United States Patent 11,001,841 (CCCTC-BINDING FACTOR (CTCF) RNA INTERACTOME) - sequence listing, part 33

SEQ ID NO: 79707 - DNA, 1007 bp, Homo sapiens
gtgtgttaacttgtattacatgtgttttgaaaaaaaatgcacagggttaacattgttttctcttaaactttcatccattaaaatggttgaatgtctttacagtataagagtaaatgaagcaaaattaaggtttcaatgtgtcctgctttaatgtttatatacaataatttatttgtgcctgcaacatttgcctggggtatttaatttttaaaaattttatttttatttaattcctattattctcctatttaaaatatcacttgtaaagaaggtgtacaagataatgttaaaattactttttccttgggtgatatttgaattggaagcattggaataaatgagcaattagaatttatggagaaggtgatggtttcttgatttattaacaaataattttatatgtttttataatttattataaaatttattttatgactaatctatagatgtttatagtattaatactagggatttttttctacattaagaaaagaaataaccaattattcaattatttccagtggtctttttgtgttctgtgtttccaggcgggcacatgaacgccccccaccccatccacataggatgcacccaaactatggtcatgggcatcatattcatgtgcctcagactatgtcctcacatcctcgacaggctccagagaggtctgcctggtcagtatcttctttaatttcaaaacagtgcttcacagcttgtggtaaaactattggaagagatgccttgtgattgattgctttgcagaaggatgatgtggagaaacctaatccccagtttaactgagacactgcctctgggcagatagaggtttggagaggaaagaataggagctggggcagggaaccatatcaagcaggagtagtactttttttaggtgttattttatgtttaattgaaaaataataattgtatatatttggaggtacagcatagtatttcaatacatacatacattgtgaaatgattaaatcaggctaatggcacattta

SEQ ID NO: 79708 - DNA, 1133 bp, Homo sapiens
gcacaagcactgggaactccaagtaagctggtgtttctaattttaggagtgagggtcaggcagcagtgagaaataaaactgttctaccaagaaactggaactcaggaaccattgaaggggaaatgtcctgatcaaatttatgattttagagttatttaatcagattatagttagatcacctcctcagttatgtggaaaaatagatgtaaatgtgggaaaccagttaggacattatagtagaagaggtaaatattgatgaatgcctgaatgaaggcaattgtagttggcataaaaatgatgatacacatttgagagatatttagggtttgggtgaaggggttaggtgagttaggtcttggatgtactgaatctctatgaaagttgaatgtccaataggaagttaagcctgtggtctggatttccaaagatatttgggttaaagatatgttttgatctgtcagtatatggaggtaatgaatccatggaagaggattaggttttcaggaaaaatgtgcagagtgacaagagggtgaaaaaaccttagagaatgacaatactgtatttaaatgataatactatgctttgaacaaaggattctgagaactggcttgaaaagttgagaaacacagttaaaataatatcagaaaatacagttaccacttgaacaatgcagaggttaggggtgttgaccctcctcacagtcgaaaatcagagtataacttttgagttcctaaaatcttaactactaatagtctattgttgatcggaagccttactgctaaaataaacagttgatcaacacatattctgtatgttataagtacgtgataatgatagtctacaatagataatgatagtttacaataaagtagaaaaaaatgttaagaaaattataaggaagggaaaatacatttactattcgttaagtgaaagtgtatcattataaaggtctctttccttattgtcttcacattgagtaagctgaagagtaggaaaaggagggattcatcttgctgtctctggggtggcagaggtggcagaaaatctacatgtaagcagacccatgcagttcaaacccattttatgttgttcaagggtgaactgtaatatggtcagtatggtgtcatcacaaa

SEQ ID NO: 79709 - DNA, 1068 bp, Homo sapiens
cacagaggaaactgcactgcaaacaagatggggaagaagggactgaggaagacacagaggaaaaatgtactatctgtttgtctattttagaggaaggtgaagatgtgaggtaactagatattaattatctaaaatccattgtcaaaactgtacatgggattttatttgaaaagtaaattacaccgggcatgatggctcacacgtgtaattccagcactttttgaggccaaggccagaggctctcttgaggccaggagtttgaggccaacctgggcaacataacaagactctgtttctacaaaaaagaaaaatagtacaattatttgcatgtgatggtgtgcacctgcagtgccagctactcaggagactaaggcaggaggatggctcaagcccaggagtttgagactgcagtgagctttgagcacaccacactgcactccagcctgggcaatagagtgagaccctgtctctgaaaaaaaagagtaaaagtaaactggaaaccaaataaagattacttttggcatatactgttaccaatttctggcacgtagaactggcttcatctggcgagtgaaacaataaaagattaaagtatctatgttaccaacatgggagtgggaaatatactgcctattgtagggccacacaaggtttggccagggaaatttcgtagtcaaaattgtcttctgtaaatcttgcagaaatgagaatttgagaggctttggaggtcctagaaagttataatgtgttcttcaaaacttaaacagggatccagattagtcctatgcagtctgttttacagcatcttttttttttttttttttttttttccttttctgggagatggtctccttctgttgcccaggctcagggcagcagtctcagctcactgcaacctccacctcctgggctgaagcgatccacctacctcagcctcccaaaatgctgggattacaggcgtaagccactgcactcggctatagcatcttttataaactggttttgtcataaaatttcctctaaactagtaggactattcccttcttgcacctttgttgtttagaaaat

SEQ ID NO: 79710 - DNA, 1836 bp, Homo sapiens
tgctaactccagggcattggcagctcctgtaccaaaacaaaactggaataattggcagtgtaatttgtgttcttacagtttttaagattttatataatttggtcctgtagctttgaaagttaattatcttgatcatttatatattatattgcccagagtgctaatttaatcgatgtgttttttatagaagaggaagatgcttagtaccttcaaaacattattgaattattacatatataatttgttaactacgtacaattatcataaaattaatttttgctttttgttttcttgccaataatagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcac

SEQ ID NO: 79711 - DNA, 1026 bp, Homo sapiens
tcttttgagaaatatctattcatgtcctttgcccattttttgatggcattattttctttcttgctgatttgagttccttctagattctggacactaggcctttttccgatgcatagtttgcaaatattttctcttaatctgtggttgtctattatttcttttgatgtgcagaagctttttagtttaattaggtcccatttatgtatttttgtttttgttgcatttgcttttggggtcttagacatgaattctttgcttgggctgattattagacgaacatttattgagcaccaaccatatacgacaaacgatgtactaggtgttgggaatacaatggagaacttacatgaatcaccagtcacacaaatctcttttatctttttttttttttttttgccttacttgagaatttgggtttttgagtaaacgccattattctctctttttttaagcacacttttgcatctcaaccacctaacacactgcatccctgagcaacccggaggggccggttcctgcacccaggccaacacaacttaaaccccaacacaccagaagaggaataaaggccaaccaacttccgcccacccactacaaacgtcgagagaaattcgtagatgaggccttgtcaaaattcagaggcgtcctacgtctgctttcccaatgagacagttcctttttgtttgtctcagagactggggtttttttttttttaaaagactgtaggcagaaaaaacaccccaaccggctgttgtgacaatcaaacgtgtctaagaaaattcagccaatgagagtgcgagagtgcatcttgtgttggccaatgagaacagcgacccgtgcgcagggccgcccaatggggcgcaagcgacgcggtatttgaatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccct

SEQ ID NO: 79712 - DNA, 1072 bp, Homo sapiens
ttattaactattaatattatagctttattatttttcatcttaatttactttttaccaagctctgtaaaggaaggtttttaaatatatgcctttaacttgcagggatctctaacaagtgatatgggtactatatgagaaataatcattaaatactaataagctttgaagttctcttacaggcccacttgaatactcagaatagctttgcaaggttagtgggaggatctttattacggataaagtagatgggtgatttgcctaatttagagtgatgttattaatcacaaatagcatttttagacttcctgaaatgtaccttttccatcttgcaaatagatcttgacgtattgtcctttcccaaagcaattctaaatttgagtatctaacattagcaaagtatttcaaattctttcaaggtttcattacttttttttttttttttcaggtgtccagtgatttggagaatattgacacaggagttaattctaaagttaagagtcatgtgactattaggcgaactgttttagaagaaattggaaatagagttacaaccagagcagcacaagtagctaaggtaacaatgatgaagactgaatgtgaatacagaggccgattctgtatagtgctgagtcccacaacgctggctgtcttgcgctattcatgtttctttttccttatagaaagctcagaacaccaaagttccagttcaacccaccaaaacaacaaatgtcaacaaacaactgaaacctactgcttctgtcaaaccagtacagatggaaaagttggctccaaaggtaggaagttctgaatttacaaacgtatttaatgaggtagcctgtttttagccagactacaagggtgcctttatcattgctgtaccttctaacgaacattcatagctggagctctgctttgaagcaatagtgtaggaaatgagtatatacaccttttaacttaataacattatgaccttgaagctgggcatggtggcttatgcctgtaatctcagcactttgagaggctgaggcaggaggatcgcctgaggccaggaattcaaggctgcaatgtgcta

SEQ ID NO: 79713 - DNA, 1381 bp, Homo sapiens
ggcatgcatgcctgcatagttcttgctcacctggttcttcctcagtttaagacctttgatttaagaggggaggacatgttttaaactgtttttttgttttgttattgttgttattgatgcatcctcgaagactggaaattataatcattgagctttactgtaaattaaaattgtctttttttttttgagacagagtctcgctctgtcacccaggctggagtgcagtggtgtgatctccgctcactgcaacctctgcctcccaggttcaaacgattctcctgcctcagcctcctgagtagctgggattacaggtgtgtgacaccacaggcccagctaatttttgtatttttagtagagatggggtttcaccatgttggttaggctgatttcaaacttctgacctcgtgatccacccaccttggcctcccaaagtgctgggattataggcgtgagccaccaggcctggccgcctcctctttttaaaaaatattttattaccttaatatatatttgtatagcttagcatcttgttaggttttacttggagaagtactttttttttgaaagcattgatttggctgggtgcagtggctcaagcctgtaatcccaacactttgggaggccgaggtgggcggatcacaaggtcaggagatcgagaccatcctggctaacacggtgaaaccccgtctctactaaaaatacaaaaaattaggcgagtgtggtggaaggcgcctgtagtcccagctactccagaagctgaggcaggagaatggcgtgaacccgggaggcggagcttgcagtgagccaaggtcgtgccactgcactccagcctgggcgacagagcgagactccatctcaaaaaaaaaaacatttaaaaaagcaaagatttttttatctttcattaataaatacttgttttaactgctttataaatttttaatttgcataatttttataaataattacccagtcagcataggaaagtgaaatactgagttgtgaacttgctcagtcttcgctcccttctcctattttatttatagactgcaatatgcttttctcctttttagttgccagtttttcaatttagaataaattagttaaagagaagaaaacattatactgcagaagaggctgctactaaagtagaatgatcagctccagtaatctttgaacccaggtggtcaagtttcttccatttattgagcacctactacgtatcagggattatatagatgtttgaggtgccttagtgggcaaaaccaattaaataaacgtaagcttttagagcttacattctggcagaggtagacagaaaataatacacatactatataaactatagaattttagaagtataggtattatgagaaaaaacaga

SEQ ID NO: 79714 - DNA, 1023 bp, Homo sapiens
gtaacatttaagtaaaacttgaagtaagggaattacccatatggacataggggcaagagcattctgggtaagaagaacctggcttgagtgaagcagtcaagggagagaagcaggagatgggtcagcgagggaactggggagggccagattatataaggtctgtaggccattgggaggacttaagttttcagtttgagtgaaattagagagttttaaacagagaagtgtctcttgaagaacttcacatactatatcttgaattattcacctcttggtatgaaatttgttgtgtctttaacatatttcagatgtgcgtatgatattgatatttaagccagttggctctgcatgtatttatggttaaggctgctcctacatgtgcctaaatttgttggtgtagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggtaggtgggcctttgtgttttggttgtataagcaatgtggaatttaccacacagctgggaagcaaacaaggtcagctttttaaacttttgattctacccacaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggtaggtgtggcttcagggacttcacgccagtggctcattgaacattgcatttatgcttgggggatagaaaactaaagtgggtacttctgaaaaaaagaccaaaaatcaaattgtgagaagccaaagaactttggggactaaaaagggaagtaatccaagtgtgtcaagcctttgatgatgcggaccaata

SEQ ID NO: 79715 - DNA, 1011 bp, Homo sapiens
gggcctgcttgcacaatttccatagtttggtgctctggtgttaagtttcctcatctgaaaaacgatgagtttggctggagaacctccacatttccagccaactatgtcattgaatcactgtagaagaagaaggtggcagtatttgttttttttaaaggagcaggggttgtgtgtggagtggactgagaatgtagtgtaataaagagtaatataagaaaataagaggcaaacataatcttcagcatatttatgagtgggtaatgcacagcccctgacctgttagaagagacagcagatataaattgccagtgtgttatctaccaaacaatagccctgcagataaggttttatttatttaaagtcaacattcaggataggggtttaggtcaggcacaaattctgtccaaacaatgtaataaaaattactttacaataatgaccctgagatactacaaaatcccaggtagcatgcattcctctttgggcaggaaagcacaacagtattttaggtaggtttctttattttttatttttttgagacagggttttattctgttgttgcccacgctggagtgcagtgacacaatctgggctcactgtagcctcaatttcctgggttcaatcaatccttctacctcagcttcccaagtagctgggactataggcatatgctaccacgcccagctaagtttttgatttttttatagagatggggttttgccatgttgctcaggctggtctcgaactccttagctcaagtgatctgcccacctcggcctcccaaagtgttgggattataggcatgagccactgtgcccatccgtggtagatttttaataatgagagttgaagcaagaaaagtacagagtttgggaggaaaaaaaaaaagcaattaagggaaacgctttaccctagcctgagagtctgcctgactccaaagcattagcgaaagattttctaagctgaataatgggtatgcttttggtaaggattaaggaaatgagccatcca

SEQ ID NO: 79716 - DNA, 1049 bp, Homo sapiens
aaaacaagggttcagagattcctgtgggctgtcaatacacaggattctaaggtttagttttccacctcagtgctatatgccaggacccaaggctgtggggctgtggctggttatttgtaaaggtacagtcacattaatagcacacaattcatttcattctccagagagggcttatcttggaaacatcagaagacgggttccccttggccccagatatggttactctgtgacctctttgtgctttcttgcatggttgaggaataatggatcttttgatttgtgtctgtgcctgcagttgcataaatacaacagctttaagagtcttcagcaacattaagcataacatcccagcattctatatgatatttgttgaagaatatgggtctttgtggctttatagtgagagcctctctgcctttctagaatataaataaagagtggtgaagagaacccagcctttttagccggaggaagtgaagattcctgaaactctgtgtagatattaaaagagctatcagttttaaaagggggttaagacatgtcctgtggagtcgtagggatggaactagcgccaactgaaagccagttggtgaactctgccaggaggtagattttggctccagtaaaaggaagaacgtagcaacccaaatatgagttgccctcgtatgtaaacagcattttgttcctgggagcatccaggcaccaggtggatggggatcaccaggcaggagtgttcagagtagtgttgtcaaatggtagataaggggaaagagaggcctctctaacactggacctgctgtttgctctctctgagcttcagtttccttgtctaagcactaatgtaatgccatcaaacttgcagcaaacttgttgggaggactagaaattatatacataaaatctctagcatggtacttggcatgcaggcgtctgctcacttaactctagcttgagggtggtaatgacggtgacagggtgatgatcataaggacccccgtcacttcatggaggttgaactagagacttgtaaggaatcttccagctctgca

SEQ ID NO: 79717 - DNA, 1047 bp, Homo sapiens
cccatgccaagaactcccagactaggagtcctcccatgctaagtcctcccgaagtcctcccatggtaagaactcctagactaagttccgctgacacaggaaatcctcgcaatccatgaagactaagaatggaagaaaggcctccttgagccccatagcttcctccaagaatcgtgtccctgggcctctgaggctaacactactttaatcaggaaaagctttgggcctttgcattaaagatgttctgctctcacatgaacatggaattgggacgcctgtcaaactcttactccacacagaaggcaaaactggtgcgctcaggaaaaagcaggggttttatgtgctcaggcgtctgatgtaccaagctggaaatcctagttccagtctgataatccaaaacagatttctagttgcatccattcttgcctgtgtctctgtggtttctgattctatctgttcctaatttccctggataaaggaccaggcagtgcagtgcagtgaagtatttaaaacgtgccaactcaggatgtggtaaagttgctaagcagatgagtccgcagtgtccattttgcagccccacctcaggtaggtttcaaggctattgttttttttgttttttttttaaagctctaggcgctgactgattttctgaaggccttcctaaacattcagctcactggctgggtcccaacctgagcggggcagtgcctgctggccacactcttcctggctagctgggccctgaggctgccgtggaaacccaacaggaagctcctgctttgtttgtcattgcatggggccctgccatgcctggactaagccaggttggccacagcgtgcttggcaggcacagcaggtgaaagtcagggaaccacagctctagggtgtgtgtagtcgctgtgccgagagtgacttgttctttctgttattgcccaggtatgtcttcagtccctcagacccctggtggagtgctcatgactgggaccataaattatcctaattgagctacatttgtgtggttgttttgttttgttttgttttgttttgt

SEQ ID NO: 79718 - DNA, 1048 bp, Homo sapiens
gcttgcagtgggccgagatcgcgccactgcactccagcctgggtgacagagcaagactctgcctcggaaaacaacaacaacaacaacaaaacccacatcagacaccatagggtttgtttttgttttgttaaatgtatccatgtcttttggcttttctcatttaaggttgttttgtgtgttttcctgttgttgttttttggtttggtttggtttttattctctccttatctgtgttatcaaggttttttcttgaacctccctaatttctaaccccctgggcttttaaaaagaaatctaaaatccagcgaatctttgagatagtctctaggaagttgggaatcgtttgcctgttcatcctttctctgagtcacaagtgtattttctgtgatacgcccaaaatagttctgggaaagaagaaggaaacaagacttactcagaaacccaatacacaagataagaaatatcaatggatattcttacaacaggcaactgcagggctcagattttaaacattctgtccagttgctaatctgtgcattccacttggggtttagaaatctgtccttatgcctattgtttacagcactgaagccaggggaattacgtggtccctcccctggtgtttggagtttgagttgttgtttctgcacagatggatctgtgaggagagaagttgagtggcaggagaggataggtctgtctcccaagcatgcacccggataaacagagacaacaaatcaagcccagctgccttcaaaccacattggcttgtttacttctggaacatttttgcaatgactgttcatcatctttactttggatttttattggttgattttatttttttcctagagagtcatgtaagccactctcaaggtaaatgagaaggtttcctactattttacaagtggatcaagtgcagatttacagagaaagctttgcgtgtctaaatgaggaggagcctggcagagcctgaaagacctaggttcactttctagccccacccagtcttagttccaatgttctcatctgtaaaatagagatgaca

SEQ ID NO: 79719 - DNA, 1028 bp, Homo sapiens
ctttcgggtatatgcttcaaagtgcaattgcttggtcatatggtaactctgcatttaacctttgagaggaactgcctgattgttttctgaagtggctgcaccacttcacattttgtaccaccagcagtatttgaggcttccaatttatctaaatccttgccaacataagttattttctaaccatcctagtgagtgtggagtggtatttcatgatggttttgatttgcatttcccagatggcaaattatattgaggattttttcatgtgcctgttagccatttgtatttcctctttggagaaatgtctgtgaggccctttgccattttttaattgggtgttttgtctttttatcattgcattgtaataataattcttttactgttatttattgtagaataaatcagtagccataagtattcattaggctgtctgtttagtgtaacacataagtgcaagaattcttgataattgtgccacaggaagagcggaggtttaacttgactgaataaattaacagtatgaagacaatttcaggaaaatgtttaacccacttaagacaataagcttaaaatatttaacctcaaaaattttgtacaatccatgtataaatttaaacttatttttatatatcccttaacatgtatttggcaggacctatacttaaattgttcttattttgtgttgtttgtaaaaggataaaatgtggtacccttaaaatgttacatcactctaacttctctaatgattctgtggcgttccactgtatttctacatctatttaatttccttgaaggaatagggaaacaaaaaagaagtaagccaaatgtagtgttttatttatttatttagagacaaagtcttgctctattactcaggagtgcagtggtgcaatcataactcactgcatctttgaactcctgggctcaagccattctctcccacctcagtctgcaagtagctagtactacaggcatgcatcaccatgcccagatgactttttacttttcgtagagacagggtctcgcta

SEQ ID NO: 79720 - DNA, 1059 bp, Homo sapiens
ggatttaggcactgaaaaatagccatgcaagggttccgccagagtggtgaggggagaagctagaatgcaagtggttatgtcatggcaaggaagtagatcctgcagcttggagaagttcacagtcaaggaaaagcttctaaagaaggcaaagagtaccagagagcaggaagctgcatggcagttttttaacatgcaccctgcagtgagaaacatggaaaagccagcttaaaaagccatagcaagttgggcaggaactaagtaattaaaatctgttttgctttccactcttccgagggtggcagtccagttcctttcagtggacaatggaaaatcctcagctcttgcaggtctttccagagttaggaatcaaaatttgcagagatgacctggggctactacaagtacatatttgggggccaggactgcctgtaattttagaaagcagagatagaaagtccttagggatggtggctgcaggatgcaggagtgacttcgggtgccttgtggtccacatcatggctcaacctgtgttctcttgctccagctcatcgagggcgcctctgcagagcagaaacacagccttggcatcaccagcatggactattattactacctgagcctctcgggctcatacaaggttgatgacattgacgacaggcgggagtttcaggaaactctggtaagtgctggcgcagggccaggcaggatctgctctcccaactggccatttcctgtggccaaaagggcagtgaaggttaataaagcaaagagctgcatgaaatgtccgcctctttctctgtgagcactctgtatgctcatacatgtttcagtatccttaaacagccatgtgccagttgcctgaggaccacttaatgatttgagatgggtaaaaagaaatgaattcatcattatcaccctgcaggagctctgataaataggcaaaaatgattcatacgttgagcatacctgtttgctgatggcctactctattcgtgagctatttccttagaaaagctaagcaaaccgcacgtctatggactgaataggtttagacatttt

SEQ ID NO: 79721 - DNA, 1037 bp, Homo sapiens
gcctgcccaccgcagccctctggctttgtgcatctgtcttatgccctactcatgtaacctaacgacatcccaaagtgactggacctggcctcacaggttgcctcttaactggcttacctaactggtaatgaaaatgtcaaccaagtgcattgttatgaatgctcatttagtcatgtttctgtctgggtgtctccagagggggtaaataggaaagctggcaaggctgaatatgaatatgttccccttgacaaaagccacatttacaaagaaacaaatgtttatccagtaaccttgatttatatagattttgcatcttatttcaaccatagatcatgtctggcactaaagcattcacggagccatctgtgaggctgattctggaacgttttaaaataaataagtgggaattttggagaaaaacaattttcttttccactgtctattttggaaagaagcttctatttccaagagaatttttactatgtgctcatataataactgtcaagttccctggtgggttctatctgttagacttgcccttactttctttgctttccaatattattcaaactactcatttgtttgtctctcatatttgggcccaatgcctgagttgtgttatcctgaagaagttttccagataataaaataggaaagaagaattaaacaaattttccacttgaattaattttcaatctaaatcttataaaaatggacttgaccaaatttaactctttatttaccttttcccctgtcttggattccttggagaccagaaaaaaaaaacaattaaattgatattttcattgatttttgcaatataaattattcattatatttggaggatatatcagtttctgtaaataacaaaaacactcaacatttattatttttctaattgcaaaattttatacaaccctgatagaaagattggaagagacaattcagacacacattcacctgcacacacacacacacacacacacacacacaaacacacactgtctctctctctctcactattcaccatcatggat

SEQ ID NO: 79722 - DNA, 1099 bp, Homo sapiens
cccctgacatgtatacacacaagtacacatacacacacgcaacacacctggctgatttgattgtccttattgagatgtaactagttgtgacttcgtttagtaatcttctgatcagggatagctgccacccccaaatccctaaagccatacccacatctccactgtgttattaatagcctttgtatactcgacttccctgtaagacagtgagtgagctcttctctgacaggagccacatctcattctggccttcggcttaacacactggggcagagggggttgttagacagtgtgtgttgcatgaacaaaagtagacatcatttttgttttaagtgtttgtcctttttaaaccacaaacaaaaagttggaaaagtgatatttcaattacgttgattcagccagttacaagggaacaccagttcctgtggtacagagccaggagagagatttttagatcagaaatgggggatgggggtgcattggtgagtcgtccaacagtggtaacagcggatcctacttattttagggaatatctcaaaaaatcaaaataaaaaagaactgaaatatttttacatttgctgaataagttgaagtgaatagaaaatactattgacttttaagtgaggaataacctttctcagaaaaataattatggtccttggattataccattgtaaatggctttttttccccagaacattctttccatttcgttgatattttaccgtatgtttccatttctatagttagtacacagaccccccccacacacagacacacactctacaatacttcctatttgaattaatatttcctataaagtctgttatgactttgatttaaaattgcttggcttgttcccagctggctatacaagaactagggagtttgttagaaattcctattcctagactctgtccctggagactgggatccagcaggtcagaagacgggcccagacatgggcaattaaaaagtactctgacgattctgatagactgccagatttgggaaccactgggatattttcctaatttctagagtatttgtgtgtgtgtgtccattttataagtcaattaaattaggacgggctgcctgg

SEQ ID NO: 79723 - DNA, 1060 bp, Homo sapiens
ggagatcagcccggacaacatagcaaaccctgtctccataaaaaagtttttttaattagctgggtgtggtggtgcacacctgtagccctagctactagggaggctgaggcagggagatcgcttgagctcaggagtttgagattacagtgagctgtgcttgaaccactgcactctagccaggcgacagagatggtgttttgttttgttttgtttttttaataaagcaaacccaaagatcccctttattcctcaataattagtatgtgcctctaagaaatcattcttatcacaccttaaacaggaagaattcttttatagtatctaatatcagtattccaattccatgattttcctataaattcttttttatagttggtttatttttatttaggatccaaacaaggcctacacaccgcacctggttgctgtgtctcttaggtgtctcggtctttaacaattttcccttcccctttttgttttcttggctttgttaaaaaaaaaaaaaaaaggttgtttgtcctgtagatcttactatacagtctggcattgcctaattgtatcctatgatgttgcttaagtattccattgtcccctacattttctgtaaattaatagttatatctaaaaacttcattagacgccgggagtggtggttcacacctgtgatcccagcactcttgggtgggcagattacgaggtcaggagatcaagaccatcctggccaacatggtgaaaccccatctctactaaaatacaaaaaattagccgggcatggcggcgcatgcctgtagtcccagctacttgggaggctgaggcagggaaatcgcttgaacccaggaagcagagttttcagtgagctgagattgcgccactgcactcaagcctggcgacagagtgagactctgtctcaaaaaaaaaaaaaaaaaaactcgatcagactcagattccgtttttggcaaaggaaacttcatcagtgatgctgtgcacttcatgcctgttgctctctcttcgtgtgtccagattgtcagtgaacccgtctgttataaatcatttcagagcc

SEQ ID NO: 79724 - DNA, 1089 bp, Homo sapiens
ttttctttaaatcaattaaattctccttagtttttctgtagaaacagccattttattttttgagacttttttttaaattttttattttattttatttgctctgtcacctaagctggagagcaatggtgtgatcacagttcgctgcagccttgccttcccaggcctaagtgatcctcccacctcagcctcccaagtagctgggactacatgtgaagaccaccatgcctggcaattttttttttttttttttttttttttaaggagatggggtctcagtatattgcccaggctggtctcgaactcctggactcaagcaatcatcccacttgtcctcccacagtgttgtgattatagcacccaaccagaaacagccattttaaaccaaactttattttttaggtgtcttcccaaatagtattatccccaagaaccctactgataaatttagggagcaggtacaaatttccctcttcatttcattctgacctgagtcattgattcacgattggcctagaatagtccaaaataaatttttgtttttgttttttttcctgaatatctccttaaccaggccctaatcagaatttatgtaatctacttggtgaaaaatcaagacttaatgagatatctctttatatagcaaattaacagtttttaaaatgttggtcactttaggagctcatatgcaactgaattcatatttattgagtaaccaagggattggtggggaggtggtacctttgtctgttgtcctgagggcagccctttattctttgtgtgcagtgatcaatttgtctaggacaaggcggcagtaaccacattccctttacaactaagggaacaagtaccctcctccatggaaggagcttatttgcctgtttgtttttccctggggatagatgtagacatgaaataaacatcttcctcttctgaagtgaagatggttctagcagtgctgtgtttctttaaaattgggtttaccataagaatcattattacttcattcattaattgtttgtttgttttcttttttgggagccagggtctggctctgttgcccaggctggagtgcagtggcatgatcatggc

SEQ ID NO: 79725 - DNA, 1088 bp, Homo sapiens
cagactctctgcaaagtctcaaatatttactttctggccctttgcagaaaaaaatttgctgacttctgctccagatacctgtgcagggcttccttttttttttttgagatggagtcttgctctctcgccaggctgaagtgcagttggcgaaatcttggctcactgcaaccttcgcctcccagattcactccttcctcagcctcccgagtagctgggactacaggtgtgcaccaccacgcccagctaatttttgtatttttagtagaggtggggtttcattcaccatgttggccgggatggtctcaatctcttcacctcatgatctgtccacctcagcctcccaaagtgctgggattacaggcgtgagccactgcgcccagcagcttcatttaattgaattgtacaaaaacagttatgttcagttgcaggtttttattttatttggtcaaaatactgaaatatgcttactttatccggacttaacaccgtcaaaaaatgttaatcacttttacgtgcagcacccacagcacatgaaaactggcagttaattgattagaaggagctgggtggcaggatgtggatctggactgtctggcttcaaaccttgctctgcatagatttggtgaccgaaacgttttgtgacctctgtgccttgctttccgtacctgtaaaatgggagtaataataaaatctcccacataaggctgttgtagggtgaaaccaaataaagaatgcagcaagtaaacagtaagtatgagtcattattaccatgcaggtgtgtaagtgcttcccatatttccgagttattttccaaaaattccactgtaaacttgtttattggaaattaaaatgcattttgccacagaaaccgttataaatggagtattgacaagcccatagaagtcttcatttccgctgaatgtagtagttgtacaaattatattttgaaatgttcttggaatgtgggctggacttactgcattataaagatggaaatacggttttttggtaagctgagtataaaaacaaacaaatgatgtccgtagtcagtccttcataactccaggcggcctcactcctcccaatca

SEQ ID NO: 79726 - DNA, 1051 bp, Homo sapiens
tttttatggggctttaaaaaatgcagaatggaaatttgattcaaatatgggttgacttcattatcaacagggaactgtgatatttgcttaagttctataggaattttgtttgatgcaactatgtaaagatatcctggtggaactattgtgagagttagtcatggacatgcaaaactctgtgtcaaatctatataatagtaccaaaaagtttaactttgatgccaatagtgccttctgaaagtatggtatcatggatgacttattaaaaagtggagtctttgcttctgatgtaatatacatcttagatttttacccaaaaagcttggggaagaatagttttcacatcagtggcttattatgattacttaaactggttttttgactattagctaaaagcacgggaacctttgcagtaataacttttgcagcggctgcctatcccatcactggtaagtcgtggggggtcgggttcaacttatcaggtatttaacaaacaatactgttaaataattaacagcattattccaaggcatttggaccattctgaccagtactctgctgtttcttatttactataagggaattttaccaatatctgtagttaaacctctgaacctctgttttcaaggattaacagatatagttggatttattggctacattataattgcatcatttaaaacatttattttctttttatagcactttgggaggcagaggcgggtggatcacttgaggtcaggagtttgagaccaggctggccaacatggtgaaaccctacctctactaaaaatgcaaaattagcggggtatggtggcatatgccttgtaatcccagttacaaggcataacttgtaacttgggaggttgaggcaggagaattgcttaagtttgggaggcagagattgcagcaagccaaaatcgcaccactgcacttcagcctgggtgacagagcaagactctgtctccaaaaaaaaaaagtgaatttattgtatttttaaatgacaaatagtaattgtatatagttgtgggatataatgtgattttttttt

SEQ ID NO: 79727 - DNA, 1169 bp, Homo sapiens
ctctgttgccaggctggagtgcagtggcccgatctcagctcactgcaacctccgcctcctgggttcaagcaattctcctgcctcagcctcccgagtagccgggactacaagctcatgccaccatgcccagctaaattttgtatttttagtagaaacagggtttcactatgttggctgggatggtcttgatctcttgagcttgtgatccgcccaccttggcctcccaaagttctggaattacaggtatgagccaccgcgcctggcccagactttgatttttatttagttaactatgtttatatattggtctgtgtgtctaaaatttcaataccgatttctaaattgctacctaaaaatactgtgcagtttactctttgtagaagtttgtaagagtattgatggtcacctcctccccactgccctgtacggggtgggggaccttgttgtatttacacaacacacttaattgtctcccttttctgggcatttgaaggcatttgaagatagtggttaccaagtatatgggtaactcctcctttctcccagatgcatcaaagaacagtgctccctgggacactaatgaagtgtttgcagaaccgctgccgcgtggggccaggcctaccctggggctgtctcctgggcaatgaaggtggactttcaggagagaataatccttcctgtgtatgctgactcacctttgctcttcctggtccccaccctggtaaacagacaccagtcagtgaggttccacctttgaaaaaatcagtcagggaatcacccatctgaggttcccagcctcaaggccgagttcttcctgtgtgtgagggactctggtgtttgggttccacctcttaaatgttagcaacaaaccaggctattatgtggataggggcgtaccctactttccagaacttgcacatgaatcaactgctttttaataaactacgtcatccttagaaacggaatgtggatctgagagtgtctgcactcaatctctatctaatggaaatttctccgtcataatttgtaggaagtgtcagggataagagtaacttttcattattgttattattacgttcatgtcgtagctggcacgcccgccactgccctcctccctttgtacagtgtgctgcgctcaccaggagctgctgtaaaatgcaataccttgc

SEQ ID NO: 79728 - DNA, 1003 bp, Homo sapiens
ccgtgtgtgtgtgcctgtgtgcaccagaaatgaccgtgcgtgtgtgtgtgtgtctgtgtgtgtgtgtgtgtgcgcgtgctgggcaggcagagccatgggaacaggaaaacccagcacccccttcagccttttcctagggactggcattcattgccaggcatgctggttgggaagaactgcccaagattttcatctagaagagattcaagaggacccaaagcccaggctcttaggatttcaccagatgataaattataaagtagctgactggtttgtggtgaacagttgctcaaatgcccttttagcttctcagtggtgacaaagtatatctcacggagatcttacattacattaaagatttaggggttccagttaggatatttaaaacctttgccagataggagatggtatcacatacctcacaccaaatttgtgcgtctcacagctgggcattgagatttttaaaatagcaacttctgagtggaaaattgttagggaaaatctaatcaacttaatttaaatggcataaatgatgattagagctaattatcgtcagaatttgggctggtgtttctaaaatgaaactacagagtttctttaaatggggtcatcaggttaggattcagttgtcaagaaagatcaatgatttgtgtgaactcacagtcttctcagcttacctggtagccaggggtaatatttcacacttcggagtgaattgcatttatattctttttcttcatagctcactcaggatttttagaagatgaaagaattgaatcttatggcaacaaagcccatttcttcacagtggaactataaatgcagacttaagtaattaatttgtaaacctttgtatctttttaaaacatcatcctatccccaaggcctaacataagttttgttgactaggtgaaatgattgaatcagtgaatgattgaataaatgaaaaatataggatgcagttcaggaaagaaaaccacaagagtgcggcggctatttaaaa

SEQ ID NO: 79729 - DNA, 1050 bp, Homo sapiens
cactttgaagtccatcccacagaagtattagctcaaggctgcaaagatacaggaatgagaacgcttgctgcaacgctgctcataacagggagaccaggaaaataacccaaagggccattcacacaccaggtttttgagatgaatgacatcatgagcaactcatgagcatgagcaccaggcgtgcctcaccatcttggctccttgttgataacgtgtcagtccctaatatccagcctgactccaaggactgagatgatgagtgtgaaagtactttgtaaattgcaaatggttttgcaaacctaagggatatgatgaatcaacaatgagcaaagtcctttgagacctttcacaaataaaggcattttatatatttaaatccttggcactcacaaatttagcatttgaggttttgccaacctgtggagcaaccccatggcaatttgccatttagctgaggcatatattttcctccatccacaacctgagtatctcagacgaggatgaggagtgagtgaatgaaggagaaatgttaaaatatgattacattatagagtctttaaatgctcattaaaacatatattcgttcagtatcttttatgctttcattaatgtgccctaggctattgagaaagaaagagtaagacaaaaaggtgaaaactagaaatattctatgtaatggaaaagaccataaatatactcataaaacaattagtgagcacagaaatatacaatcaggtaatctataataatgtacatgtaataatctacaacagattttttcccttattttggattctgagaagtgagcactaacatattgcaaagggatttaattgcaaatgatttgtgtaaacctggtgccatagaaaaacttctggggttgaatttaattttatcgcatttaaatagaaaaatgcccacctgagaatatgcagctgtaattacgagggagttttattggttgttactgtggcatgtgtttatttctctcccacttaacattctggatggagggagttcaaggctgctgtgtagctctgcagttgtctg

SEQ ID NO: 79730 - DNA, 1099 bp, Homo sapiens
tagagtcggggtttcattgtgttagccagatggtctcgatctccagacctcatgatctacctgcctcggcttcccaaagtgctgggattacaaggcatgagccactgcgcccagccaagactttgtatttctaacaagtttcctggtgttgctgatgctgctggtttgggggccccattttgtgaactagcatgatcaaggatggtgttctcgcctaatcccagcactttgggaggctgaggcaggaggatcgcttgagcccaggagtttgaagctgcagggagctatgatgccattgtaacagccagggtgacggagcaagattctgtctcttaaaaaacaaagaatggtgctctaaacgcaaggtttttcacagcagtagtgacagctgctcctttatgcttctgtttcttcatttgtgttgtccctggaaagtccccctcgtcccagtggctgagtcctctgcttcctccaggctcggcccaagttcctgttcctccacggaacctttcctgattagtgcacacgatcttttctcttctctgaactctttcagttgtaaaaatgaaaccctaaaatttcttttgttgccttgtagtatgctcagattgatgcatgataattgttttcccaactagactgaactgatttgatttgtgaacacgatcatcccttagatgctcttatgtgtgttcttgaacttagcacagagccaagcacaggactcaattatttattttgtgatgaaagttcaaagtgaattaagagagaaaatatattgctgagtgttgtagtccatttggtttgctatagctgaataccacagactgggtaatttataatgaaaaggaattttatttctcctggtcctggaggctgggaagttcatgatcgaggggctgcatctagtgagggccttcttgctgcttcaacacggcagaaagcaacatatggcaagtgcgtgcacgagaaagagtgagaaagtgtgtgagagatagcaagacagggccacactcacttttaaaacaaacccactcccacaataacagcatccatttatttatgagggcagagtcctcatgacctagtcacttcttaa

SEQ ID NO: 79731 - DNA, 1046 bp, Homo sapiens
ttttggttgccattgatatttcaaaaggcaccttttttttttttttttttttttgtgatggggtcttgctctgtcgcccaggctggagtgcagtggtgcgatctcggctcactgcaagctctgcctcctgggttcacaccattctcctgcctcagcctcctgagtagctgggactacaggtgcccaccaccataccaggctatttttttttttttttgtatttttagtagagacggagtttcaccgtgttagccaggatggtcttgatctcctgacctcgtgatccgcccacctcgtcctcccaaagtgctggaattgtaggcgtaagccaccgtgcccggccagaaagcaccatttcttatatacctttaaaaaagaaaaatattgctaactaaattaagacatgtcttctgttgtaagacatattctggtttaagatatgttaaatggaaaaaaaacaaacaaactcaaaacccatgtacctttttctttttcccaatgtgctttttagaatcaatacaatctgtgtcaggactctattagatttcactttccctctgacagagccacttatgcttttaaaatagccaggtaagcaggacaatttcctttcagcccatctctggctctcatggcttccttcttacacatgctaggtaagcactttgaacttgaaaaacacttgactaaacactcatatgatctggattgtttaaccacaaaagatttggtcttctctagtgaaaaatgctgtgggtttcttttttacctttaattttacttttcaagttaaaaaatagcttttaaggtcaaaattttcagagcaatttgtaagtatagatacagtttcatggtgacagtttcttatgttgaaaaggtgacacaaaacacattatcttttactttagattcaaggggtacatgtgcagatttgttacttgggtatattgcgtgatgctgaggtttggggtactgtcatccaggtactgagcataatacccaatagttagtttttcttttctttctattttttttttttttaattt

SEQ ID NO: 79732 - DNA, 1054 bp, Homo sapiens
cacatgtccaaaattcaagtactattaaaaacacataattttaaaaataaaagttacttatgaaagcctgactgctagttttaaagggacataaataaaccttatttaccttatttatgtatgtccctttgaatctagggttttttcttttcttttttttgagacagcgtttcactcccatcaccgagactggagtgcagtggcatgatctcggctcactgcaacctccatctcctgggctcaagcaattctcctgcctcagcctctgagtagctgggactacagggccacgccatcgcacccagctaatttttgtattttttttagacatggcgttttggcatgttgtccaggctggtctcaaactcctagcctcaagtgatctgcccgcttcagcctcccaaaatgttgggattacaggcctgagctactgcactcggcctagtttttttttaattccagaaaaagtttcaagatttttttttttttttgcttttgtgttaatattttgggtgtagtgggagagggggtagcacacttgagttgctgcaggacttgtttttttgtgtgaccagagagagcccacagcacacagccgggttctcattggaaaggcatcagaacaagtgtgtgcagacagcaccgcttatagtccgtgacactcattcctccgcatgaatcagggccacacatggcttcagatgatacaggttctttcctgacatctcaaggggagtcatttgaatgcgtccgtgtctctcccactacctctcaaaatgccggactaagttaattggtaaataaatgctcaggctgcttagcagtggcctatctctgaggcatgaggtctaatatagtttaaatgtaagtccatcgtggcctccaagtagctaggaaaacaggtgggggacttcaaagagatctgagagcaagcctggccgggtctcttgtacttttccagccctggcttatgtgtgggacaatggtgaaaagcagcccttgaggtagaaccaagtgggttttttttttattcatattcggcacagatttattg

SEQ ID NO: 79733 - DNA, 1041 bp, Homo sapiens
tagagacagtcctggctcagcactgaggacatcttgcaggcagggttggctgagtgttttatggagcgagcttaagaggagatgttctaaaaccagagaggaaacatttttctctgttctctgcaattcagcaggtgatatcccttcatggatttataataaacacagtcctctcattgaccaaggttgaaaaactcagaaagtttgctcagcacagatctgggagtcaggaacgtactatgtgctgtggaagacatttcaactcctctttcaagcaaaaaaaaaaaaaaaaagtcaatactgatctagtttatatagctattataaaaaattatattaatgaaaatagaaattcatttgtaagtagagacagctaccaaattcctaagcaatctattcatttttgtttttttttttagacttgaacactttttcttgccttgcctcacaatgcagttgtcaatatagggccactttagttacacctattacctgactctgcaaagaccacagagcttatttcctttagaaggattttgtttgattaatttacactcttcgctgacatttctcagttgagtaggaggaaaaaaaggagtttaatttaaccatattagccacatcatggacagggaaatgtatggaggatgtttaagtgatttgccttattgagtaaagatatatctaagcttagattttactttgtcctataagaactctgtgagcgagatttttttttcttttttgagatggagtcttgctctgttgcctaggctggagtgcagtggcacgatcccagctcactgcaacctccacctcctgggttcaagcgattctcctgcctcagcctcccgagtagctgggattacaggagcaaaccaccacgcccggctaattttttatacttttagtagagacggggtttctccatgttggtcaggctggtttcgaactcttgacctcaagtgatttgtctgccttggctgcccaaagtgctgggattacaggcgtgagccactgtgcccagccgagcgaaatatt

SEQ ID NO: 79734 - DNA, 1019 bp, Homo sapiens
cgtcaagacgtgaatcgagtaggattagtttagcttcgtgcccaggacttgtacaggacgtgaaaaattccttgacctcctgatctttcactttgactttctgttctgtctttcaatcaaaaatgtaaaaataagtaagttggagagaaaacaaatccctcaacttcagccgttgacaactcatgaccaatcttgatttcactgttcttatcttcccctggtttctttagaagcaaatcctagatagcataccatttcatccataaatatctccatattatattggctttcacatagagcaaagctagacactaactgctcattggactgaaagaagagatatactcagagaaccaaagcaaatagcttccctttaagttttaataggagtggctttgttttatagaacgctgtaggcatctccagccactgaggggacttcttcaagcttggcccagcctcatccacagaaggatctggcagtgatatcttggcattcatagtctcagtgtgcaggacagcattggttccccaccctacagtcccagctctacctaggcagtatcatatgtatcatggtaatggctatggaaaataatatccctccctccctgcctcccttcccctcttcctctttttagagatgaggtcttgctgtgttgcccaggctggtctcaaactcctggcctcaagtgatcctcctatctcagcctcccaaagtgctgggattacaggtgtgagccaccgcatgcagcctctttcttttttgacagggtcttgctctgccatccaggctgaagtgcagtggtgtgatcttgtctcactgtagcctcaacctcctaggctcaagagagcctcccatctcagcctcttgagtatctgggactacaggcatgagctgccatgcctagctaattaaaaaaaaaaatatatatatatattatatatatatacacatacatatatatatatatgtatgtaaaatatatatatattttacagggtctcactttgttgct

SEQ ID NO: 79735 - DNA, 1301 bp, Homo sapiens
gccctgtggttcacgcctgtaatcccagcactttggggggccgaggtgggcagatcacctgaggtcaggagtttgagaccagcttggccaacctggtgaaaccccgtctctactaaaaatacaaaagtagccaggtgtggtggtgcatgcctgtaatcgcagctacttgggaggctgaggcagagagaatcacttgaacttgggaggcggaggttgcagtgagcctagatcacgccattgcactccagcctgggcaacaagagtgaaactctgtctcaaaagagagaaagaagggaagaagagggaaggagggagggccttattttttattttttaactccttagtgcccagtgtgatcattcctattactcaccagactttgtattacatccctctcaggtgtttccagaagttacattgtgcctcaaaggcggaacaattagccccactaaagatatgcagtatccagcaggtccctttttcctggaataagtataagaactgctctgaaggaggcacactctcttgggtcttttgagctctgataatgtttgttacaaattcatttatagcactttatggtcatacgttacattatagaaagtaaaacataggctacattgtagaaagcccagaagagagcttaaaaattctatcctaaatccatttgttaacttcacagagagatctagagaggttaaattacttccaaagtctcatagctagtttttagctgagctggtgccagaatccaagttagatctgatccagtgcagatctaaccttattagatcccagtctaataaggtttttcttaccaaacagtggtgggaataattctttaagagtctggacgtgaccagatagttttctttctgggacttttcaagaaagtctgcttgtaggtggaaggttactgtactaacttcattataagaaatttagaagaattcagccgggcgcggtggctaacgcccgtaatcccagcactttggaaggctgaggtggagggatcacctgaggtcagaagtccgagaccagcctggccaacatggtgaaaccctgtctctactaaaaataaaaaattagccgagtgtggtggcaggcacctgtaatctcagctacttgggaggctgaggcaggagaactgcttgaacctgggaggccgaggttgcagtgagccgagatcacaccattgcactacagcctggggcacatctcaaaaaagaaaaaaaaaaagaaaaagaaatttagaataattcacccaaagtacccccacaccctaacacagtaattattt

SEQ ID NO: 79736 - DNA, 1051 bp, Homo sapiens
gaaccacagtgattcttctcattcactcaccaggaagaatgtctaaacgttcactgcatacccagtagtggcattcagtatttatccatacatccacaccttcctactgggtctccctaaagagagggaatagcctggtattttcagcctatgcattctctaagctattataacagggaaaatctgcatccagctgctactgtttggcgctatctcaacacctgtgtaggatggttccacgagtggtgaggctgcaaattgagcttttctcttcaacccttcaactccttcctccactgaaaatgccatggcctccaatgtcacatgatggacttcttgtttttcactcctttttcagttgaatctcatgaattggcggtctgtctcaggcgttttcctgagggttagataatgagcagcggcgtgcattctgataacttagaatacaacattttgcctctgtgcctagtgtgggcatgtgatgagcccctgtgagactcagtgaaagaacatatagtaccttgcgtttcctcatgagccaagtgtggggccttattattcattaggaatttgagaaatctctttttatctgcttcaacaagcagaaatattttaaatcttctgtgtaagtgcaaggtattataagcttcatggtaggatatataggaattatgtacagtcatggttttccaagtttgagtcatctctttttttttttttttttttttttttgcgaaaatgcagcaacttgtgtttttaccaatctgtgattaaaatgtttcttaatggtgagtttttaaaaactttttttttctttttctcaccatgctgaaatatttacaaagtaaataagaggttaaaggttaaatgccaaaggtattaaaataaacatctcagccttataagcacattctgtaatagtggtaaacaaattgtgttttgaatttcagtttcagaatttatgttggcagagacaaaaggttttggggcatcctagcaaagtatttttttcatatatctttgggacagccacacttaagagaagtacaac

SEQ ID NO: 79737 - DNA, 1077 bp, Homo sapiens
tggctgggctatagggagaacacctataccgtggacttcttctgtgtgagtgtgtgtgtgtgcgtgtgtcttttaggaagtctggtagcatagtaggagggctctccatctgtacctgaggccctactaagactcattcagttgtgactcataaggaaaatagccattttcattttctgactcatgaacacagtgtacagcttgtagttcaccttctatcttcctcctgaaaactcactttgggacacttttctatcttgagaaaactaggaacactaccaggcaatagttacttgtgtctttttcctaaggagacttgaagaagttaaaaaaaaccctgcacatctttataatttagtggaggttgtttagcagagtacaaaaaaatctctgttgactttaaccgtaatacccatctaaggcttccttcgtagaatctgggcttatcatcatctgcaaaggaagttctgcttttgtggccatgaccagtttggactctctgatagactgaaacccatggctgtaggtccgctatgtgctttggatccagaaattgtgattgatttttatgcaaggtttctgtgcattaaatatacagaaatatttgagcaaatctgaattgaccatcacctcaaaacatgttcaagagctgttcccttttccttacttgcatatacttgtgaggaaattatagatatgacacataagaatacccaggaatagatttacaacctagaaatctgatggatagctgatgataaggtaggtaagttcctttaggtgatggcatggcatgtatttagaaagtctggaatacatttcaaatgtttcctgggaaggtaacctacttgatttccacagattagtttatcagattgctagtagtctcctagtcaaaacaacacaatacaacaaaacaaaaccagaaaggaatgggatcaagcacaaaaaaagttttgatggaggcaaagcgttggggaaatacctagagtccgggacattatctagggacaagtgtgagtgggccatcctagtgggaaatatttgacagcccaggcatctccttggagagaaaat

SEQ ID NO: 79738 - DNA, 1063 bp, Homo sapiens
gatatcccggtgagcagcctgagggaagtgcagcagaggcccatcgaaacctgcacacaaagctcagaagcccccttgccccgtgctgtttattccaaagaatgattacaaacaaacatcaacgagaaacctttcaaggcatcctcggccaaagccttttctttttacatagtccaaaattaagtcacttttgccccatctaagagaacactttgtctatacatttcctcttctagttttaaggtttaagaagtcagtctactctacgttacttttggaccccttccctcaccccagcagagaaccattcccattgggcatgtgtttgggtgaagctacctcactgggcacctggtcccttgaagcagtgtgatagtcctggtacttgagaattgctgtaatcattttccgtgggtcaatatttcttaaaaaaatcaatgtgtttatgtcaagaacttaaagaatcttactgaatttaagtacttgagtggtaccttgaggaaattaacttcccctcagttaaactcatttttcatgctgaatggactgaaatatactctaggttgccttttccgaaacctgtgataccatgcttaattcagccccattgcagatgaagtagagggttggtcaaatgcatgcgaagaaggcatgctgtagggaagaggtggttctatctgaggacagtgtgtgacttccctattgatgggctccctgccatcagcacagatgggcatgttgtgtgcccccaggcgactatctgtgcatcagatatggttgctgaagtcacaattcactgatggaaaagttgaaacagctggctgtcctgaaacaggagatgtgccattgatagatctactggatccagagtgatttggccaaagttaatcatttctttcctgacttgaaaaattgttcattatgtatgtgaagttgccttagaatagagcatcatcttaaataatcagaaacccaagttacaatatttaatgtttatgtcagactctgtcaagccaaatgatacttcattttgtgttccacatctgcccaggcctgcccaagt

SEQ ID NO: 79739 - DNA, 1262 bp, Homo sapiens
ccaccacaaccaacctttactgagcactgttgtaggtgctggagaagtagaagacaagttcccagtcctcataggattcacatgtttacatgtacatccaaaacatacaacaatgcaagagagttctaccttcatatagaacacgttcccaaaacacacaccaatgtcagatatataaagttcaaagacaaatccgtgtgctttaagcacaggtttctattttcagagatctaaaatgtagcataaaatccctgattgtgtgctgtcccctagacatagtcttaagctataattccagcatgcatagatgtttttaaaatctgagcatctccatcctagctgagcaaagttgaccacctgaagtccaataggcagctttaagatttgggtcaggctatttacctttataaatcatgaatttttttttatctgtaaagacagagataataatagtaccttcatcatttatttctcacatagtgttgtaagaatatgaattaaatcatataaagtaatagcaatgatgagtgatgcgtagcaacgtctcggtatgagttgtcattattgaggctaaatattcactaccttctccacacctaatgattcccttctttgtctcaattgttttatgtttatgagaacaacactcccttttactagtgtttgcacttatattttctccatatttcactaattttgaaaaagcgacaaggctaaatggaacccagtatgaatgtaattgagtaaatactgtagtttgacaatgctggtagcgcaggtggacctgagctatggactggcaggcagcaccgccaagagatagctcaaaaggttcctttgttgcctggcccattgtcctgatgccatgtaggaaacatggctcaggtgcatttctatacaatgtctgtatctgtggaaaggtgaatgtacaaaggtcaacggcacaaggagatggcccctctcttttattatattgaattcctggaaatcccgaaatagagccaaacatgataaagttgatgacagtttcccataggaggaatgcttcaataaggacttgataacaaatggattataagttggaccaagaatgtgattctaaaaacagctatgacaattataagcttccataatttaaagtagtacagttttgctccaaattttataaagtaaatataaatatgcatttttattataaaagagacctcagtgaattgaaaagtgcatgacaccacataaccacataaaaaaatcacacaact

SEQ ID NO: 79740 - DNA, 1033 bp, Homo sapiens
gccactgcacctggcctcaagttgattcttttcttttttttgagacagggtctcactttgtcacccaggctggaatgcagtggcacgaacacagctcactgcagcctggaatgcccaggctcaagtgatcctcctgccccagccccacaagtagctgggactgcaggtgtgtgccaccatgtcctgctaatttttttttttttttgtagagacagggtctcactatgttgcccaggctggtcttgaactcctggactcaagcgatctgcccactttggcctcccaaagtgctgggattgcaggcgtgagccaccatgcccagcctttcaacttgattcttgaattctttgacttcaacttgattttttacctctttaaccttagtgcaaagtgggactattctgactaaaagactcaggtgtaaaaatctgtttaagtcttcaagtcaatagcaagtgccttagttatattccttacttttacatctctgatttgaatcttgctatccttcttgctgagcatggaccatgagaaaagcagctggatattagagtaggtaattcctaatgacaaaatgaaggaaagtcaaccttgtttttaccaaatctcatgaagttgctcaataattctaagatgactcatcttagtactttaagatcacattaaccctgctgccttgaaaacagtgcttaaaggaagaggatccaattatgttaaaatatctatcttttactctccctgacacacacacacacacacgcatgcacacgcacacacacacacacaccctatctatgtagagaggaagataagccttgagggaaatatgacgaatgtttacttggttatactggatggtaacactatagagatttttatttttgcttttaactttttctacatttctcatttttaaaaaaataatgagcctgggcacgttggctcgcctatgtaatcccagcacttggaaggccaagacgagcaggtcacctgaggtcaggagttcgagaccagcctggccaacatggtgaaa

SEQ ID NO: 79741 - DNA, 1140 bp, Homo sapiens
tattgcgcacctgtatttttattgcaaaatttggcaacctcacatccatgtccccaaatcttcaatcctctctgatttcttcagtaatgaaaactacttaatgtgtgggactgtaaactcaaggacatctgaggtcttagggagatgtccgatgggaccacacaaaaaaatgaaaataagaactctcatcaaaaacatgagagtctcttccactgagtaaacttttcccatcacagggactttgttgtcttccttcctctggtattcgttcttccaaaatacctgttttgactatcaatcaataaaggaaagccgtggaaaccaacaggaaataacgcccactcaatgagcgcctactatttgccaagcatcatgttagatgctttatgtgcctcatttcatttcatcctcgctatattcttgaagataattacgttttttctttaatgtaaagatgaggaatccaaggtttagaaatgttacacaacttgccccaggtcacaacccgcatcagtggaagagccaggatgatggtgatgaagatggtgataataatggtggtgacgatgaacacagctcacattgcttgagaatacattatgagtcaaccagtgtgctgagcgtgctacatgctttaactcattcaattaccacaactgccttttggggctggtactctcattaactccattttaaagatgagaaaacacattcactcttggtctgctcactccaaaccgctgactctactattagccatactccttggattgtacctctccacccactgggtcttgacatcccactaccacccctcttattgcaggttgctgaagctgtctgtagactcagcttcttcctaaaaccttaacctcgcgactggctgattgctcttgggaagcagtgcatggtaaagcttggcaggcagatgtcaggttgaccaaggttcctatcttaaatgttgaaaatttagtgtttcccaccttgaaaatacactctgacaagttttatgcaaattactcccaagagctgacacatagccaaccaataaaacagcctcagcaaaaaccttctcaatcttacctctaggaagctcttggctttcgctaaccacaatcttagagaagcttccaactagtc

SEQ ID NO: 79742 - DNA, 1091 bp, Homo sapiens
atggagtccctctttagggagggaaagcccactgtataataggtaaaatctattgatagcagctgtgtgctttatatacgctacctcatttaatcttcagccctggcagggtccagtggcttacacctgtaatcccagcactttgggaggctaaggcgggcggatcacttgaggtcaggagtttgaaaccagccaggccaacaggctgtgaaacttcaaaaatccagcataattggaacctcaaacctatgagattatcagatttgtccagatatttggacagtattatattgataatgtttgaattttttaaaatttctgacttttaagatattgtccaggttatgtgcttctatctcttggccattattattttggctcatacttgaagactatcaattacagatgagtcaattaaggcagaaacgcttggtataaaaatataaaacaccatcataaacaatatttgaccttggaaaggttctggggaaaaaagtgaattaatcagcacagattcattggcagagtctgttcaagggtgtatcaccaacctcaataatggtgctaggtgtgagccaatccaccggatacactcactcctctgatcctactgaaattcatcttgaccatttgcttcttcagctaatgatagagacacaaatggactattgggattttccagattgctttcaacattccaaatgccaaaccatccgagtttttaaaattacttatggttttccaaatcctacaacacaggatgtgttgactaggagatacaatttttaagatgtttgttgtacgtgctttttttttgtcttcctgttttctgcgggtttattggtggtatcaactgactattccatccaagagacagaacttgcactggaggagaaatgggcacaatcctaaccatagcatcacctagcgactatcaagcccgagaccagaaagcaacatttgaagtggtttgacagcattgcctttggataactggctttctggttccttactgaacacttgcagatatgagttatgttaggtgaggacatctttggagccatctgcataagaagaagagtgtcaactct

SEQ ID NO: 79743 - DNA, 1054 bp, Homo sapiens
gaataacctcaagatcagatcacttgctatactgttcaaaactcttccaatggcttttcaacacatctgaaatgaaatccatgtgtttctcatggccagtaaagctagtaggtctgggccctaaccatcaccctgaaataatctcctaccaccctgcttccatctcactctgtcccagctacactggcttctttgtgctctttgaacacacagagctgacaccaaacccagggcctttgcatgctctcttctgtctgccaagagtgctctttcttccaagctttgtttcttttgctccctcaaagccctgctaacatgtaacttcctcagagaggtcttccctgaccactcagtctaagccatctcgcctcctgcacatcctttccttgttagcagttaggttatagagtcatttgattatttctttatgatctgtcttccactacaatataaggtctgtgagagcaggaatttggtaatgtatgtgggatgaatgaatgaacaggcctgccaagaacagagtgggaggggtttgggagggtacaaagaatacaaccgtatgcctctttccgctaagaattagaccgggctctgtggctcacacctggaatcccagcactttaggaggctgaggcgggtggatctcttaaggtcaggagttcgagaccagccaggacaacatggcaaaaccccgtctgtactaaaaagatgaaaattagctgagcatggtggtgcatgcctgtaatcccagctacttgggaggctgatgggggaggatcgcttgaaccctggaggcaggggctgcagtgagccgagatcacgccactgcacaccagcctgggcgacagagtgagacttcatctcaaaaaaaaagaataatgataataattgctactacttcatcctgtccatcccatgtccctaaaaacttcagcataagtgcactccacacacaaggagagaacaaaccctcttactggccttgggcccatccctctttctcccacactgctacttttgagttatctcattttgctcccaatagtcagccttg

SEQ ID NO: 79744 - DNA, 1049 bp, Homo sapiens
ctgccactcgctccttctgcctgataacaaatactattccttttatccttgcaactcgacccagaaagaggtggctgtcaatgtccaaggcccctggaaacgaagactggaaatgtgaaaccactgggcacaggggaatgggtgggtctgagagtctgaaagacagtgctagagcatgtgccttccagatcattctcattgaaaaattcagaatgacctcccctccccaagccaagaaaggataaacactgacacctgcctaccttctcacattctaatttctaaggtaaaataaaatgcattaagaatctgtaagttatctcatttaactggcactctgctttatgagatacgcactatcatcacccacttacagatgaggagattgaggctgggggatgtgaaatcatttatttcagttcacatggtttgcgagcagtggagtcaggatcctaaagtagatactaaccagtgctatttggcataccaatttaaatcagttacctacactaactttaaaacaacatcagctttattaaggcaaatttatatatcataaagttcacccactttaagtgtacaatttgataattttagtaagtttgcagagttgtgcaaccatcaccacaatccagttttagaacatttccactaccccaaaatgtttcctcatgtccattttcggttcatacccactcctacccccagctctaggcaaccgctgatctactttctgtctctataaatttgctgtttatagagaaatgaaatcatcctgcacgatcttttactacaagctgcatttgttttgtgaagactgttcagctcagttctcaacattcagttcagaggtgtgcactggcttagcacaagaaggaaggtattgtaactccacttttgcaagacgtctggagggaaagttttttttttttttttttaaggagaatttgtattattttaattatttttatgtgcagaaaactcaacagcgtacatttaacccagtttggtggcaagttctttagccttggcttttccagcttggcaat

SEQ ID NO: 79745 - DNA, 1040 bp, Homo sapiens
cgtgctttcccctgctagtttagtaggtagagagtttacatgggcttttaataatattttttctcttctagctgttgcacttggcaggttccttttttaacatttggtaatgtatcttttctaatgctagaaagaaaagttgccaaatattgctgttgatcataataaaacaccctaaaagtaatgacttctttttgggtgtgagtgcccgggcccactgcagggtgacctccagccttccgccgagctcacagctggaagggcaccttcagtcagcaatcgatatgtcatttgggtagagcaactcaacaatgaaaacagtgggtcttcccaaattagaaaaacaaaaaggtgaatgaacaaatatgtatgagtgtccgtgaagaggcgtcgtgttaggcttcgtggagattacaggttcatgtaggatgtggtttccgctgccctacggcagctcagctggggagacataatccagaaaggttcaaataacaatagaagatttaaatagcatttcaaaatagctgttattaatagaggagaacaaaaaccaatctgtttttgcaagggttctcctaaaaatgttaacatcattctaagctgtggagagtggattgaacatcagagaccagtcattgggttctagaggtctgtctgtaaatctgtctggatctgacagaggccatgtgtgtattgcagattggccgcctcccttcagttatgcagaaatctctgcactggctggaagagcactgtcaaatgttgtaagcattctaaagttcacctttgtgggtcagaaacacatcacccctcacccttctacctccaacagaattccctttatgaatgtgatagaatggaggggaaagaatgcaagtcttgctaagtggactcaaggccattttcacaaagagcactgaaaatatctgctctgggaccccatggagggacttgcagttttcctggaacctcgagtttttggaatactgtgctggcatcactccagaatcactggacctgtacaacatgctgattccctg

SEQ ID NO: 79746 - DNA, 1073 bp, Homo sapiens
aattgaatatatcatacgtagtttgctagtttaataatttgcaaaaggactactggagtttttgaacttgagcgatgagtgcagcattgggctttactaacatgggaaagcaggggcgtagacagtgatgttaacatgtagtcggactaacatacaggaccttggttcagtgtgcttccagtactgccaatgaggaaagagttttggctactggacttcatgcattttactgaaaaagggaatttcagcctgcagctctgtgatctggttctattgaaacaggtatatcagcggaggggttttggtgattatcatccaaattcattttgttttcattctacccactagatgtggcgtgttgtatgccttgacttcgggggagaagacagtaaattgaatggaattcgaatatttattcagttctgttgacagaggtttttcaatgtaaatgaataaattagtgttctggtgtctgctctgtctccagtacattttagcttgtctgagtcctctttgaggacctgatcatgtctgggaaccagagattgataacagctcaaatcaaagggattgataacagcttaaaccaaagacaggatggacagctagagatagtctctaagccttcaactcagaagaccagatcctagaacatggagctaaattaattgataaatcactcactaatccactaacccactaacagccaggcattgttagaggcactggagctgcagtaatggcccaagcacacaggcctctgatcttcgccctgctgcacactttagtggggtgtacaggcagtcaatgctaagtaaccaaggtgatgttagctgatgtcaagtgctctgatgagaggatgtgatggagagtgactgtgtggctgtcttagaaaggatggtggccgggcgcggtggctcatgcctgtaatcccagcacttttgggaggccgaggcgtgcagatcacgaggtcaggagttcaagaccagactgaccaatatggtgataccctgtctctactaaaaatacaaaaattagccgggtgtggtggcacgtgcctgtactcccagctg

SEQ ID NO: 79747 - DNA, 1056 bp, Homo sapiens
tcccaggggattggttgtcatcacctttgcataaactgcattatacagcacattgaggctcccacagaagtccctattccaagccgttttgggaagggaggttttttaaagataggccgtatctttgaaaaaataaatgaggacttgggacatcactttttcaaggtggctagcttctgctccgtgcttgtgtgaagcatgtttattgtgtgcacctggacaatgcactttccaccctttagtttttcttgctgcaagaaaagcaagaaagctccctgagggtatgcctgatgctcagcacacagtaggtgtgcaaaaacaagtttcttgaattgaattgaaaataatggagaagcaatgccatatataacgatataatctttttaaaaataaatgcatcatgatgatatattgttccaaaatgacaaattcaggaacattattgactttacaaaggaattacttttctaagttttcattctagaatgtatttaagtaataagccgtctaacaccttctgttttcatattactttctagtaacatgaatactttgttaatgtcaggtaggattctttcctgtattcttcaaagcacttctttcttaaatttttattcatttgttttttgagacagggtcttgctctgttgctcaggctggagtgcagttgtgggaacatggctcactgcagcctctgcctcccaggttcaagcaatcctcttgcctcagcctcccgaatagctaggaccaggggtgtgcaccacaactcttggctaattaaaaaaaaaatgtgtgtagagacagggtttcaccatgttgcccaggctagtctcaaactcctgggctcaggcaatcctcctgcctcggtctcccagagtgctgggattacaggagtgagccatcgcacccgaccccagagcggttctaatacaataccttattaatctgcataagaatttggagagttaaatgggcttttttaaatttctaagcattttttaaagcacatttttttttctggctataaaagtaatgtatgtccattgttggacatac

SEQ ID NO: 79748 - DNA, 1051 bp, Homo sapiens
atcttgatataatttaggttgtgtattttggtattctttaaaaatgtcaagaagtgatgttgtgccctgctcagggtatcttttcagaagttacgtgatgttgtttctcccagtatgggtgacgtgagatttgatcacttggttaaaggggtatatgacagtcttctccattgtaatagttcctttttcctttttgtaattaaaaagtaatctctagggagaaactagaaactcacctgttccccatcatactttcatcccagaggttttagcatctattaataatttttgcctgaatcaaccattactagatactatagaatttgatacagcattttaaaaaaattgttaactgttgtgaaatttacctctccttcaagggtttacagccgtctatgaaagcataggatccctcaggcaagttctcgaggccaagatgaagctggacagggaccagctacagaagcaaatccagctgatgcagaagccagagacccccatgtgaagggagctgggacaaggtcctaaaagacagttttgccagtggggctaggagccggatacctctgtagccaggccatcgctgcattcaggattgttccatccatggcgtgcatgtgccaagaaatgtgtttttatgggtctaaatgtttaccttgagtcttgaaaatactcttttgttaaaagtatgaaatacagtttttaccagtttatttcacttctctaaattcaatggaaatcccccgccctggattttgaaaggcttttatcttcttcattttacgaatggaaagacgacaatttttcttcaatgcttgatgcactaatgaagactgtttactattttgaaaaatgtcatggggatttttttttaattaagaaactaatgaatcatcacaggaatgtgttgctcctcaccctaaattaagagaatgtcccagtagattagacttcaacctttgagtccaatttggattttattatcgttgtctatgcacttcttatattggttatcttcttgtaaatcttctgtcttttgtaaggggaaagg

SEQ ID NO: 79749 - DNA, 1022 bp, Homo sapiens
ctgacggattatcatactttctattttgtctgcaaaacttttacagagtacagtgcattgacatgataaaaccaaggcacaaaaatacagttacgataagtgtatataaaccctagcactttgtgccaattttggaaacagatcataaagtctgaaaaattaccacattctatttgattagtgaacaattaattgtgcagtaaatagactgttaaccaccattccattattaaatatatggctatcactatacaggttgtggataattcaaaaatagttttaaatattaaaacctgtaatatctaggtggtcaacgcagatattgagccttacgttatctaaataagtttccatttaatttgcaatccacatggcagttagcaatttttaaactatttccattacataaatggtggggtttattctaaatgttaaatcctttccccttacaaaagacagaagatttacaagaagataaccaatataagaagtgcatagacaacgataataaaatccaaattggactcaaaggttgaagtctaatctactgggacattctcttaatttagggtgaggagcaacacattcctgtgatgattcattagtttcttaattaaaaaaaaatccccatgacatttttcaaaatagtaaacagtcttcattagtgcatcaagcattgaagaaaaattgtcgtctttccattcgtaaaatgaagaagataaaagcctttcaaaatccagggcgggggatttccattgaatttagagaagtgaaataaactggtaaaaactgtatttcatacttttaacaaaagagtattttcaagactcaaggtaaacatttagacccataaaaacacatttcttggcacatgcacgccatggatggaacaatcctgaatgcagcgatggcctggctacagaggtatccggctcctagccccactggcaaaactgtcttttaggaccttgtcccagctcccttcacatgggggtctctggcttctgcatcagctggatttg

SEQ ID NO: 79750 - DNA, 1064 bp, Homo sapiens
gcattttctatttttaggacaaatcacaaatgaagtgtctaactggctattactgtttacccatataaaatatgctgctaaagtacatattttgctgtcaatggcttgacaattttttttttcaaatttggacatgagaggttatatagggactatattatccaacacatattttcttattttgccacaaatttccacttaacaaataaaaaaaggcgaatgctgttttgcaatcagaaagtgaatttcttttgtggtagcgtacacgtggttcatgtggttctccacgtttaagcacaaaccacagcacaggaagccacaccccctccagcatctctgtcttgtggggtctttgaggagaaggaatcagaacatcgacacctgggaagagggaggcggggaacaccagctggactctggccaaggagtgatgtaagcaggtgacacttggctgtcagctgagcttctcaggtgcttctgacattgccagccccttgagatgagccaccgcaggtgtgctcaccttggctacatgttgaaatcatccagaggagttgggaaatctactgatgccccgctgtgcctcccagaccgattaagtcagaacctctgggaggtgggtcgcaggcatcagtgcgtgcccgaggcctccgcgtgtttgggtgtgcagccgaggtggtgagctgtcgagccacagtgcagttctcttctcaccaaagctcaaatgagaatcagcttccatgttctttcctttaccagaaatttgcaataaaaagaaaaataaaattttcacataaatgtggtgtatgatttttaaattgaaaagtctttcagtgttgagctgaagacttaattaggtaaaatgccataggaaatatttctgtttgctctctgtggaaacgctttgatggttgaaataaagtgctcaagtcctggcagctcctctgacgactggaatgtcattgggagctgctggtctgtgggcttcggggctgtagggccttctctgcagccttcttgtctcttggcagttctcgggtgtgtgctgtgtgcctgtgctgtgt

SEQ ID NO: 79751 - DNA, 1008 bp, Homo sapiens
actggtaatcccagcactttgggaggctgaggtgggtggatcacctgaggtcagagttcgagaccatcctggccaacatggtgaaacaccatctctgctaaaaataaaaaaactagctgggcgtggtggcaggcacctgtagtcccagctacttgggaggctgaggtaggagaatctcttgaacctgggaggtggaggttgcagtgagccaagatcgcaccactgcactccagcgtggcaacagagcaagactccatctcaaaaaaataaaatgaaaacgtataaaaaattataagttgcacaagacaatgaatgttgtagtcttagtgaccgatgcagtaatgcatctgagccaagtcacaggattaaaatttagtgtttctaagaaatccctgcttttgtacatttggagaattaacatacacaataaaatatgtaacttttaacaaatatttccataatttgaatgaactttcataacttagccacatgagggcaatagaaatacaaacgcaagtttttattttttcttcatatttcaggtaagtaatttgcaatgcagactaaaaatacagtctgccaactaaaatatttttgaaatcttcccttagcaaatttgtctggtggttgtttttttaatagctaggattaaagttaaggaaaatcttaagctaagcattaaacttattatgttcttggtagctaagatctcttaaattgctttggagaaaaatgtgaggggaaaaaacgtttcacggtatttctaaatgttttgttttaaagggctctctaaatacgtacagattctgcgataatgtgtggacttttgtactgaatgatgttgaattcagagaggtgacagaacttattaaagtggataaagtgaaaattgtagcctgtgatggtaaaagtaagtgcttgccttatttctgtgaaagctacttgaaaccttgtttttatgagcctttagaagatctgcatccatatgaaaagcctaacgggtaaaat

SEQ ID NO: 79752 - DNA, 1937 bp, Homo sapiens
tgactgtaatcccagcactttgggaggccgaggcaggcggatcacccaaggtcaagagttagagaccagcctgaccaacatggagaaaccctgtctctactaaaaatataaaattagctgggtgtggtggcacacatctgtaatcccagctacttgggaggctgaggcaggagaatcgcttgaatgcgggaggcagaggttgtggtgagctaagattgcgccattgcactccagcctggggaacaagagcgaaactccgtctcacaaaaaaggaaaaaaaaaaaaaacatattaagtatttccatttgttggtatattttatgagattcaataaaatttaataggttttttgtttgttaatataggccctgtgtatttaaaagaaacacctctttgtctatcttctcctttccagccactgtaagggaaaattgacaaagttttgttctggctttgtaacatcactgcatgttttctcttcaagattgtttgtgtcaagatagtacaaaagatgtcttcaagcttggtgcttcatcatcagttatggcaaaggagataaaggaattctagtttagaggctttggttaacctcagttaaattttagatgataatttgtatatttttatttactttgtctttaatgttcttccttaacgggatttatgacctttaccttttctcagtctcaacagatcaccccccaacttgcccttcaagttctacttcagtttgataaggctataaatgcagcactggctcagagggtcaggaacagagtcaatttcagggtaaggatattttcctgaatctagaagcctgtaccaatggttgttaaaacactgatttttttttaggacccctacatatttattaatcataagaggaagaggtggcttagtcaatttttggaacttgttttatagtaactaaattatacttttcaatcaactataaactaagttgatccacttaatgtgagatacagagatgtttttagatttttatttcattgtttcacaaatcagcctttgtatgtttggctaccttccctgaagagttactgagattccaaacacctgaaatattatctgcaggattaaaggtaagtggcggagtaatccccaaggttctgttatggttttcaaagtctggcctttccccgttccagggaagtagagttatttctagaaacttcatgttgcctccctccgactcttaggtaacttggctgataaaaacctgatctctaatggtagataacagtctattctggtagcttggtctcacttcagtcacttatactttgaacagtagtcatccaaagctgaataaaattatctctctcaatttcctgataacttcagattaagtgcccattgaaagagtcatggtgcaacagaaataattttaccacattatggtattgatggagtcatataatatatgatgatgtttgcttattatttatctaactttatgtttatattgtattataaggcataacctgtagaaatatagtcaaaagaaggttaaaatatggttacaaccaaaatttgatcattagttaacatctgcctacttcatttggtacttaaacattcagtaaacaatttgagtgtctgttaacataccaggcatgctctagatacacagagatgaaaagataacataccaggcatgttctagatactcagagatgaacaagatagacaaagccccatttgacttaaattttagtgaaggataaaatctccatgtattttatattaatataaataagtctcatatatcagtttcatgtgccaaaaaattatctggagtaaaatatgccttcaagactgtataatttgaccagtggatccatgaatttttaacagtaatgattctgccaaaattagtttgtgtttttttatatacccatatgcagaagtctgcc

SEQ ID NO: 79753 - DNA, 1344 bp, Homo sapiens
caggaagactatgtttactgttaccgaggtgggtaagactgaggacagagcatatttgcaagagtagcatcagaaacatggtttttgacaaattgaatttgagctacctacttgatatttttatccagtgtcaagcaggcagttttatatatgggtacaaagggagaattgagggctggagatacaaatttgagagtcatcaccagatagtagatggtatttaaagccgtaagtctggatgaggtaactaagagagtaaagtatgtggaaaatagaggacccaagaaaacttagggcagttcaacagttacaagtcagggagctgaggaggaaccagcaaaagaaaataaaaaatacaatggtatccagtgacatgagaactgagaatgctgtctcaaagccaaagaaatgtttcaagaaggcagaaatgatctgttgaatccagtgctagcaaggtgtgaaatgtaaggactgatggctggccattatttttgctgagttttatctgatgattgctcctcaaatgtattttcccccatccatctccagactgaaagggccatgaggtcaagatcttacacctgacgtgtagtggaagctcagtaaatatttattgactgtgtactgctgccacccttttcgagcccccatccctcatctgtttctaaatcacgcactgaagcccagctgtctgacctttcctgcctaaaattcttcagtgactccccactgcttgcacctatcctgccaaacaactccatctatgctgtctctttcagcttcatctcctgccactccctattcgtacttatgccctgataatgtagaacagtttatgtttttccccacaaacatttcatccttccatggctttacttattctattctgtcagcctctggaatgacttccctcctctgcttggctaaagtctagcttaaagaacctggaagcttttctgagccagctcacttctacaggcagcctccatggtatgctttgtatctttatcccagttcttatctttttgtatgtttgttacattctctagagtataaatttttaggattgggagcatgcctttaatcatcatcttctctctggaacctgtcacagtgccattctcttggtaggcactctgtaaatactgaatttagagagaacaggaaaataaaggggcagacatgcaaacatgagctgaagattttaccagtgacttgacagcaggtagaaaggacagtacatggaaaattctagactaagtcagaaggcagacatttgaaggaaatggtaaagacattttaataaatataacagctatactgcataaaggagtataaatgccc

SEQ ID NO: 79754 - DNA, 2618 bp, Homo sapiens
aattttttgtatttagtagagacaggatttcaccatattatgctggtcgcgaactcctgacctccggtgatcgacccgcctcagcctcccaaagtgctgggattaaggcgtgcgccaccgcgcccggcccctgctataatcttttcagaattcgtctgcaaggtcttcaacactgttaccctgaacacacttccggcatgaaatatgaatgccctacatttcttaaattgtgcatctaacaatggagaagattagtctctaaaaattataattcccttaggaacgatttagtaaacctggtgaattactcgagcagagcgcctgtccaccactttaaggcttcaagctccagcccgacgcccctccttccctctccacgcccttccctgacaaggcttgagtggcgggcgagagcagggctgggcggggcctcccgtccctcgggcggggtgtcacttccaggttccgcgagcacttccgggtcgtcagctcagttctgcggtttctgcggcggctggagaggtggtcggagaagtaggaacctcctgccgggctcgtggcggcttctgtccgctccgcggagggaagcgccttccccacaggtagtgggttagggagggcagggttagggagggaagcagggccgcgctccctgccgcccccccggagtcggagtgcgttggtggggtagtctctgagggcccttcgctcctgggatctgcccgttaccgaccgttgccggcaaggccccgcggccggcaccggagaagggcggcgaggcggcggtgatggtcgcgtcccgtggcgggaggctcgtcgttcacggggcgcccacagaacccacctaggggaggtcttcagcccaccaccgtattttcagccaggtgaatgtcttaaagcatccactagcgccctgtgagttttgccgaatttcggagagcattttttaaatgtctcattcctgtgctttgtagcttgttgtttgaagtctgccttccaactttcttcgtgcgaactccgacaaaaggaacgaattttaaacttggtggtttaatcaaaaaatgctaggacgagttacttccgaatttgacttctaattttctgaactgcaaaacaagaagggaacaataaatttctgtggctgataccacatctaaaagattagaacacttaacaaggaatttttaaagaatgtaagaacattgaaatcagcacttttaacaaacgtttaacgcagggctattttctagataaactcaaaaatttgtcaaatgggacacgatgcacgattctgtattcctactctgtggagtttttatctacctattgggacttcttgccctttttaaccccctctcccctcccacacgcatattatacttactgatatttgccttcgtttactgaacagatttttttttggctcctattgtgtgccaggtactgttctagacgcctattttacttaagtgaacaaaataaaaagctttgccctcatggagcttacattctattagaggatgcagaaaataaaatatataatggtgttagaaagtgatggtgccatcaaaaaaaaaaagagaaatataaaggagtacgggaaagttccagagtggaggtgggaactggtattttaaagatgacggtggtcagtttgagcctcatttagtaggtgttatttgagcaaagacttgaaggaattaagaaaatttgctaagtaaatatcaggaagagcattcaggcagataggaaagccaatacaaatgcttttaggcctgtcatgtttgaggaatagcaaggaagccagtgtatctggagagggatgagcaagagttttgggggtggagggacaagaagataaagtcaaagagatcatggtagccggatcattgtaaaggctgatagaagccatgggagattttgaatagaggagaggtatgttgtaactgaagttttagaagatcaccctggctgtgagttgtgattagagtgtaggggtgagtgtagaagcagggaaatcatttaggagatttttgcagtaatccagatgacgagagtggcccaggtcagggtgataaccgtagggatggtgagaagtggttggattctgaatgcattttgaaggtaggccttacagtatttgctaggaattggatatggagagtgagatagagggagtggaggatgaaatcaaaggttttgcccaagctcgtagaagtatggagttctttaagccacgatgcaaaagataacaaatagagatgttgagtaggcagctagattcaggagtgagaagttctatgctatatgaatttggggatcatcagcagtggtacttaaaccatgagaataaatgttatccgtaaggaatgggtgtagacggaaagcagcagaggcctaaggactgtgtcctgtgatattaagagtttagcgaaaacgggatcaaccagcaaacagtattaagaaggatgaacttgtgagttaggacaatccgaaaagggcagtgtcccagaagccaaggtaagatcctgtacgaaagaggagggagtaatcagctgtgtccaatattctgagtgaggctagagaattagctttagcattgccattgatgaccttca

SEQ ID NO: 79755 - DNA, 2988 bp, Homo sapiens
attttagttaacagaatcatttttgagggagttgtttttcctgccattttcgtaccacctggatccctaccacagccaagttacaggtcaagattttaatatgccatgtaatttgaacttttaagaaagtttatggctgggcacggtggctcacgcctgtaatcccagcactttgggaggctgaggcaggcagatcacgaggtcaggagatcgagaccatcctggctaacatggtgaaaccccacctctactaaaaatacgaaaaattagccgggcatggtggcgggcgcctgtagtcccagcaactcgggaggctgaggcaggacaatggtgtgaacccaggaggcggagattgcagcgagctgagattgtgccactgcactccagcctgggtgacagagcaagactccgtctcaaaaataagaaaaaaaaaaagtttatatgcatttgtatgtaaagtattttataatctttaaagaaacaacggtcacatttcttgccagtgtcctcctgcctttaaaaattctcttttctggttggggaaatgatgtttggtaactgtttttactatgtctgcttctttgcaaagctttgtctttaacagagtaatattctatgctaaaatagtcattatttttagaaagaaaattgttcagttgctggtttcttattttatatattcttcattaaacagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacacttgttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgctcaaaatgggctgaggtttttaataggtggttttctaccacattaagtacttggttcttcagtttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatag

SEQ ID NO: 79756 - DNA, 1424 bp, Homo sapiens
aaaatgacatgatttttgtatcttgtaaacattgtatccattgtatttgtcagaaatatggaagtaattatttttattttcttccatagctcgaaattcagccaaaaaattagatacgtgtttaatttggcagaactagcagaacttgtccccatggaatacgttggcataccagaatgcataaaacagtatgttttgttttatttccttaattgtattggatcttaacattttgatgtgcaatggataatacttttcaatactcattctttatgtattatattttataactgtgcgcgcgcgcgcgtgtgtgtgtgtgtgtaacaaagaaaaagaggaagaagccattttcccacaccatccccctaagttagcattttcttcaggctgtcagttgaagaactaggataaattatttccggttgtgattcatgttatacttttatagactacttataatctaagagatgatttctctaattgatcagtactaaagagcattctccaaacttgaacatagtgctcaacaaatttgagtaaactgatcatcaatattattattgaataatcatattgctaaataaataaaaatatttaaatcatcataaccttaatgttttccagtgactgaaattctgttctgattatcagattcacattcttccatgtaacttcttggacttggtagaaggctgttaacataaataactgagtattacaatgcatgtggaaaagtttctttgttctgctcacctgaggttttagtctatttaatgtatgaaagtcagatttattaagtaaatttttactttctacatcatgtagtaaatatttttggttttgctggaaaatttaaatgagtttatttttagtagcttttttcaagtttttattcattttcataacatgtatatttactgaaataactcttccctacaaaggtatgaagaagaaaagtttaaaaagaaacaaaaaaggtatatgcacaccttgactgggttgcatctagactagtccatttgcattgcagactaactcttccttattggttggttagcttgtagacaaagataatagcatttgcaaatataaatgtaccccaacttccaaatacagggtgaacccagagttcctaaggctgaatatgacttggattcaccatgttttattgccatatatgatgccaattagcaattaaaaaccacagacccttctctctccttcttagtctaagtactaatggtgaaaccagagaaattactaaaaatggtatttggaacaccaaataattttaagactttatctgtttcaccattttctttaaatcgctaacttgtgcttttgaaatatttttgcagactttttaaaagttctcaatttatttccctggggttgattattatatttgcaatgcatatatactt

SEQ ID NO: 79757 - DNA, 1110 bp, Homo sapiens
ggccaatataattgagccaaatcagttctttttccacaaggtcattctatttctcaggttagtgcagtttttaaaaaccgtattgtggaaagtttcagacatacacaggggtaaagagaagtatatcaaatcttcatgtatcagtcacttcaacaattaccaatttatactttgttcccacttctaacccccagtttacaagtttgaagcaaatcccaggagcaaatcatttcacctagaaacatttcaaaatatatctctaaaaaataagataatcgtaatactagctaatgcggtttgagcattttcattgttgctctcattgtaggagagaggaaggaattgtataatggtacaatttagagaacctagttcagttatgcacagtgatttttaaggcttaaacttaatttgttttttacagatatgttattggcactttggagctattagtagcagaaaactacatgatagtttatttaaatggtgcaacaactcgaagaaaaatgcccagtctgggatggctcaggaaatgttatcagcaaattgatagaaggtaatacaaatacaagttgaaagctagtctgaaaaaattttataatggctttaggaaatcaaactttgtttttcgttgctattttttttttttaactttttttttttttgagacggagtttcactcttgttgcccaggctggagtgcaatggcacaatctcggttcaccgcaacctccacctcccaggttcaagcgattctcctgcctcagcctcccaagtagctgggattacaggcatgcgccaccacgcccagctaatgttgtattttttgtagagacggggtttctccatgttggtcaggctggtctcgaactcctgaccttaggtgatccacccgcctcggcctcctgaagtgctgggattacaggcgtgagccaccgcgcccagccttctgttgctattttaaaacaccatttattttttaaattttatttatttatttcatggcaggtttctgttttctaaagatagcattttagaatattgtgagggaaatcaattttgatttttctataaagaataaccttaattcttcaaacttacaaagtagct

SEQ ID NO: 79758 - DNA, 1148 bp, Homo sapiens
gtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggtaagagttactgaggatttttcagattgtttaatgcaatatcagaattcttttttttttggaaggatatctgtttattaagagtaaataagccctgtacagaacacaggcgctaggttgagagactcgtcttttgtaggacatttcttcctgctaaccagttcctggagggcttgttttttttgtaactttacacaaggggcactaatggaaaatatagctttctcaagacatctgatgtcagtttcccattgttttgcttcacaaacatcaacaaagtaaacctgaacatgcttagcaatttcccaatgttctttgctgacattacttttgacatactgtgtcaaaattcttaaggtctcccctcctttggtaaagtaggcaaaaccttacaaggaaaacactataatacgtggaaatatactgagttagatttccagtcacctgctctatggctctgagatgcactatatccataatggttcctaggactgtgtccacctgatggtttggagtacggaaaaccaacccttatggc

SEQ ID NO: 79759 - DNA, 1062 bp, Homo sapiens
atgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaaaaatcagatacggaagacctcttatgctcagcaccaacaggtccgccaaatccggaagaagatgatggaaatcatgatccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaacgtgctatttgtaaaaaaaaaaaaaaaaaaaaatcccagcatttcggcataagaattctgcctgtttagttttgtctaatttataaaacagaagcgaataaaagtttgtaaataaataattagttaattaaattataacttgtccatgcactagaacacaatgcagcctttaaaatattacagaaaattatataatttcattaaaaatttcacaaattttataatgaaaaaacaggctttaaaataatataattttatttaaaaaattaataatgcctttactttaggtggttgaatagaatttctttgtactgtacttatttttattttttaaatattattttttaaagcaatgaataatcattactgagattctgaaaataatttagtactatatatgaatataaaaatatgaaaatattttaatatttaacattttaattagttgatcttgcagcaacctggc

SEQ ID NO: 79760 - DNA, 1264 bp, Homo sapiens
tgtttaaagtcaaaggaccagttagactcttagtaattgttcctcacctcaccagcttatttccacttgaccttaataatgcaggaaataggagagtgagctaggaaagtaccctgttttctgtggaaagacgaggacgagagaggaaagttagggtgtttgtaggaccttgctgcagtaagaacagccctggtcactaacctatgtcaatcctcagcaccttgcactccctccaccccacagtcctaaggagccttgagtgtcttccccagcacctcctccgaccacactcctggaggcttccctggcaatggtttgggtgtggccttccaggcctttgtatcagggcaggtctcctgcagagtcttctctttgtcatgggagaagcttcattgtgcgttgaggctacttctgtgttattgaggagtctgggcttttttctgataccacgtttcttttctttcctgggccattgtagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaataaaatcagttcctgagtcacacaatccacatttcgaatgctcagctttcacatgtggtcagcagctagtatatctggacagcgcaggcagggaacatttcgatagaaagttctgttgggcagcagtacatgcccagggcatgagaggacctatgggggagaaaaagggtcccagagggaccccttatctgcttatctttctacaggttaattaggtgaaaataagcatcaggggcagccacaaactggagagag

SEQ ID NO: 79761 - DNA, 1050 bp, Homo sapiens
ttcttgtatttcctttcgctccctccctattactccttcctttttcttgtccttcagtttaattatttcaaacacatcacacataaggcctgtcattcccttgatttctaatttatcttttcaacctctaataaatttaacacagagaatagtttccccattcactttgctccccatctactcagatctatcaacttctctgatggttatttgaaagtttagtacttaaaaatgtgtcagattaaaacttgtttagaaacagccagctagctggagatgaaaaatatataagagcttatttgcaaggtggttaatacatgtataaatactacagagttgactgtatataggtatgttgtagatacattaagctattctgttctctgcttcatctcttagattggtggaacgagaatgcctacacgcagccacaggaatccagtttccatggaaaccaaaagcagttgcttgcctgctcagcaagttgaaactgaaggagtggctccacataaaagaaaaataacttgaggactgtaccatggaaaactaaatttaaaaaaacagttataacagtgtttaatttagataagtttgagggaaaataatcagtaggcaagaggaacatttttcctgtagtagctagagtgccttgaaaaaatgtgttggctatgtgaaggaatatttcaactaaaatggaatggtatgcttttcacccttgaagtttgaggaggatcttgatatgttttaacattatcatggcagggaaatatataaagaagaaaaatatttttacattaaaccttttctaaaaattgtaaatagaaaaataatttggttttttatcaagaacaacacttatcgttatgtattgtgttagttatattgccagtctgttgcgactgactcaaaaagttaaatgttgccactgctgaagatgattatgagcatcgcaaactttgtttctgacccattttgacagtttttatatactcctttaaaatgatgaatgttacaggttaataaagttaatacctttaaaaacttggtgaa

SEQ ID NO: 79762 - DNA, 1051 bp, Homo sapiens
gcatctccctttgagtctcttctgccttcttcttctgtatttaagggctcttgtgattagtaaaatttgatcattttaaaatcagttgattagcaaccttaattccatctgctaccttaattccctttggccatgtaacatattcataggttccaggtttggaacataaacatttctaggaggccactattctgtctaccatagcttatattcatctatgtacattagacatgtacagcacttgtaagatactcctccttagagtatctctcattctccatgaattaaatattaatatattcttctgtaaatgaaagctttctccatttttagtggaagtagttaagatatatgattttcattgattaaaactcaatctttgaaatgttatttattcctactatcataataattcatttctttatatggaaatatgaaaatgattgggaaaaaaaatttccagaggataagagcaattgtcaacacctattttcagtttaaaaattgatgaaaatgtaaccgattaggtttataggcaaatctgtatagctaaagtatgataaatctttattttttcataatatattgtaaagaaccgatgttctccttaacatctttgatccagaggactgtgtaatcctaagaaagcacaatatatttattcatatccctttagttctttaagatgatacattgaattatttaaaactttataaggagaaaggaaaaatgtggatttgatgttcaacatagtttgttattgctacagtagaggatcgtgattaagggtatggcctgtggagttcaaatgcctgggtttatatctaagcctacactcacaactttgggcaaattgcttagcatctctaatttgtttatttatcaccctaaattaatatgccttgaaggtttattgtggaagatctaatagaaaataaatttgaagccataatacagtagttagctcataataaacatttaatacctgctagctgctattgtttctgttatcctcatagcacctcatgttgtactgtgattgttccattga

SEQ ID NO: 79763 - DNA, 1013 bp, Homo sapiens
attattctctgtgaatcctatcctcttgtgagcctttcatttcattgtactgggatagtatttttggcttctgtgacaagtgtttggtgaaaagcatatattgtatggttgtgggattttggtttgttcggggttttttggtggggtgtaggtatggggggataacatctgagtttttgagtttttaaaaatgttataatactcttttaatttaaggaagatgttcaagaaaatcacttgaagtgcttttaaaagtggagattgctggccccaccctggagtgtctgattcactaggtctgtattgggacctaagactttctcaggtcgtactgatgctgctagtttagggaccacactttgagaatcaattctatagcttatagtctcttttttcagtagaatcaacacacttgtgatttgtttgtttgctctgctttgctataaacatgttccccactttccctagttgcagtactctttttatcttttccccataaaaacttgaagatttactcctttaagacagtttcccacatagtctcattgcaacttccgtattcaccctccaaccctataatatttatcaattctatatagttgatatataggcagtcctcacttagcacacagtttcaataagcacaagttttagttatgaccgtgtattaacagtgagtaattgtataaagtataagcttcactgctggctcttcagtccacagatcactacataagtaacaggcaaatcatgatcagtgaccagtcatgtcacttctttcaaagtctgtttataattgtttattgtgtacccattgagttcatgcacagaaagcagagtgtgcagttgtgttgactctttgtctcccggtgataaacccatgtgatattttaccaaagtagataatcaaaagaattgaccaaaaaatattaaagcaaagcaaagaaacaaaaggtgatactgccagaagtgaaatttgaatggaacataaatggaattacagaggaaatagc

SEQ ID NO: 79764 - DNA, 1044 bp, Homo sapiens
tgaaacttttggagtaaccaccaccaaagtatcaaaatcaccaagtccagcaagtacttccacagtacctaacatgacagatgctcctacagcccccaaagcaggaactacaactgtggcaccaagtgcaccagacatttctgctaattctagaagtttatctcagattctgatggaacaattgcaaaaggagaaacagctggtcactggtatggatggtggccctgaggaatgcaaaaataaagatgatcagggatttgaatcatgtgaaaaggtatcaaattctgacaagcctttgatacaagatagtgacttgaaaacatctgatgccttacagttagaaaattctcaggaaattgaaacttctaataaaaatgatatgactatagatatattacatgctgatggtgaaagacctaatgttctagaaaacctagacaactcaaaggaaaagactgttggatcagaagcagcaaaaactgaagatacagttctctgcagcagtgatacagatgaggagtgtttaatcattgatacagaatgtaaaaataatagtgatggaaagacagctgttgtgggttctaacttaagttccagaccagctagtccaaattcttcctcaggacaggcttctgtaggaaaccagactaatactgcttgtagtcctgaagagtcatgtgttttaaaaaaacctatcaaacgagtatataaaaaatttgatccagttggagagattttaaaaatgcaggatgagctcttaaagccaatttccagaaaagtaccagaattgcccttaatgaatttagaaaattctaaacagccttctgtttctgagcaattgtctggtccttcagactcctctagttggccgaaatctggatggccttctgcatttcagaagccaaaaggacgtaagtaaatatttacaaagagcttacagtgttttacttgttctttttccttaggtttttctccctcgttcctttactttgtcataacctgttttgtaattgtcatatagtcactgatatttcattttttcga

SEQ ID NO: 79765 - DNA, 1047 bp, Homo sapiens
aagagaagttggactgcatgttctcactcataaataggagttgaacaatgagaacacatggacccagagagtgaaacaacacacaccggggcctgtcagggggtggggggcaaggtgagagagagcattaggacaaatacctaattcgtgcagggcttaaaacctagatgacaggttgatacgtgcagcaaaccaccatggcacatgtatagctatgtaacaaacctgcccattctccacatgtatccccgaacttaaagtaaaatttaaaaaaaagaaaaaagaggttggaaccatttcatttcagctgtctaaatataggtggtcagttgtcagatatcaaagtactgatttaaggaggatgtaagtttgacacattcagtgaaacttttttatgtgtaaagctactttaggctcagcactactaaatgaattaattaggtctatagcacctgtagtcatgtttaagggtgagagttagagacaaaatgatggcatagggtggccaagaaatacatgaaatggtcaggttgttctgtctttcactgaaatgaaaggaacgtagtactttagtagacaacctcaaatgggtgagtttttatgacttatttacttgttcgttactggaatttggaataacagtaagtctatacatataagcaatagggtagtctttcttttgacaataaaattaatatttgcatattcctgtatataagaaattatgtccatactgttttgatatttaattttttaaacatctttcagagttaatatatgtcacagcataaatacaataaatgaaagactatgtctattgaaacaaaactacaaattagagttaaatgtaatatattctatgtggtaaatatttcatcactttttgcaagttcctataagaaactgagtaataatgacagtaagaatataatagtaaaaaccagaaaatcctttttaaacattgctagaaagacatttttctcctgccagttggattttcttgcccttagatttctaaaggactttaatatctgctagtctaagggt

SEQ ID NO: 79766 - DNA, 1813 bp, Homo sapiens
accttcacacattccataaacacatatggtaacaggttctgaagctactcactactttctcttctggtacatttcattaacgatacgccaggatttttctttggcatccatgaaaagcataaagtcatttccatgaactcagccatgtaccagagtgatagaggattgtacaacttttccaaaaccaatactgctttcaaaaaatatggtgcataatgttagaattttcttaatttttgagataagcagaggaaatcagaacatttagaatctcagtgaattttgttaatctcaaatttgtgattcctttacattctgttcttagtagcttttattcaccatattaactgataaatcttagtgatgaatttaagtattaaaaactcaaatttaataaaatgtaaacataaagtacctgcatgtgtaattggcaagaacgattttcccctctttattaatgggaaaaaaacttctaaattgaataagtatacctcttcctctccatcaggtaattgaaggtaagtttgcattgtgatcatatgccacagaatacttaatctactttaaatggctaaacatcaaaatgcaggtggcagagttagataataatccagagtttactctgttaatcacgctatattctccctggtgattgagaatcatgaagttccatgatagtaatcttcatgtgaaaagcacatatttgtaaattatattttgttttccagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttggtatgtattgtgttcttcagtttcaggaaaaaataataaaaattaggaaatatttttatcttaaatttacatttatgtttttaggtcccgtcattttttttaaaatggaaaacgtaaggagattgagagagcaatggtgctttaattcttttgttggttccattgtagttcaagcattttgctctacttctgagcatgactcactccagttcatcttaagtactagcagtagaattttacatagattataccaattttaaattattgcttaattatttcaattaagacatttccaaattctcaattatataaatgatgctatgctgaacatctttgtagcaaaatctttgttcatatcaatgatagtttccataagataaattcttaaaactgccagatcaaaacctatgcatgttttcaaagctttgatctgcagttacacatgcataaattgttctgcaaaaagtttaaaccagtttgtttgtacctctgttgtatgacaggttttgaaaaaactatcttctctaatcctacaggggtaaggtaaaagaaaatcgaaatcaaatttaaaaaaagaaaaaactatcttcactaatattggacattaccttttttgcctttaatttaaaatgggaaaaatgatctcttgctttacattaatttaatttatgattactaatgacagtaagcattttccatatgtgtataagccatttttattttttctttggtaacttgcctatttatattatttgctcgtttttctattcggatgtatgtctttttaaaaaaaattgaggccaggcccagtggctcatgcctg

SEQ ID NO: 79767 - DNA, 2094 bp, Homo sapiens
caggtattaatcttcatcttgccactgcttctcattttatttttaattttagagttggtgtcttgccatgttgcccaggctagactcaaattcctgggctcaggtgatcctcctacctcagccacctgaatagacgggattataggtgcacgccagtgtgccaagtttatttttacggttcttttcaagtccacttctgttcagcatatcccaggtgtgggttatagcctggctttgtacaaggaaaaaggcattttgctggaagttgggcatacctaactcctaaaatatttttttcttagaatatccttgttttctttagatttctatagagcacaaaataatctattagtataatttactttgtactatagaaaaaatacacaagttattgatatgatgtttctagtcttttttcctaactttgttttattaagaattattacaatcattgttacagtaattactgtaataattcttaattgctgtaataattattacagttatttcaggctttattgtttacaactgttttcttgttgaaaaacaaggccttttattctgttaatttcaagataaaaaaaattttccttttactctctgtgctccataagtgtttgtaaaatgaaagaacaactcgaatagtgtttttacaaatgaataatataaaaagttaatattgtgttacttttctttgaagcatgaaaaaaaattatagaatatttggaaagtcccccaagaaaataaaagaggatattaaaatgacccatgagccgttcatgtagaaatagccactgtaaacgattaccttttttttttaattaaagtttctgtttgcagatactcgtaactgagttttaagcaaacaagcggggaaatagctttaaatggaaatatatatatataaagctctaacacgtttaacttaggaaaataaatcaaactcagaagatactagtagacttgaaatggagactagaagcaccatttccaaatgctacttttaaataagctaccaaaccagtacttaaagtataggaaacttaaagttttggattctaccctgtttgttttttgttttttgtttttccatagaaactttgagaaaggagaatgggtagttgacaaaatgcaggggcaaaacttcaaaccatcaaccaaaataaaatataatgctgtatacgtgaatagagaaaccctgtcagatgcttttggtttacaccctgatgaagttcttgacagcactgcacaaggaaatgatcttgatgtgctaccatttcattctttgctgaatgtagccaatttaaactgctagaatttcttgacattcctagtctggcgtatctgagtcagcatcttgttgctgcagcagcttaattaaatttgccagtttgtggcacaaggacggacatgttctcatattcagagtgacagctgtgaagcagtactgttaagagtgaagacacaatactgttaggtttgaagagctctcaagacgttttctagtgagaagtcaatttgctgtaatacatttctcccaagatcagcagttaatgttcattttgtttacctaaaatatgcttatttttatacaattatttgagaaactttagtagctgtgtcttttttttacctgtgttattttcagagccaacctaagcatcctaattttaatttccaaaattcttctctcatccccttatcagctctttgagtagttttttatccattgtttagctctgagagagtggtcttaaatatttttgctttatttggggacctacatatttctaaaatagtgttgtcatcttttggaatttttgccgtatttattctagtattataaagttaatttaaaactaatcagtagtagttttggatggaatgtaactcaccctttgtccagatgcagatctaaattagtagttctcagccgtatcagactgataccctcccactttttatgacgggtatttataagaaataagatacctcctttactagcttaaaatgaaattaatagatataatttttaaaaacaataaatatatcctatacctataagtgtgaaataatttattttttaatatttaa

SEQ ID NO: 79768 - DNA, 1050 bp, Homo sapiens
ttttttttaaagcacgatttagcatcctaagcttcctgagggtagagattgtatctttttgcgtctgcacaatggctagcacatgtcagcatttgacaattgttaaatgataacaagtgtgccccaattaaaacgtttttcctgggttgttttgttaaatttacaaagtaagccaagccttacggttaacattctcctctacaaccaagtattaaagccacatttaaaaagaccacatgaaatgctgattctaattgtgtgtaggtcttgaggattaagcacacaaatttcacaaacttctgtttgagtaaacaaactcagccttctgtaaatatacatgcaagtttggaaacagtaatactgtacctataaatatatgctgtctgttttgtgtacagtatgtaaaaactccttttctgccacactaaaaatgcaagccatttatgggaatcctaaaactagtattgaactaaaactttgctaatgatctttattagaggatcgtccaacttttcacttaccttgggttttcttttcaattcactcttacactagtctgcttatttccagctgtttattttattgagtcctgaatttaaaaaaaaaatattttgattcattttgtaaatacaagctgtacaaaaaagagagatttaatgttgtcttttaaatactccaattttcattctaatatgaatgttgttatattgtacttagaaactgtacctttaatattacattacctttattaaaagtgcattgaacacatcaattttagatgtgctttatgtactgttatcctataataaaacttcagcttctaatggaacacttgccttgtttttcttcttttttcttggttattgaattggactgtacatagtttcctagcttacatcctgtctctagtgaagggtctaggagagagtaggtaagtgtggtccagactagcagcacggcatctcctgcgactttgttggaactggataatcccagcactacccagacctactaaatcaatctgcctttttataggatcccaggtgatcc

SEQ ID NO: 79769 - DNA, 1247 bp, Homo sapiens
gagtctatgatacaggtcttcattctatccctaaacataatgttagtaaagaggttccatcagattgtattatagagaccttcctattgctatttatttttaagagatgagaagactgactagcaatgtctccacagtgcaattggtttcacttctgggtctgtctgtctgtttgtgtaggtgagatcagtgttgtcaggctctcagaataatttttaaaagaatccagaagcctgacttcacaccaagtagccatcctagatgggcgggggggatctccatgttcaaccaaaccctcagaacttagagcaataaatacattcagtcatttatttataaatgaatgacagaatattcaatccaaatagaaacaaccttttgtcagtgatgcaacataacatggagtcttatattgagaaagtgaatatgaatattttaaatagatgcctaggaaatctgtgtttgctgtttacatttaatgtactttgccacattagcagtaccacacttcttttactttcatccttctaagaactaatgaaagatagcttgctattagctttgacatgttgcacatgccattatgttgttctctaagaacaactaaattctctccagtgttcatgtgtgattcctttttcatcattattactttaatgtggatgaatactatttctaggaacttgattatcactgaacagattgcatatgtaaatgcagataattcttgagcaatatagtgaaaatgatttcacaaaaaaaatccatatgtactgtatacatcttcctgaatccaaaattctcctgttatccacacagtttgaaatctcatattaaacagtggtaaatttttaaacattaggacattagctggctgcttctataaatgtacctgtattgtctgcctgctccttttgtggagatgtgtttttgtattggatgtttgggccaatgggaggcttcaagctacaacatattttcccactttaaataatatttaacatatgacaaaccccagacaaggcttttaatatgtataaagaactgcagtgttaggtggtttatttgcaaactgttttcagtgttgtccatttttatggcacctttaacaatattcttgtttccaaagtacaaaaaaaataggttaaataatctagccataactgaatgtcaagcaataaaacaaatgacttttgtgcatagacttaaaaaatacaaattttagacatctgcatgtaaatgcaatc

SEQ ID NO: 79770 - DNA, 1309 bp, Homo sapiens
acccttctataaatatttgatggcacttgaaatattcctgcaataaaatgtgatttgtgtaaagaaaaaaagattttgtaatgtgaaacaaagaaagaaagtaatgtaattttctaaaaaaaaaaatacaaacaaacaaactttgtattattttcttgatggaatttgtctatctgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagttttttggggtttttttgttttttggttttttttgttttgccttttgtttttggctaaggaatgtcgatcgaatcacttgttattgttgaggggcagccagataataatcctaaagccactgtttccaacattgattgtttaaatcatatgtccttccaatgctattattttaagataataataaaaagttattttctgacagttctttgtgctgactggtgaaaaacaagggtaaataagcaccttataattgacttactgtgaatgacaatccatcttggtatcaacgatagaagccctatcattttggagttggggttaagagtcagaaacaatgtgctcagggatctcctaaaactcttaaaacagggtggccagtactactgggacaaattgtgttttttattattaataataatgataataatactatccctccaaggcacaagtgaactatatagaactgcgtgtgtgtaaactctttactctcgtctcattttgttgagtttagaacttgatgtgctcgtcagtcttgtgtttcaaaacactgaataacttccaaagcaaagttatgccagtgtgttcaaaagataaattaataatgtaccagcaaagagcatcattcaaagtatagtccttgcatattccagttaccatttctctaataattaaaatattcatgataaatatatatatagcatcatatgttaaaaactatttcaaattctacatattaaggatgaaaattttaaaatccagtaataagaggagagacctgcctatcagtacagtgatataggtaaaagatgaaatatgtttttaaaataccagcaattaactattgttttcatgggttctcctc

SEQ ID NO: 79771 - DNA, 1131 bp, Homo sapiens
ctcccatagagctgagattataggagtgagccactgtgcccagcctataatctttgaatttaggaagaagttataaaggactaaaagacttaatcaggatgaccatatatactaatattagttctacttccattaaattcactagtcatcaacagtaaatgacttttgcatttttgtcaatttcccatcactactctgtattcaaagcataaggtttcatttttaccaatcattatctttcacaataaatatgattataatgtcaattttttaaatgtgctaatatccttcagtgccattgctagtagtatgtatttggtcttagaacaatcagccctgttctttcttattttatgtattttattgtgtgagatgatgtgagaagtttttggttttgttttcttgtttatttgtttgcttgttttttttttttttctcctttatagctatgttagaccagaaaggggtaactgggggttaattgctgttttgctttttgattttgcacctgttaaatgagcaaacgggcaggaatgggaagtggaagggaggagccctgtcaggagcttcactctccatctctttgcccaaatgcaagagtaccattaggatctctgattataaacagcacttaacatgtggacaagatctggtgaaaacatttcctagagaaggttattctgggttaaaataataagcagtttgcctttgtgaggtgctttggaatctaaaagtaattttgcaaattgtgtcattaccctcagctggtaaatggtcaatgctagggcctccatccaggccttctgactctattattttgctcagacccagcattgctttattacaggcaaaactccttatcgaaaagaaacgtgtagttatcggagttgactagtgccagttctggataaaatgtgtagaggatgccatcacttccagttgcagtgccttcactacccacccaccactgcccctcacccgcttctccatcactagacatctttttgcacagtggtagaaggcaggattccaggaagtagagcagaaggcatcttggagtagaagaagtcaagagccttgggttctgtatgagtctgctgctgacaagctgtgccaacttttgcttatgaa

SEQ ID NO: 79772 - DNA, 1074 bp, Homo sapiens
ggttttaagatatattcaggaaacattccccccacttttcttctcttctgggtgaaaagattaatttgaaggtcacctacattcccaaattttcccatcacgtgtgttttgtttctacactccaagtcctccgagtttatgatgttaggaagaagaaagtagaactcagaaagatatacttgtttttgattcttggttttagtacatatgaataaatgctttcctagcaactctgagactctgcattgcgaggtagaagagtgctaaggaagtaatttataaatcaaccctcacttcagttaaacagggcttagcttcagcacaacagtcttttaattacatagaaaactctgcccttttggatagacagctgatgtgactgagaacccgctagctaaactgcacacgacacccaccatgctgttgcagaaggagtctctacatgagcagcttagaaacaaactcactaacatcagatgacccaaatgacccaaaccatttctgcctctgcttaggttctctagaggtggtgtttatcagaatgtgccgtgcctttgactctcagaacaacaccgtgtactttgatgggaagtatgccagccccgacgtcttcaaatccttaggtaaggggatatcaaggtgccttttcttcaaatcagggctataggaaaagatgcgggttgagtgaaagctctgcttggacaaaatgaaaactttatttagaaacaaaaattaaggggttttatacctattttactttctagttagtcactgtagaaaagtcatatagctcaaaagttttttgtctacattacttgtaaagatgtagagtttcattttatctagttggtaatcaaagggatttatatgacgtgtccttccagttcccttccagattttaagaaaccagatttgctggtgatatattattcggatgacctttaggatgtgagctgatacataaaattaagcaaagggcaaaagctttgcccttccatccccctcaaacagtaaccattaatgagactgaaatgcagatatcaaagaaataaaagttacagttaagtgaaacca

SEQ ID NO: 79773 - DNA, 1050 bp, Homo sapiens
ctgcaatttgcaggaaaaacaaaagaaatacctagttgtcaccataaaagaatatcattttctagtttttcaagaataagaataatccttcccaggtcaatgttatgtggcagatgtgtcttcataaaaatgccaagaagaagcaccacgtcaatcatttcctatgtctatctaggtcaatattttttcattcctagacattggtataaaggcacagaacaagggcaaagtcaggagggtctttgaagtcagcaggtcttatcttcaaatgctggctttgcaaagtccctgtcctccttcacgttcccaaatacaaaacagttccaaattacttgtttaaatgtgtaaagacagtcaaaactcgcacagcacattgttttctacttgttatttcttaaagcaaatattaaatcaccaattattcaaagaacttcgcttttcgtgtttgtgatctcccgttttctccttagaacaccttgcacagaatatatctaaatcgcatctggaaacctgccaatacttgagagaagagctccagcagataacgtggcagacctttttacaggaagaaattgagaactatcaaaacaaggtatgatctgaggaatttttcctcctaggattgaggcaatattgggaagggtgttggtataggaaagttggtcaagagttcacacagactaaagaatgaatgtcatcaggtttctgtttaaatatcttttttctgaagctactaatgtacttgaggctttgccatttaactcagatgcaaaatttcagcaatagcaaataatttctattgtgctttctaggtatacacatacctccttccatttgtcaacaggagaatagattaagcagcttccaaaagtctaaatgaattgagaattgtctcaatatcacaatcaagattttaaggtctggaagtttatgtaaaataatctcagcctaatgtttctggaagttgacaaggaagcctcatgtttctggaagttgtattagggagtatatacaaaaaaaatttagaagctgtgatcataactccagtct

SEQ ID NO: 79774 - DNA, 1096 bp, Homo sapiens
tgctttatacctaaggtgacaaaaaaaaaaatggcagtccacaaactgaacttggcccacagacatatttttttgcccagggcagagttttaaaatttttgaatcagttgctaatatttaaatttggataattatacccaaaagttcagcttttttagcttcttgtgggaggggaaaaaatgatctatttacactgagccaacatttgtgaatgtcaacagccaactggcaacagccaggggattacacctttcaatgggcccacctgactcccgccatttatatcatatgcacagcccctgtaggcatctcatttttgcaactctgatatatagtataaatgttcaacagaaatcagcttctttacttaccaaaatgttctgatgatggatattggtgacaaaattgatgtaattcatataaggctcaccatgcaaaagacaaaaaactgtccttttcttattgctggaacattactgcttcttgggagatgtgacctagaaatgttgataacacagacaatgggcaactttccatttcgaggaagttgtgttaacatccgctgctatatttaatcgatttttaagtacagcactattattagaaaaactttgataagaacctttgtagtttttaaatttgatctgctcctcctggtggttcctcacacaaggttataatcctttgggatatgtcaattagttgctgtggagatgactaagttaatacaaggagagaatgaagacttcagacggaaaagaaacagcaggttcagacttgagcacagaaatcctcagttcacagaaataatggctgtgttctttagacggtttctctacctctgcaccccataaaacatcttttaagtgaaaatttatatttccagtaaaatctttctccaaatagaacaaattgaatgttctttacggtttttacacaagcatctctttatgggtctaaatttaaatcctcaagagcagggacattttaagcctggtctttaaccactgaacagcattaaaaggtgtattgcagctcttttgattaacagagaaacctctgaactagaagccaagctgagcagaggtaggtttga

SEQ ID NO: 79775 - DNA, 1044 bp, Homo sapiens
caaaaattagctcggtgtggtggtgcacgcctgtagtcccagctactcgggaggctgaggcaggagaatcacttgaacccaggaggcagaggttgcagtgacccgaggtaatgccactgcactccagcctggtgacggaccaagactccgtctcaaaaaaaaaaaaatgacaatttttttcttttttgacttataaaaatgggaatttctcattgttcaaactactatgtatgcctggacgacatcgccaaaagtttctggtttgatatatagttctggtttgatatatctaaggtgtatcttttaaaagctctgtgggtgtttctgatgcatcacctatatgtcaactgctgtacctgataatctctcaaagtctttcagcaccaaaggcctgtttgttttattctaattttctatttgcaatagctgcatggtaatctgctgccactaggtggtggtagtgcgccacagtcacactaaacgtatactacctgaaatgtatcatggtggctctctggctcaagctcaccatgtttgtaaatgaacatctccatgtattttaacatccataaaaagtgaacttttatgacagccaagtaatttgttagcttatcttttagaaataacaaaattgccaaattatgtacttgatacctttcccagctcacaacttcagcactttttttttacgcctcctcagttccacccaaaactccatgccctagttttgtgcttcccctgctctctgtatgacctccaatccctggaattcatctctcagctcactcacttcctaatccttttgcaggatttctccccaatcagacaaaatctatctctgtacttagaaacacactacttctaccttgaggtaggaaggtacctaccacactttctacttttcttcttcctctttctaatccttcttcctcttatgtgttatttaactcttagtatcttatctgtttaattttccaaacccttaatcctctgagaaccccgccccccaaggaatactgaaaagaagaggtttttaaaaagaaa

SEQ ID NO: 79776 - DNA, 1070 bp, Homo sapiens
ctgaaaataaaatcaaatgccttagggtttttctttttaatctttattggtttttctgcttagaaaagtaatacatgctggttgtaaaaaattcaaacattagagaaatatctaacatagcaagtgaaaagtcctccatattctctgcactccagaaaaaaacaccatcaacagatctgtgtaaaagatagataggctttttaaagcactagtttttgaccgtttttgcaagacacacaaaattggttgacattcataagtatgacagacatgttctcataggtgtacccaaggttcggccattggccgtttcctggcaagccagcagtaaccccaccccattcagtccaattcaagaaaatatttggttgtgcaattgagctagagtgaacgatattattggggtaaccttgggtctatattagtttagtttttatgtgaaccaataaaaaactttaattttgtaaaacttttattagtaaccaattccctgtgacactcctgcaacttattgcaacataccactgtgttgtggcaaacagttaagcagcaatgttgtgaaggattgctgtggtagctggtaggaactgcctgtcatgttatttggaggataagcagcttttctctatccccacctcggaaagagcttaaagtctggaggaaagaatttcatttcactataaggcaggatttcttatcaacaacaacaataataataactactatttactgagtgccagctatttctaagaactatgtgatgggcatatatagagaatacatatataaaatgctcatacagatatcatatatatggtatgtcatttatgtatcacatccttgaatcttcaagtatgaaactgaggctcagagaggttaagtaatctgcccggccttaagaactgtcaaacgttgacattggtcattttagggttaaaattctaaccagaattttgtgaaactgagatcagtggcctagaaggttgatggttatttttagttataaactacggggataactcccagcaagagatgttgacatcaattcctgagtagtgtgttaagtttaa

SEQ ID NO: 79777 - DNA, 1757 bp, Homo sapiens
cgcaagcagtgagtgtgggaagctgaagggagggacaacacgagggaaaatcctgctcaaaagaacacagaatggtgactttcattgtcataatctgatagtaatcacggacaattctgacttcagccaccagttcagaaatcactaagaggcaggagagtttgatcatgaggccgcttggtgcttttactgcagtcacacagaattccctgtttccaggctcagcaaacctctgttacgcaaactcgggttgaggacaagggtgtgctggggaattggatgtaaattttagttgtgacattgaagctttccccacaggaagtcctttggaactatcattttattccattttatgtttaaaaatataaaaatgggctttattaaaatcccatttttttaaggtttatgagctgttagtgaagactatacagaactgctacctattttcctgtctctatctgtttctcctgggaactgttttggcttaccgcagatggaggaaaagagccacactggagtgaaatgaatgacaacattcccggagaagtctctcacgatctcaaaatccttggcccactggtcatttatagccactgctaaagtatttgtgaccagtttcctttagtttaacaattactctctcaatagacaagcatccatccaaataacaatttgtcctaaatcaaatccctggaatattaaaatacatcattagtttaggaaatctgttagttggccctcaaagtttttcattttttcttacataatcccttcttgctccccatttttcagttagagttgaataaggtagggcctagcaatgtcaaccatgatggagatgccacatagtatttgtcaggttagaagaagggtgagaaagcatgtagcaggtggaacggatggttccacagccccttgactccctgacgtagaagagactgaaggcaacctgatcaccacgttcaaaagttggctttctccattttaagttcttccttaaagcctctttaagcaaagtccctgaaatgatacagtagaaaaatcacacagacttatttaaaatgaattctatcactattcctgagatctcgcctgccccactgaggacattttgttttcgcaaagtgctttgaaatgtgataaaggatcttaaagaatatttgtaaaattatgcccaaagaagacattctttgaggttaacttgcagtgtctaaaagtcaagaatgaggaaggaaaggaaaataacagattcactttaaaatggaccacgctaattgggcagtgaaacatccttgtgtcacaccatttaccgtagcagaccagaagagggaaaaggcttgatttttctctcatagataccacagttcactctcaaaaacattcctaaaatggattgatatttctctgatagagcacctgttttgctactgacagtgttaagttccatactaatcagctcatctagcctaactgacaactcaaaaagctgattccaagaacaagaaactggcttcaatagaaatattatggtttattttgaagcgtggggacaggtaaggactaaacaaatttatctttgtgacatagtttaaagggtattttaaatgaataataattcctcataagtgctagccattcgtctcattgttggtgggtgtgtttgaggtgcggctggtttttaaaacaaatataccaaaggttatgaaccccccaaatattctgttccattcagaatttatttgtaagtctacgcactt

SEQ ID NO: 79778 - DNA, 1055 bp, Homo sapiens
cacaacatgattttaaactaatgctattggccaggcgcggtggctcatgcctgtaatcccagcactttgggaggccaaggcgggcggatcatgaggtcaggagatcgagaccacggtgaaaccctgtctctactaaaaatacaaaaaattagccaggcatggtggtgggcgcctgtagtcccagctactcgggaggctgaggcaggagaatggtgtgaacctgggaggtggaggttgcagtgagccgagatcgcgccactgcactccagcctggggaacagagcgagactctgtctcaaataaataaataaataaatacactaatgctatttaccgtgaagtgtagtagttatacttcgtgcctcccagcacttgagggtttcatcattgccttacagtatttctcagaaaataacacattctcccctggaaattgttggctgactttagcaaattcaggccacctattcatttaagactgttgtgtgtgtttgattatctagaatgaattgccttaagagtctcttttggaaaagtactagcacagtgcccgaaatgccagggagtggaaagtcatggtctcggcggggaaatgactgcagtgttcatggagacagtgttttcgcttggctgacattaatgacaacccaatgctatgtgctcactgagtgttttcatttcagaagagcatcaaaaccactgagtcctttcaagtcgtcttcttttactgtgaaaccagaaaccatgccgacgactactttcagtaataacctgtgtcccaactgcaggctgaagtaaacttcttctcatataattttctaatttctgtgtaggggtagttgtagcaaacaacttagtttctttcagagcgtgacttcagaaagcgtattttcatgcagcagtgatgggtaatgaaatcagaatttccacaaagtctgccctaattgaacagcattatcaggaaaaataaaacatgagactcagagttttctcccaaagtcatttatgttattaggtaatgaagctgattttattttagcaaacatactaggagg

SEQ ID NO: 79779 - DNA, 1060 bp, Homo sapiens
ggcaaagtgaaagccgcatgcaggtctgtggaattgtatggggatgtttcatacaacactgaatgccatgtctgctggaaaacattgcttgaaaataaatatgtaggccatcgctacctgtgtgtgtacttgctgtaatggagcaaacttccaatgaccaccaagaatgaaccacagtgaactagaagatgtgtcctctgataaacaatgtctgtgatgtagccacacaggaaaagccatggtttgaagctctggggagcccgtttcctaagagactctctggggcacaacaataagagctgctgtttactgagagtctcctgtcccccaagcactgtgctgtctcagtttggttttaggtgggtaagatccccatgctacaaatgaagaaactgaggctcaaagaaatttccctaagattgaccacatccgtggcagaattggaacagtaagtgttcttgatgactaaaatagttggaaatatacataaggggtaaaatctcatgaaggttccctaattaaattcacaaggtagactttgctttgaagtgaagtgagataccttctaaagcaaaagtctgtttaatattttccaccattagaaaaaatgcgtgcttaggccaaagtgcaagaagaggaattccatgtggaaaactgcaggtgtgtctagttaggccaagaggtataaaaggctgagcagttgtctggcacacctggtatttgcaccatcagcatcttgcacttagtggatgctaagcaaatatttgtgatttttttcaatagcagggatgtttgtctgaatatttaaatattcaccttagtttgattttactttggtagactgactccgtgttcactttgggagaatttcaacttatacgtgtccgccttaagtaacaagattcagaaaatatgattaagtatagcatttatttgagcccaaacttgaggatagccacctgggagaatagattgaagttgccttgtacactcggattaacagcagttacaagtgaatttttaaaggaagaaataagaggcagtttctaaattgtttacc

SEQ ID NO: 79780 - DNA, 1052 bp, Homo sapiens
gtcaaatacctggccttgcatccaaggactattcattttccttaagtgtttaagtggttctttgagaggatgtgttgactttatcaattcaggccacatcataattagctaatttaaagaaaaaacaggggtggtatctatatatgtttgtaccaaattgagttttaatataatcctggttctctgagggtgatatggctaataattaagttatccccattaggttatactttcggaagctgctgttgcctgctgcctattccattaaaaactaactttatcactaattttaacatgaaacagatccatttggagaaaaatccattatgaatgagacagagttggctgttgaataacattggtgtaggctcaagtctggaataaatgtgatatagatgggacgatattggacaaatgcaatttatttcattattcagcaacaaggtattccaaatgtctctgctaatgaatacatgaaaacagattacatataatgtgcacactgtgagtcgcatttgcagaattatttttgccacctctagcactatctgaaaccaacactgaatagcaatggtacttgagcttctagttgcaagaaaaagcaactttaaaaattaaaaccaaaaaatgtaaaaagaaaaaagtaaatgtcttatctgtggaatttacctttatgggagaattcttgggaatatagcagttttatctcaatccaattgtgttgtcctctgttaaacctctattgtcccttaaaatcagcccacatgaaaagaagacagtgttcttcttcaaagctctgatggacgactttagagactgtttcaggaacactctgtctttttgctgagatattggtagaatacaatagataacatttaccgagctcacaagggggtcactgcttgtccacagcagtttgtaagctgttggttctggcattaaatttaaagtcccacaaagtgaagcaaaaatgtataataatgctattattgtactggttgcagggttttcgttcgggtgccattggggtattgagatatttaaatatcaat

SEQ ID NO: 79781 - DNA, 1004 bp, Homo sapiens
acattagcctttcatcctcctttttacagaggaggaagcggagactcagagacgcagagcaacctgtctaggatcacagggctagcacatagctccaattgggggctgagtctgccagactcgcagggctgggctaaccctgctctgttctgacccaacagccccagcaccaccggagtctcagaaactcacattgttccagattccgagattaggtcatcatgcaaattgaggttaggggctttttctgaacactgcagtagaatggaagtagacaaaatacacatagaaatggattgagcatctgatgtgtgccaggcactataaaaagtgctggaaccagaaagatgaaaagaagtggtccctgccttcaaggagctcacaggccagggagggcccaaggtggaaataaaatcatgacatagtgtaaatgctagagcagaggaatgcaggagacgataggagcacagaggaggagcacaaatcagactgaggggttaggaacagctttttggaagaagtgaaggcttagctgagctttgaagcaaaggaaggttattgccaacaaatggtagtttgtgaaaatccttgaaagctagacagtgagcaaggcaagtcggggactgcaggagacaaggcatgtagaggagaccggtggggtctgaactatgacaggctctcaccctcattctacgggagttgttctttctactgaaggtgccgggaggccacggagggaggctgccagatatttttaaggcacatgaagaaacacgagaaacaatcagatattctcagtatcttcctttcccttaattatttcaagagataaaaaagctttttggatgcggcaaaggtctcttctgtgttatgatttgggtttctgtgcggccgctctgcctcttgtatggtgttgagagatgtatgaaaggcatccgccacgagtcttcaatggatttctgcactttgcttgatataaattgattcagggacttcattatgat

SEQ ID NO: 79782 - DNA, 2117 bp, Homo sapiens
gcttccaaaagcctaggaggggaggccaaggaatcttcttttgtaaaagatcctcttgtgaggataagacaggtttgggaaccactgctcggggctaaccctttcctcttactcacgaggaaagggaatctcagaaaggtaaattatattaaggtaaccattcacttctctttagttcactcccttcagcatggaagaggtgccagatgtgagcaatttctggcattgttattaacacacttgaaatatttttctgttaactttggccttgctatcaaccagcatgcagaagcaagtgggcagactgttccctcaaatctcttaccccaagtggcccaaacaggagagaaccctgaggctgttttggtgctggaggctgctgtgagacttttcaaatactgtactccttttcgtcataaagccttgtccagaagccccagcctctgcatgtgacatagacacaatgtattttagccttcactgtgtgcctgggctgggtcttgccaatactgtgaccacttagcaggagcaggctaagagtcttactgcagaagtcaaggccaactcagtggaaacagtgatgtcttttcaaggttgctttattcagcgacaaagtaaaggtttcagtgccctggaagctgatcagtgcttcctgtttagcacatggcctttctcaggcactgagcatctggtgtgtatctgccagtgtccaggctctggaggtgacatccaaacaggggagaccaaatgctgccttcgtgcagcttagattctagtctggtgggatagatgaaagtagacttcctctggctggtgtggagaaggactacctgcctgcttccacactgcgacaccagccccctttttcttttgaaaatgctggtgtagtatctatctcattattgtggcagatgtgatgctggcggccgaggggacagcagtgatcatgtcagtctctggtctctgtgagtgtacattctggtgggagaggtaggtaatacttaagtaaacatatcaatgaactagataaatgcagataataacaacagctaggccaatgtaaaaacagtataatggtttagaaatgcttatggcctcatgggtcaacatcagggaactgaatcaaaaaattttcccaactgatggtgaacattttgcaatagacctcacaggtcatctgctcccaacctggtctgcgtattaatctatctaaagagtttttaaaagatatataagcccaggctgtgctcttacagatttctgattttactggtcccaaggtgtagagctcaagtattgctacatttttaaagataactcagataattctggttgagaaacctctgaagcccaacaccctcactttgtacatgagtcaccctgtccgcagtgtagcaaaacaatgttgagtagtggaaacccccctacatagggtgggggaagatgaagatatgggttattgtcccagatctgcgatgcaataattgtcaggttaaacctcagttgttcactttccctgtttttaaagttaaagggttggacttggtagtcaccaagatcttttccatctctaccgttctatgaaagtgtttctattaaaacagaaacatgctctagtttcttgtttgagacttgggagaggcaaacaaatgcctcctactttccttattccctgtctctacccttaattgctataggtccttctatcagctaatcagttccttttggaagtgaaaatttaagacagaaagaggtaattactttatgctatttaaataaatttaagaacaagcaagttttcattaatattaataataaatatgcccagatttagttctagtaaattacagtcataccttatttatcaaattgtagcctaaagctttttccgtttttgatggttgatttaaaaccaaggggcgggggcagttgtttaaaaatggaaaccatggagtagccttaaccattgcgtaccacagtaattttattctttaccaaatattccaagccaggaacccaaagaaattgagtctctcccaatgtatcgtctgcagtttattagcaagcagaaacaatgtatctcttgtgatgccatcttattttataaaaaagaaaaa

SEQ ID NO: 79783 - DNA, 1125 bp, Homo sapiens
gtgctgctgtggcatgacctggtctgcatattctcagatctcagagccagcaccagattgtgatgaagtttccacaaaaatgagggcaatccattgtaaagctgccaactttatttaagaaataaagaagagagtgtccttcctacttttggggtattgaaatgttgctttcttttatgaattaatggtaattgaagatggtagctgtggggtttttttaaacacccttttttgatcaaatttaaacttggcaacagtatattgatcttctcacaatttcccaatttccttttcttttcttttctttttggattttactggcctgcaaaatccagtctctggaaaatatcagtctatggctaattctgtccatatggtaatagagagaatgcagataatcaccatttttagctcaaagtagcaaatccctcccctcccaaaacttgtgcctcagctaatgataagtaggacacccgatgcgtgtgagttgtatttctccctccaccctctaataggagtcctaaaattaagccacagaaggtcagaaaagaatgaagcaaggggaaaaataataataaataaataaaccagctggttaatggactcagtgtcgatgaacaatgaataaaagtatgccctatcattatttggaatatactaaaaaattattcattgtgtatttgaaattcaaatttaactgggaaccctgcattttctcgggccaacctacacctaagtctatctgaccctttagaaaatacataggtagtgaggccgggcgcagtggctcatgcatgtaatcccagcactttgggaggccgaggcgggcagatcacgaggtcaggagatcgagaccatcctggctaacacggtgaaacccccgtctctactaaaaatagaaaaaaattacctgggtgtagtggcaggttcctgtagtcccagctacttgggaggctgaggcaggagaatggcgtgaatccgggaggtggagcttgcagtgagccaggatgcgccactgcactccagcctggacaacagagtgagactccgtctaaaaaaaaaaaaaataggtagtgaaacatgaatttaagtagctactacacataaatagttattaataaaata

SEQ ID NO: 79784 - DNA, 1033 bp, Homo sapiens
gcccttgagctgaaggtaggaccaaaagagacagaaggttagaaaactgaaggatagatgcaatcgaatttattagccaccattaggggtgcttctgacaagacagaggaaggagaccctcagcctagcctcctcttcaaccatagaatagcactctaaaggtaaacccttctggttcacagtgtgagtgcgaggaaggaaggatgcaaaaatggggaagaagagccaccttttattaccccttactgaagttgtcttctaatcaactgctgcctgaaactgtccatcttcttgagtactgtaggcaactttttgatatttattcattatacattcatttatttaataaatatgtattgattacctgttctatgctggcagctacttggacaaaaagaagttggcagctaagaaagaaagatatgtaggcctgggcctgcagaagtatgcagtttagaagtaggagtgcagagtgtccatgagtgactagttccagggaaagtgagaaatacacatagccttgagggcacggagactgtgttgggagttactcaaagcagggacaggagtgacccgtccttatgaggccgtacagaggcaaaacctcttttgggataaatgtgcccaaattgggctgcaggggcagagcaaggctggagaagctctgatgatgtggagtttaaaaagcccagaattctagtctcagcacaccacttcccagcagtgttaagcatggagcttcctttctcattgccttgtctgcccacctctaagtgctggagttggagggatcatctctgaggccccttctgctgaaagacctacaggtcctgattgtttgtgtgctctggagcatagaggattggaggtttgcctgggattcttcatgcggggccctccctccctcttctgtgccctgggaccagtgtagtaagcagagccctgcttttcagaggcaccacaggagctgtccagaaagcccaccaacatcatcccactgctcaggaaggaaattgggttgcagccatgagaa

SEQ ID NO: 79785 - DNA, 1014 bp, Homo sapiens
taaatatcccgcctatggatataacaacgtattagctctgtgttcagatgggataactcaaggggagacctctaccagatgcaattaataatatcttacatttatattataattttattattgtataaagtttttaaaaatctgcacctttcttatagtacttttcgcactctgacttacagttgaattatatgtaaatgtgagttacctcccctactacactttaagttttttttagggcaggatctgtgcctggctcacctttaggtgttgagaaatgaatagcacttggcatatacttgttgcattaatgaatggagcagggatgtttctgcagatccttttagtgtgttttactggtaaatgcattttacttataatattttttaaatgggagacataatcttttcttcatttttaatcccctcattcaactttataagtgaattgtgtgtctctgtaggtattttggatgaaacgaatgatgatttacttagtagggatatttttaagtggaaatgaactaatgtcctatgtttttctgtgttaatgagctgtaacttgctattcaactgaataggtaactgaagaggagcaacctagtccctacacaagcagggtcaatataattcctatcctgtattgtctaggtccaagggtgagttgggaggatgggtatattgcagatacttaatattgttgaacggtaagagaatatttgtctcttggttatggattctgtttacaaagcaaaaaagtattttagcctgggtgacataatgagacctgattctaaaaaggtaaataaataaaaaagcaaaaaggaagcatcttcttatcttgttaaattctacatgaagaatagtcacccggatgggaagtagaagtaaggttttcagttccaataacatgcaaggaaaaatggaaaaaatcctttggcattcgttcttttgatacagaggaaaaatactaggctcagtgtttcacaaaccttggtgtcccagtctccgagtt

SEQ ID NO: 79786 - DNA, 1033 bp, Homo sapiens
gagggaaggctgaaatctgagtgtctccacccttcgagttgaggcaaacctccttggtgcatatgagccacaaagatcattcctcccaggcctcagttgactgatcatgatgttttagtcaatggaaagaatatcagtgcttatcagtttacagcaattcctggggaaatgtagaaccatgttaagtttgttggaagcttcattgctaggactgtcttgagaaaaaccttgtagagtttcctgcaaagtgaccaccagcttgacttttgtagaagaagtgtggattactaacattagccaacaggttcatatagtgaaaggctgcaagatgtgttggcctgttaacctatctgtttacttacttgtgccaaacagcatttccccttctatggtgcttcctgctcctattacatcttccacagcagcaggtgcagtgagcagcctggattgcaaatgacttcgatggcagggctgggccggtaaaacccaagcctccattcagggagtcttatggagagatgcattagactgccctgggcatttaaatggaccattggtgagcctttgatctgaactccttgtggttgtgttggaggaaggcaattctttctggccagaaaactgaggatgcaaaaagataagagttgggccaacctgggagaggccactcggatcactccagggagacaacgagccttgggttcctaggacgggttttcattaatttttgtgaatgagaaaagtctgatgagccttcactttgcacagcaatccaaattgcttgtgccttactgactagaagtccaatttaggcttgaaacgagttatttatgctcgctacctaaacattctcgtctataaaatgggagtaattcatacctcacacagtgttgggaggaggaattgattaattaatgtttacaatccactttgaacttgaaaaggcttcttgggaagttattattaagcctatatcatttttactttgagttctggggtgtgtctaaacctgaaactcaaaggaaacctcaca

SEQ ID NO: 79787 - DNA, 1051 bp, Homo sapiens
tttcacttggggtattgcttctttttctcttgggtcataggttctcagatggaggaaggtgagtcttggaaatcaattctggcttcaacacttatcggttgtatcatctataggctgctgtgctgcttagaggagaatatccttcccaaagttatttggctgtgcctatcacagactgggcaccccaaagtagttcctttttctttattcatttaattcatgctgcctatatttattgaatgcttgttacaagcaaggaattgcactcaagagaccagaagtagacccacttcaaagctgataaaacttaaacttcaggacccttcatttgcaccggcctctcctaaagccctgagaatgcccctagtaatttattttcatggttataggtttctgtaatatttgcaaaagttagatattttacaattctttcttcttaaagaaaatcccctaacttgcttaaacttcagctgccccaaacctagatctgtccctgaaagagctcacaacaagtgggataaagaaacatacatatagattatcaagaaacggtatggatagtcggtgcaatgcagacccagtgctgggaattctggcaacacatttgtaaggaagcagggtgtccagggaagtcttcctggaagaggtggtgcttgagtttggccatggaatagaaggaagactcttctagagaaacagcttgagcaaagttacagaagcaagatatattaagtgtttgtgtatgtgattaaaatactttgctgtttgagggcattttccttcgggctgggatggcctctgatgccaggatgaagagagtccttttccagggagcagtatggactgtggggctgtgttccttgggaacacctgatccttgggatcctggcctcagctggctcctctgtttggcctttgggaggcctactggtgacaacatcaataattgttcttcaaggaaaaatcactcttctattccttgcttcttctcccatagccctccaacccttctttactgtcagccttgcaaatcaatatttcattttgaaga

SEQ ID NO: 79788 - DNA, 1061 bp, Homo sapiens
tggaaggacagagaggccactattttcaggagcttcctcttctgatggcaggagtttgaagcccagcaattcctcagcatccactggtgcagcccctttcctctcttccatccattttcttcggcttggattcaagcttggaaaaaatatcccggggactatgttgggcatcttaggaagctgtgctctctcttcatttattattttattccatgaatatttaactcatattaggaactgcactagacactggagatacagtagaataaggcttaattcctaccctcaggaagctccatctggaaagagaaaaagataccatagatccccttcgcctctcccacttccacccaaaatcagcatccttagcatatgattcatgcttcagtacaggagagtcacatgcagaacgccttgaagaacgctggctaattctgcctggggagttggagaaagttttggggaggagccaaggttggtctgagaactaagagaaagtccttctgggcaaaaggaacagcctgagtaagggcatggagacatgacactgtaggaggcttggaagccatataaaaagttaagtcttcattatgtgacattgttcctttggactagaagagctaaattagtccctaataatatattctctcataatcttcatagattgttttatgatatgtagtatgcctttttatccaaatagattatatgttattcaagttctaagaccttgttctcccccataacatggaactaagcaggactgagtatccgacatttacctaaaagacaaagaaaaaggtgaaattaacacaagttttgatcttaaatgtgatgcttcagttctctgagccttgattttctattatataaaattatgataattatgctatttctcaggattatttcaaagataaaataaggcaacacaggtaaaagtactttgtaaactatactgtaatattgctcttattacatttgatctgataggtaattataataaagatatagtattctgtagtagtttttactccctcaactgtggccagttagactctaag

SEQ ID NO: 79789 - DNA, 1140 bp, Homo sapiens
gactgtctgtacctgacctgggaagctgggatgggagagtggtggggaatgggctggctcatgggtctgtgttagtgtagctggagttaggagagccaggttcatttccagttctgctctggtgaagtagagaccttggcaagtcatagcactccttgggctacaacttcttcctttgcaaaatgaggctcttgaactaggagataactatgcttcttttaaacgatcaaattctggcaatttcagttgtggaagtaagagtgaaattgaaccccaattttccctttgataaaataagagttttaccatttaccaccaaaccttgtttcattgctctcaccctcagtttctctagcaatacaatcagggtttggactacacagtgtatatattttttttagttctaaaattccgtgcttctgtgaatactgctactcattgctttattcagatttcctttatttattcagcaaactttgagtttttagtatgaggctcaggagtcagactgcctggattccaatcctcagctgaccacatgctagctgtgtgactttgatcgaattacctaaaccctttggcctcattgctctcacttattcacatgggattaataaaactggggctcttgtagagtgattgtgaggatagagtagcatagcaagtattgcacaaaggagtatcttgcacctagtgcaatgcctgccacatagtaagcactcagtaaatgtttttatcagtaccatcaggccccacactagttgctacggatgcaaagatgagtaagacacagtccttggcatcatagagcttacaacctaggcagggaggagaaagagatacaaatcactagaatatgatgtgaaatgacaaaagtgtgttcccagcctttgaggaatacagaggagagataggggataaaagtggtgagttactagtcacgtggaagcctttgagccactttgggtggtgaaaggaagaaggagcaggctcttaatgcgagccctaccttctggaggacttaaggggaccacaggcgccaggacacgggcagcagatggagcggacccagtgcagagcgtaggggctagaagccccggatccaaacagccaaggggacaagagtcagcactgaaaggg

SEQ ID NO: 79790 - DNA, 1053 bp, Homo sapiens
ggaatccagtcaggggatgtcaacattgacatttccccttccaattagtctcaagagttcacatatctcactctgttcaatacaacctggagtgtaatcatttgttggtaataacctagcccttgtttagcctcatggatctgactctgaacctggacatcctatggacaaaaacaccacttgctttttattggcatgttgggtagaatggctccacacagccaggaaacaattttatttttcccctttgcaactcaattatgaggctgaagggcacatatagatttttctgcaggaatcaaagggctttcaggcttacttgatgagtagatttctgcatcacctccgtggtaaagggttagctgcttttaagaggcaaaaatgcccagactgaaataaagaaggaaaaaaaataataatacattccagaccaccttgtaaaaaataggtaggcgttctcaatcttggcctttcactccagtcccacttgaggccactctctttccagaggctctatggaacaacaagggtggtgagaacgctgaattaggaggcaaaagcccatgctagtgttctgtcccctaatgtgacccacgcttagtggggatcctgttcagaaccttcaacctgctcttcctctgtctctctgcctataaaatgagggaagtagattggctactttaacaaatctcccctttataaataacttgtgactctattttctatggttttttttcagagtacatctttctccatttatttatgtgtgtgagggttcaatcgttcgataaaggctatgtttgagagaagatggaaaggcatggaataagttttgatcttgggtttactgctaacattgacttttcccgttagcccacctaggttctaaagagctagtatccagagctttgacacatggggtgccaggctttgtttctctgttaaaatcccccaaatttcctgactcctcagaacagctcagctcagctgggagtctgtggctgaggctggccgagacatcagcagagtacctggaatggaactccaagcagg

SEQ ID NO: 79791 - DNA, 1054 bp, Homo sapiens
cacctccccatgggcaagcactttgggaaagccctttccccaaagcctcccaccctttctctcgcagtctgacattgcagtttacatttggtgcttcttgagtccaaaacaatttcttaattcaacaaatgatcacacatcattccctgactgtgtaaagtacagcaaattagcacagccaaagcaggaaatatttgctctgaacgtgcacccgtctttgttttcacagcctcttcccagtcaatggagtgcagatcatctattgccagacaccatggtatacactagagttacagaggtgaagaggcacggtccctttcatacaaaagtcagtgtgaaagggagacagacattaacagaaacacttaatccaccggactgagttccataggaagcagtgacatggcaaaaggagtggtcaattgtttggagggaactatgagatggaaaaaacaggaaagataattttcaaaagacaaagcagcatgcatataagggcataaatattttttgttgagaccccctttaatagactctaactctacagttgttactttgacaccctatacagtaaatccatagtatttaagcagattctatagtcatccaaatatttgcccatagccattctttaaccgtgtctgctgctaacaaatgccagcaaagcacagcattgtctttgttttaacatttcccttaaaatagggccacctttctgttttccacctgactcacagtgaaacagaaagacctggaatgaagtaagtcatttggtgccctgagataaaggacagcacagcctgtcacgtggcagtcacgggggaagttgtactgacagtctcttagaaatgcaaaaacaataagggcacttggcaaccagaatggaataccaagacgttggccaatttcctctaggctttcctgggagaggtggctgtaggaggctggggtggaggggctgatcacaggcttgctctactggctctagaaaccagaggtgtaactgggagctctctgtaactttccaggtggtgagcatagaggctatggacat

SEQ ID NO: 79792 - DNA, 1010 bp, Homo sapiens
ccttacctatgaatgagctactatgagtaagcagctgtgatatctgaaggaattaatggtttttaatggtttctctttaggacggtccagaatgacccagccctaatcgtggctgagtttacaagacactgccttggaatctggtccaaggcagctgctcatggcatctccatttcttctttgagaagctttactgcttctcaagcaaccccaccttctcaggtccctcagattttcccctcattagtaatcttggacatttcaaataccatgaattctttctactccaaaggattggttttcaaggtgaattcaaagacattgatactgcttgttattccaaatagaagttgcccatctccctccagtataggatcttcatttaaaaaaaaaaactcttgattcaatatttttctagatattgctttgagaattcaggattagaattggtaccataatcaattctagaccctaatttctggcatttcattatgtttagctgcagtgccaagttgaggcaatggcttaacatggctccctgacatggtgttaatattgaaggaatcaatatttagctggagaaatgaatatttagctggagaactcagccaactgttttgagtctgagctatcagcctcataaggcagaagagcttagggagaaggctgaggtttttgccagaccatgtcccatctcttcctgcccttacatttgcttatgaggtcctcacagtggctggtggcctataagggggcccttctgtagaactctgtgtgtgccagaagaggcagctttggccctgtgcaagacactctggagcattaagtcttggcatcagccatgcaactcttgataccagtgcctgttttctagaggcaaaataaggacacttcatgagaagaaaggagtaatcaaatgtcggagacttgaaagactgcaggagtctgggagattggcagggcttagctctggaagctgaagccaggcctcttctctcttcagctattcc

SEQ ID NO: 79793 - DNA, 1175 bp, Homo sapiens
ccatcagagccacttcacaggttgcctagcacaaggctaagctgaaaactaggtaaaagcatcctactttgttcaatctaagagatggctgctgtgagtagatagacagaagactgtaaggagcaaggcaagtcattttgttcctggagatgggtcttccttttactaagaagggcttcccccagggccatagatacctctgggccatcagataggattgggtcctagcatcattgtttttctgctggaactttgcacagggactctgatggtttcgttactatgcagaccttcccatgggtaatattaccatgatgagccttcaggctgagtaactgtagggccggccacatggggaaacccttgacttcaactggtgatgaattcaacaatgtcagtctcagtttgcccaactcaaagagatttgggctcaaacttattttgggatcattgtcttctgtctgcagtaaacaagaatgttctctaaaaagggcaaagctaacttttgggaagatacacgtcttaggaatgacttgtctgctgcggtctcaaagggtcacattttgctgatcatttgtgcagcatctggctgttgaagtccacctcctccaaagcaatgaaggatgaagctgccaatttgagtctgatgttttatttatctggactggtaactttatgtatggtgtgtttctctgtttgggcctcaaggccggttaagcaaaaggcgggaaacataaataagtaatggatggagagggctgtccatttatagactctcgacaatgacctgattttctgttccagtgtaagcattagtgttgcattagagtaatatgtagccatagatgttttcactggtgtatttggtggtgataatcaggagagacatattcatgttctatttttataataaaaattaagaaacctcaggccacaccaagggcccttactggcagcatggacactgtgggtttgaacagtccattttcctcagcttgtgtgggatcactgtgttcttttctgctctcctccagtttctggttattattaaacaaccctttgtgaaggattaactctggcttttctcccagcgaggagatgtctacacaaagccagaatatccagccaattacaggcaaatgggttatttggtgtagtgcaggaacaaatgactg

SEQ ID NO: 79794 - DNA, 1004 bp, Homo sapiens
ggcatcatgtaattttggagtgggaagggaccacaaaatcaatctagtctttgtagcaatgagagggaggtaaagccaggtggctgtgtaaaccaggaagtgtccagaacctcatatcctagtttcaggcaatttttttcctcattccacacacacacaaaaaaaatcctgttttcatttatttagggggtttcaaaggaaagttttacaatctatactggctatagggaagtatagaggatacctcctcttgcatggcaagcccgcacccttaccccaaggccaggaaagagagatgagaaggaggccacaagtgctagatgggagaggaattgagagatttttcacagatatgtctctaccataaacctttatggcaaaacaaaacaaaacaaaaaaaagccttctctggaggatcatgggatgcagcagtagaagaaccttcaggaccatttaatccggtgttttttcaaatgcgtcctaccagtttcccagggtgtttaaaggtgtcacacttcatggcccactaaatgtggaaatgatgacttgaaggacactaatatgtctgcatctggagtttcaggctctttaatatgctcccattagcacggtgactctccaagaaaggatacaaacatgagccatatctataggatttgttgttgttgttgtttatttttgtaaagaacccttttattttaaggctcctggaaacatctttcaacatttgtgtgtttcaggacacactgatgttgcctaatacgttagtttaaagataaagacattggaacaaagtcactatcaggtacgtggttgaactaggactccagtaagcccttccttcagagtgctagaatttagactagtcaggctaagatgccacatacttgaaattatttgaatgtttcaggaaaatgattttttaatgtatattttgttagatctctttgggtcagtttcctacttgtcactctgttacactgagtcaagcagccatagtcctc

SEQ ID NO: 79795 - DNA, 1050 bp, Homo sapiens
tgaagaactagttcctcccctctccctcccaattcattgcagaccaatacttttgttaaagaaggaaataatcaaaatgagttaccagaagaatgaaacaggaaaaaaaaaaaaaaagacatatgtagtccaagcccaggcttattattattaaacgtcacagacaacacatttcactttggagggtatgtgccccattgtcaaagtgctgtaagtttctaaacactactctcaatttctgtatttatcttgtctcaaaccaataacaacaagcttgcaaatcagctctgctccaaatgaactttgagtagcactggttattacagacagtgccttattatttgtgtatgttacctcctatattgtgtaaattgtttgtagacattagatagtgtgtatttatgtgtccacattcccccactctctccaataagacttgtaagtaggtaactgtcagtagtaattataataataactattattattatactaatattaaataattaaaataattagtagcattattggtaaaagcaattaattgctattactattgtcacgattcttttttaaaaacaacaaaaatatatgtagaatgcacccttctccaacctctctttgtgagtattatcctgaagatattccattgcttaaatctagtttcatagggaaagtgtaatttttaaaacctaaaggaacaaaagcatcttgttaattatcattactcaatcggggtgctatatgttcttataaagtgaatcagaaaataattgtatatgagaaactctgtaattgttcttcacatcttggttcttatcctactaacatattctcagaaacagtttttggtattatccccagtatattaccaatccaggagtatttaggagttaaaaacacagcagagttacaattttgctatgaaatatacaaatcaaaaattatgaattctgcctcttctctatgtttacaaaaagtgccaaattctgtaaaatatttgaagagatttattctgaatcaaatatgaatgaccatggcccaaggtacagt

SEQ ID NO: 79796 - DNA, 1033 bp, Homo sapiens
tggggagcaattacttaataagtatgggttgtttttcaggggcgatgagactgttttgaaactagaaagaggtagtggttgcagattattgtgagtgcaccaaataccactgaattgtgcactttaaaatggctaattgcatctgatggacctttcacctgaatagaaataaaataagaatacttttccctgaaggtgattaggtttaaatcaggatgatgtatacatggtggacattcaaaaaatacccttttctttctttattctgcctttatcactgtgcccgccccacaacccgcaccctttctggatgattccttctttccttcggtgtaaaagaaaagacagtgagatcatagtagtttcaactgaaaagtaagtggaaatggggagtggggtgcacataccaatctctgtgcacctggagtagataaatctaggtcagccctttaagatgttagtgtctgttaaactgcattgtgtaccttattgagaatgtttcaggtggcctttaaacatcatagagtctttggaggggtgggaatagacagagacagctacagcgtttggagcacttcatctagggcaggtatttgccaaggaagcagcgagtcgtaattctaatagtttagcagtagaggatttgccatggtcaatgggctgtttgtcagcggggcaagtgttttgcctttggctatgacttttatatattctttccaatggaggcggaacaacagatgagcaaaaatccccaaacattatgctcactggttgaaaaataggcatttcctgagctgaatggaggtaattgccttctgacctacgaggtgagcagtctatttccaggagcatcaaatgtgacttcctggctattagcatgctatgactgattgtagctacatttgcttctgactttctaccccaaagggaattaatatttctacctgtttctaggattaggtaatctgtcacttgcccccagtgtcttccctctcccaaccctccttctggcctggaggacctgcttagggct

SEQ ID NO: 79797 - DNA, 1049 bp, Homo sapiens
ctgcatatgtctgatacaatacgctgctaaaagtggaattgctgcactagaatctgcacatttaaggcatctgcaacatgttgcctaatttaactccagaaagactactcatttctattccaactttgaatagacataagagtgcctgtctgcataaaccttcatcaacattggtattatctttctttttcatctttgctaattggataagttttaaaaagtgtaacacattttagtttgcatagctttgattataagtgaggttcgacattttttttcatttctttacactttaaaaaatctaaccgtggcaacgtttgcaggtgtgtgttcttcttatgttgctgagtgttatttactcccggacccatgtctgtatccatctctgttttctgcaggaggcataaaattaaagttcagcttccctagaacgggtgtgtatgtgtaagaggtttaatcaataactgacagaggaagtgggggttcagagtaccctcccaggcctctgtggatttcttctctttcaacctggctgctgcttctctgacaggtatacttcttagctccggggacctggaccagacagccctcactctgcccccatgtgccttgggactctggaccttgcagaaatacttatggcctgaaaaatgcaaaaggtcgcaggcttatttttagatgaaaaaaaaaaaaaacattcagactccattttaagcataaagaattctataataggatgcttcctcttgctgtattatttgtattgtacgtattagtctgtctctctctctttctctctccctctctcttctctctcctctctctccccatttctttctactcctcccctctccccactgccccctttttggcaaattacacttttccatgacaagaagtaagtactgtcaataaagaaagcaaatgcatgacaaagatttcaagagttgaaacctcctcttgtctgactccccttcactctgggatctgaaccgtgtgacagaagctccctgtggcgtgtctttagtccctccacaatgggatcttgt

SEQ ID NO: 79798 - DNA, 1098 bp, Homo sapiens
ttacatttaattctactcttccagtgtctttctttttaactcaccatctgacaaggaatagttagcatataacccaaagcatatgtggtaagcttgttcctccctgcctaaatatgagtttaataaaaaatagcagttaaacatatgttaaaaatgaagcagtacagttgggggcaaagaagaaaaggcaacacaactgtttattagttgtgtttttcattttcatgttcagagaatttgaagactccaattttttttccaagctgcagtcagatctgcacagttgcataccctgtttgggtctttatttcctacagatgaacactaggctgacatgtcgaagcccatgtccaaagtaatgaacaccaattagcaaattaatggattaagatcctttttatgtgtcaattgcccaggttaatcatgtcaggactaataatattttacctcaggatagagctttgacattacttacagaaatcagtttaagtaagtgttaagtgatcttgattctgtggattgtagttcaagatttgtgaggtctaagcgtagtcaagacaaatcagatgtttccatttctcactgttgttaacagcttcattaagacgatctatctgaattaaaattaaagattagtcttgaccttataggtataaatagacagtctatgccccatgtctttctaatttgccagattttctttcctgtatcgtacggatgaatcaaggtggacatctttcatcttggtgtatttccaccaagctaaacacagttgtttaagcataggactatgcccagagttgtggcagtttctttcattagagtgaaacgagggctgcaagccctaagcttttgttgaaatgtgcatccttcctataataaatttttactctatcttaataaaatccatggcaactttcctacccatccctcccccggaatgggctacttttatagggaaagaaaggcagcatcaggaccaagaaggggatggagaacaccaagtttcttcttctaacagcgatggcattgaagagctgttaatactcaaagtgatgaatcactaatggcatatgacattctttcagattcgcattt

SEQ ID NO: 79799 - DNA, 1084 bp, Homo sapiens
ggcccggatccctgaccttgtacaaccagtgaagcaaagcacaaagccatctgcccccagaattcacgttatgtggaaaaaagtaaatgcttagttgtttaggccactgtcagttgagtttctgatacaattgaattcatcataactgagaggcagcaataaatagcctaattcagcacaaaggtctgttaccatttgggaaggagaaaagatagatgaggggcctaaaatgtcctcaggaaattatacggggcccttgaagttttgtcagtttgggaataatgtgatttgagttatgctttaggaagggaattccagcttcaagttcaatgatggattagagcagagactacaaaatctaatagtgcaccaagattgcctgggatacttttcaaaataaagatgtgaagggccttttgttgatattctttgatcagtctctctgagggtgaaggttttggaagcatctggattggagaagggaagccttggttgttgtaacaatagccagacatcattatcttcaataaacaataagaaaagagcctcattcacattttagagatgtgaatattgggcctgaaaagtattgagtcactgcccaaagtctgtttgcgaagaagcagcaattccgaactagaatcctggctcttctttccccattgtgtgcatgctttccatggtaagatgctagctacttctggggcaaagagagtgctttcatcctgggctgcaggtgggatggtctgaacttgagtagtaggagagaggatggaatgttaagtgacagaggtgggaagctaagtggaggtgatactgagatgctgacttaatgtggagtcctaaagagaagggaacagaaagacatatatgaagcgtttcaaacttgcaaaattcggacagtggcagccacattaggatttggaaggaagatgcagcattcagagctggtttcattgatactctacaaagggacgttctgtgatgatgtccagcagacacttgcaaatgtgaatctggagcctctgagagaggttagtgattccttcagtggttaatgctgaagggtggtggtgaaggatac

SEQ ID NO: 79800 - DNA, 1026 bp, Homo sapiens
tttccgaaaacactgagcctccagcatttcaggtccagtcaacttcagcagatgtggtgttgggacacgagggtgttcagatgtgtgggggtgtccaagggggaatgattcagagccactgcctcagtttttaaagtaaggattcgtggatagtctttgtccccagtacaaaggcatagcggaaaaccaaagtggaagatggtgtggaggaagaggttcaaaggtgattttgttttttgcatcaggatgatccttgactgtgtctgaggccaaaagtaagtcttgactcccatgaaactccaggaaatggccggcacttgaagagccgtaaagaagcagcccagacctcactctcctgccagcccctacttaaaaccaccccttaggcttcccacacagatgagaattgttcagggggactctatgggtcctgttggactcgacgtcaaagtgtcctgagtcctgagcttatgacatttctacaactgcacacagcagcagatagtccctgtcaggcagaataatcggaaacaggctggcttctccgccatgacgctcaccgggctttcagggcaggggctgtcacgaagatatctggggtgtggggcaaaaggaaaaacagttcccccgggacaggagtcttgtcctctctgccgtgtgactcttgacagagggcagagaccctgcatctggagtgtgcctgtgcctctctcacctccatggtcttgctgagccgctaatgcctcagaaggcctggctcactggaaagatgaaaccaggacacagtgttcaggtctcgtttcctgggataaagtgggtactcaggtaagcagaactggataacctaggaacaagttatcaaaggcttacgcatgagaacaggccaagcagacctgcatataatttcatcagtaacaccagcataatcttacttaaagtattgttgatattatttagtttcaaatagaatttaaagggaagaagtatgaaggatagtgacttaaagtacacagaaactgttgtaca

SEQ ID NO: 79801 - DNA, 1032 bp, Homo sapiens
atattaaaaagccaggtataatgaagtgcataggagctaaatagaagcagctttgaataccttcattttatgtagatgttccaagagcttgcccaggcttcctctctctcccttcctctctctcccttcgcctgtcgagtctaaggagacctggcagcctgagatacccttgggtgttcagggagatcttgaaggcaggcgcctttgaggtacgcacctaccaaaaatgtcacatcaccaccggttctgttgtttcacattgaatgtgaaagattcactaaaaggttaatttccagtcttgtcaaatgtagatcattaaaggcatcgccttttcatggtacagctgacaaaagtcaggagccaagagggaaggcagatgcaaaggttgaataggccaaatactgtgagaagccctttggaaaaccacatcaggtatttttatctgtactcagcagaagtagtgattggtgactatttgcggaaggaaactggacgggtgtctgcctttttaaatgttaaaataggccctgtctattctaggaatggttttgataattattttttcattctttgcctttattctagaatagagattgcccatattttaaaaaaatgcttttcatgtttctatttgttttgatttctagaaccatgtttagatgacaaaaacaccagattgaaggatggtccatctggtatctttggctttcataaaagccagtttgaatcacatcatggttgatccaatggctggaaaacacatatttacccaaaatatggttaattccgtacttctgaataatcctgggttttgacttcttcagtttctccccttttttactttcttctgtttgagaggcactgtgaatagtggaaggagcatgggattcagagagttccagataggaattttagtttttccatttaagagcaactgcctttggacaagatgcttaacgtctctgaacctcagcttcttcatctaatggaaggatgccaataaccacctcacaggatttagggtagtgctaa

SEQ ID NO: 79802 - DNA, 1054 bp, Homo sapiens
agggctttttttttttttactttgaacaagcaagggagagggggtagagtgaaaaatgatcattattctgatgattcctctgcttagctgaacagttcacagttctttgataccaagagtcacccacatttaaacccatttctgtaactgcctgctgcagccatgcctgctgtcagatccggttgatggcagttcaaggactcacatgccattaggttggagcagcccaatctggctttagaattgtgattaaatacagttgtaacatctgcacagtgatccacggcatgatgatggtatcactgaaaattaaaaagtgcaaactttggagacttcccagggaattttgcagtttctattgtaagccttttgttttattcagtgggatttcttataatctgaatatggtagtcttatctttctatgcatgtctacatgaattaagtctatctttagcttgcacgttcctggaaggcagggactttaacttttaccactgggtccaaaacagagctgatgatagaagttgttgaaacgttttttttttttgagatgatcaagagatgccctccttaatgtttgctcaataagtatctctgctctgtgtggagcaataagtgagatcctgggaagagacaagtcactttatgttggtggatcgccgagtgtggtccctgaaccagcagcgtcagcatcacctgggaatgtgttagaaatgcatattctttggccctaccctcggcaactctgggggtcaggccctgcgacctctgctttaacacaccttccctggcacatctgacgcatgctcctgtcagagaatcacgggtctgcatccctgcaggtccttgaacccctccacagacatttttcctgcaaagaggagagagatgacctagggtagaagcagggctagagggcggggactaagctttgaggaagtgaaggctggctttgagacagcctcccagctgcctcagcagggtaacaatgtggcagcttctctcctttggatgctttagggctgcctggcagctccaggagccaagtaatt

SEQ ID NO: 79803 - DNA, 1059 bp, Homo sapiens
ctttggggaatttttcacatgaccagggccaaatagttctgactgctcttgtgccatcctgggaatagagcagtgggatgtaaggagtgaaaggggccatggatcagtggttctcaaagtgtggtcctcagacctgcagcatcagcatcaccagggagcatgttagaaatgcagatcctcaggccctggccccaacctactgaattaaaaccttttcaggcgggcccacgagtctgttataacaaggtcttcggatgatgactgtgcatagtgaaatgtgagaagtaccgcttgattcatcatccagccagatctgtccagcccatttttgtgattgtggaaattgagggcaagagtgggcaggtcactttcccaccatgaaacagctagctcagggtaggtgctggccttctgattcccagtccagacctctgctagtcacagtgcccagccaggtatgctgtggggatgtcagtggcctcagaaagagtgacgacttgggactgatgtccccacatgctggggtcacaggacaaaggaaagggtttgtgactttgagctctcttcttaccctgggcaacctctctctctgtttaaaagcctggtgaccctgctgtgaacttcctcttttaaatgaacagctccctagagcatccttggctgagcttagcaacaaggggggagggagtgaggaggggtgggaggaaaatgggctcccccgttatcatgtcagtgcaatcactgggaattatggttgaggattaagagtcacttggggataattcagccaggctggagagggaaacacacacaaatacacacacactcacaacataaacagattgctaaagctcatggcagaaaacaaacagcataggaaagaaaaaaaaaaaaaaaaaggatgggtagaactgaaagggcctgaattttgaataggtggtataggttccagaatgatctgtttcctaaacacttttggtgaagttgtatacacagtgactagagcggagcagctgcttccccggttctgtgcattgctctgtttcagaactcatagca

SEQ ID NO: 79804 - DNA, 1054 bp, Homo sapiens
gaaacaggatgttttcccaagttagcaaggtctctgttcttctgtggaattccctctcacataaaactaaggcaggctttgaggaagggtggccacttatcttggacttttttctacagtagggggatttactcatattcactgggagctttttattatctctaagagaaactggaaaagcccagttaacagaaaattcattccttttgttatgcttgaggtgctgattcatttatcttgaaagaaactttgcatgtgttgtatggctcctggtatgtcagaagtgggttttgtgttacttcagggggtctgttttacactcccaatggttctgggggcacatgtagcaaacagagctggtgttgggtgtagacactggggcagatgtttaggaggctaccgttttgaacagtgtcaatcgtatttgtgattcacagtctccctagcagtgtttctcacctgcatggtgatgacatgggtgattgggagattttagaggtttggctgtgcttttcagttcctcttttaaatggcttcttccatcattattcagtgatgatggaggagactttagatagaattttttaaagaaaatggaagaccttttcttgctgtacagaatgagtgtttttcttccctggtggcttcgttgttagtttactagtttactagcccattttgctctcagacccagccatgcctcccttcaccttcgtattaatcctctgaggttctgtttactgatgaggacatgaggtttatgggatttggcaagttacttgaggttacactacctgtaggtgatagagccagaatttgaatcaagatctgcctacctctctgctaagcccacagtctttccagtctctacagctgtatgtctcctgtcgccccatcccccaccgctttttgcttctttagtaccaaactacatgtgcattctggaacaaatcatcccgtttcttgcagctgtggctttgtgcagtttttcttgcatgaacaacacatgcacacacacttagaggcaaacacaaacacagagacacacacatgc

SEQ ID NO: 79805 - DNA, 1013 bp, Homo sapiens
ttgtaacagataatcttgtggactattttgttaagaaaaataaagatttatggtattaaaatatgtatgcatgtctaaaatagcttccagtgctatctggctgtctttgcctgaattttactatgtctgtaagtgagattcagcattttcttttggactgtgaattgtcgctactaaatgagcttatcagtctctgggaaggaacaaaatgtcattggatttgccccatgctgcactgcttgtgaacttataccagagcacactggataaagcatgtacccgattccgagaaggctgcagctctataagggacagtagtgtacacagccattccccaaagccacctagaagaaacttcaggagccttcacacctggctctgcctcacactcccccaatgtgggtgtgggcctggtaaggtgctgtccgcatggggtcttgccttcctcatctgcaaagcctcagctctgggattcaccaagaagagccaatctcctgctcctctcacttcttccacttgcagacaagcttttggactctgccctttggcttgtgattcataattccaaaccccctatcaatgatcaaataagcagcaggaagtagcagtccagatccttcaggggccatctcatcattctgaggaccaggcctttagtagaaaagatgggccagtttggaagttgtcctgacttttagaaagtagtttgtgtcccaaggggcccctgggtgtttgttcagggcctgtatgggctgcctcaaaaggccaggaggtgatggaaaatcatggaccttggggtcctccagtccccagcactccacctcgaacaagcatccttatttgtaatctgatttgcctataggattctgcataagattttgcttaagcaaagggttctgctgctttttaaaaagtgctcaaaacctctagtttatatacttttagattttgtgtccttgcacaacctcattctccataagattggagaaagcatttgtcaccagggcccagcc

SEQ ID NO: 79806 - DNA, 1100 bp, Homo sapiens
accaagttttttaaagctaaaacttacctgagcattaaatgagtttggaagtgcctgctagctgaggggtaaagctgaaatttcagccgtttgtcactcactgcagagtttgcttgggtttgggggagagggatgagatgacattggataggcaaagcagtgacatcagtctcctggtgtttaaaaaaaaagtctctccagttccctctgtggtgagccaaattttcagtttcacagttaagtctaaacttaaagctttgttggctgaaataagaactttgcggagtgacatttctgttttcagggcttctgttgagaccatattgctggcgtaggaatttagcttcatgggacaggaaacagttataggctgtagtgagtaatgttcccctatttcagatggaaaaacattgaaaatcatgattttggccctcaaagaacagctattcgtggctgtcatggttaactctgtctctgactttgccttggcaacgaaggtcaatttaccacgataacaaggacgttgattttatggcacttgacatcttaaaaggtgctgaagtgcttcacaaactggtaagcagaccaaaccaaatgtgccttcttctgagcagtaatctcaagaaaaggtgaggatgtatatatccgcatgtgtgcacacgtgcgtgtgtgtgtgcatgtgtgtgtgtagaattttaaaaaaacaggctcaggaacttcctagctagacattttagggccctgtctgcaaaatgtggacttgggaataaccgcaggcactggaggcacctggtttacgaagagctgtatcattccagcctttttgttttcctcaagagaacctgacctagggccacaggagttactttgtcatttcccaccatattgtcctgctgagccaaagaatgttctttgtggaggtaaagaagctcccatatgatttttatgttccctgctgtcctcagaatcaaagttcaggtcctaagcctgggaatcagggcctccatctatgtcttggcccccacctactgttctggtcttacttcctgcatctctggaggcagttagtcctgagttcgaaacatctttacaaatcactt

SEQ ID NO: 79807 - DNA, 1008 bp, Homo sapiens
tattttaattcatgacactagttattattttgtaaagggttaagggcactcgtagaagggagtgggcccaaggcaggcacgtggtgccacggccagtgtctcttcttgggtcccatgtaaatgagcgtgcaggaccaggttggttgctctcattcctggggccatcgtgtgctgattgactttgcttagcacttgactcttgtctcaggatgcattgccaatatttggttgtgttctgagacactagatcctttgtgatctgcttttactcccctggaggaaattcaggagttatttccccttccctgacagatatcacagcattcatatgtgtccctggcagttggaaccagagaaagaacatttcaacccttccgtaaagctggaaaaaccatgggaatatatgtgacaacatcgattgcacaccccaggatttctctctccccgtatccctgagttatctaacgtaatcaacagcgtcataggtctgtgctcatggtatctgtaattatattcatttgtgtggatgcccagggaattccagtgactggccctgtaagtggttaactgcaaacaggagcctgctggaattacagcatcatttgagatcctgcacatttcatgtgactgattttaagtttatatactgtttagattttttttttctttctgtatttgcagtttaaaaaataaaggtaagctaataattctccggtcaatttgctgtttttttctagtgctttaaaagtatacccttgcagaaacacactcacacacagacacacacacacacacacacgtgtgcatacacacacacagcaattatgatatagggaaaatatacaaatcattccaacttaagtagaaatgataaataagctgactcttgaaattatgtttcagtgtgaaaccaaaagcattttccctccctttctccttcccttgtttttttcctccagatttaaaatcctatgggtaagcctcttctactggactgcataattaggt

SEQ ID NO: 79808 - DNA, 1043 bp, Homo sapiens
gtaccaacatatttattagacaatccaccattttcccacatctgaaatgtcaactttattatataacaaatgtttctatgtgcattatgtttatttctgaactattttttccctcagaagattgttggtttgctaataacaaactgttctaattccttagctttactgtatgtcttaatagccaatagagttaataaccttatatttcagaattttactggcaatgctcacaggttaatttctcaggtgcaatttagaattaacattccaagtttcaaaatactcttattgacatttttattggattcacattaaatttaggggagaatacatctttacaatgagtctttccatctaagtacaaagtctgtctttccattattttgccagcttttacatctctctgtaggatttaaaatttttttcttgtgaattctatacttttctaaatttatttttttaaatatatgcccattttgctcttaaaaatgatacctttcttctgtatatttaattggcttttgtttatataagctatttatgtgtactagctttataagcatctgccttctctcctaatgtatccatccattttcagttgatcctctttggcgttctaggtacatatatgtataatctgcaaaaataataattttgtctctttctaatttttattattcatgactttctcctcattgcactagtactaattagaaagtgtaaaattatagggtattggcaatgaccattcttgtcttaataggaatgcctcttagggtatcatttagtatgatttaggcttttgagctgatgcatgtgtatctatatctctctttcccatatcaaaaaatattcatggatttctattttattaagggcctattaaatcagaatggattttgattttgtcgaatgcttttttagcacccgtgaagatgattataggatctttctgctataatgtattgatattatgaatgacagaggtaaaagttctgttcttgaatgatcctggtatccctttaataagctctatttggtgg

SEQ ID NO: 79809 - DNA, 1007 bp, Homo sapiens
tctctggcgccatctctccaggtctctggggaaggtaatggagagttgctgagaagacttgatggaactggctcttccaggagctattttatgactcatgtactgtaggggtgccggcctgtgggggcagaaaggaaactgcttgtttcttcttttctgattaaaagaaacaactcaaggaaccgactatctcaggcagcctccttttccacactattggaccatttgcaaaaattataacacaaacaaaaaatctagaatcatactaaaatggcaacaggaacagattttaacatatcttaatacatatcttcaaacttttccccccttgttttcctctcttttcctctgctttatgctcttaaaaaaaagaaagagaagtgacaaggaactggcttctcacccagtaaagagtaggaacagtcctttggcttttgagcagatcatgagattttttttttcttctgcaaaatttcagggactatcttccagaaaagtcatgtgcaaggagagtgaatggttacagctggattaacacccagcctgttgggttctgagacgtcaacggtgtcttctctgtataatcccgttttccagaacacaaagtccagagtgcccgtgtgtgcattcctgccttggctgggttgaaacgcggggtctccttccacctggagtgtggcaaggagaaagctgtggttctgaggtatctgaatccttggatctgggcctggtgattcaccagctttgctgtttgtaaacacatcatcagcctttgtcaagtttcttctgtggttgggtaattaatgttattggaggaaactattattttttttcccctcacagctgaagatgagacagaatttgtcaggcatcatagacaagtgtattattttgcttaatctttcccattgatcggtctctgttgcctgatagcccaaggaatcttccaaagatcttcccatggctgcggccacaactccccaaacagctagggcgtatttaaaaag

SEQ ID NO: 79810 - DNA, 1210 bp, Homo sapiens
tccttcaaaaaggctgataaatgggactcttgatataggctaagtaaccccctttcattctgtgtaggaggatctatgagagctgattattttccagttaacaaagggtaggaagttgttcttaaatcagagtctgatttgtctagttatgtctatctatttatatctacctatgtctagctgtatatttatatatgttacaccatgcttgcgatttattgaggtctagtcgtaaaatgactaagattgaatctgagaaaagatcctaccacatcatgaatgtgtacttcccttgatatcctctgtccttggttaaaggtgcagatgtgaatgcaatattcccaatgtacttttccttgcggacctccccacttcatccttgccttcatcctttaaatgccatagaacgtgcttcagaatgactcactcctgaagaggaacagagccattttattctccaaagtgcacagtctttcatcaaatattgtttcagctgacacgacagctcccgcaacaatccagaccaggaacagtttctgagcctctttgggtctctattaccacatctgcgaactgagggaaataatagtacttacctcgggggagcggatgagcagtaaataagtggacacttgtaaagaatctagaagagtgggtggcatatagcaagtgctcaaaaattgtttattcaataaaggcaaaggttggcagccacctaggaagtaatgagctatgtagccatttagacataaaataggttaaacatcatatgcctttgaccaacattagccagcttggaggaggaatgaaaagttcatatccaattaatgctgcagatttcccagcccccgccagttctagaaagttgagaacccacaacttgcaaagacatcctggctgatctccagttgagatgacacttccagagaggagaaggctgtcaggtcttcgtttaagccaagtcagatcagcacatatttgcccgctgtctggaggagtggaaaactccacactgtcacttcgagcactccagggatcacatctgtcaggatggaattgctcatcccacactctgtggacaaggacttggcgtccaagtctgacatgtgaccaacactccatttgggatagtggtcacagcaaacccttctgaaagggaatttggtaagttttccgacaagtcagtgtgcagctggggttgggctttggc

SEQ ID NO: 79811 - DNA, 1270 bp, Homo sapiens
gtttcatgcttaacatttgcagaattctgtttttcgagagatttttatatttgtttgaaattctaataagaataaacatatttactgaatattaaagctcaataagatagctatagtgtgaaatgtggttcaacattaaaacagcaatgctgtgaaaatgtgtaatgtaacatgaacttgtaaattataaaaaagttatccttctcacctcgtagttactttacgtatactactgtaggctatagacctaataagctagtatctataaacagggaaccgctttatgagcatcagtaatggaagcaggtttatgcaactttgctgttattttttgtttgtttgaagtaggtcctgtcagttcttggattagtgcttcgtgccaggaacatgagagcttatgtggagtgttgatttaagtttgtataacattgtcacatcatttcttttattcttctcaacaaccttttgatgtaggtgtttatttgcattcctgttttataggtaaggaaactgaggtcacacacctggtgatcgcagagaaggaactggaatgagtcatcttctatcccagggtccactacccaatcgtttgattttcagaactatgtgggaattttcttttatcatctgagtgtacccatcttcagatcctcacaaaatgaaaattctcagtacacatacatatttctagttgagcaaacaaatgcttttcattcacaataggaaactgaacctcacaaaatgaatttggtaatagctaatccctatttatgggcagctgcccaaactggtaaaacatacataatgcacacctcgttgccattgcacattcaaaatgcagtgtgattgccgcaaaggtacattattatccacagtcaatatgtcacctaaatgtatgaatgcaatacagtgtggtattttggaacacgatgttaggtttcctgattggaaatgttcttgaactaaaatatcctccgtgacaagcttttttgtagttataaaaaaagatcagcatctcacaggttacctgatttgctaattacttagaattcagatcaggtatttgtggtgaaattagcatgcaataaccatcagtttttgacaagggtttctgatggaagaaagggattagctgtgggtgacaagctggtaagtaaaaaaaattggaagtacattttcagggttaaattttatctctcaggttaaatgatggcttaatgttttaatgatgttcagcaagggtagatgggtaaataggaaaggcaaagct

SEQ ID NO: 79812 - DNA, 1026 bp, Homo sapiens
tacaagggccaggcacagtggctcacacctgtaatcccagcactttgggaggccgaggtgggcagataacttgagctcaggagttcgggaacagcctggctaacatggcgaaaccctgtctctactaattacaaaattactattttgtaattttgtaaaaatacaaaaattagttgggcatggtggtgcatacctgtagtctcacctagtagggagggtgaggcaagagaatcgcttgaacccagaaggtggaggttgcagtgagccaagatcacgccacggcactccagcctggacaacagagcaagactccgtctcaaaatacatacacacacacacacacacacgcacgcacgcacgcgcgtgtatatatgtgtatatatgtaatgatttacatatatatgtatatgtatgtatatatgtgtatatatgtatgtttttaatatatattatatatatacattacaagttttctacaggaaacaacactcagcatattcctaaatactagtagaactctgggcttttacaactgtttggtggagttttgtctgagcaagtttccagatgttttataggtgcctgaaaaggtaggtgaacatcaggggatatccccaagagcaaatatacagaagcaagaaatgttagaaccatctttgcatctgtgtgaatgtgcaggaaacatgcattgaagtgtggctgtaatacagggactgtgtaggagagtggtgggtggggtgggaccaccttggagggtcctgaatgccacattaaaagatttcggttctacagattatgaaggacctaacccagaggtggtggttgagatgctgtattaaaagtaacaccttaaatgtggcaggggattaagtgagatctaaatttgaaaggttggttttcaacataagtgtggggaaagctccctgatgccaaccttgctggtcctgaattgtggcacactgtcaccacctggtggtcacatagccaaattgtagggctaatggatttagccagagtcctggttgt

SEQ ID NO: 79813 - DNA, 1042 bp, Homo sapiens
actgctgtgatccagttttcctgtatataaagtgggggtaatagtggtacccagctcataggattgagatgaggattacatgagaggatcctcgtacagtgcctagtagaaagaaaatgttcaaaaatgttattaataccaggaaagagagatggaaaaggaaaaataaaataaaatttaaaaaccacaaaaatgttatcaatattaagctgtctcatggaaaaataattatatatgactacaggtaattttgtttggtagcaaaactcaggaaatagtaataacgcaggaggcttgaaggtgaaaaacttgcagaggcttctcaaaggacttgcttggacacagcatctacagcagagagcaaagacatgccttttttttagctcctcccagcccaggatacatgctccttaggggacccttagacttaagctctgcctctgaagtgtgatttaccctggaaatgattctaacggaaaatagtagaaaactgctttccaggagaagaatcaaaggagagtatgtatttactttgggcgattttcccattgtactggttatattgccaagaagttaaaaatagtggtgataagcagtctctgaattggtccctcctgaggtggcaagggtcaactgaaagtaggatcattcctccggggccctgagacctatcccccttgaactctgttttgagagcccctggtggagcatctgtgggctgctgtcctgggatctgcatatactacctgagtttccctcctgtcttatcaattcctcagacttgttcttggcctctgttaagccaaccgattttagatggcctcatcctttaaatatgctatttataaccactaatttatgttttcatgatacttcatgtagcagctggcctttgtgccaccgtaagaaaggaataatgaaatacgtggtatttatatgggtggctatagtgtttgtcatttcgtatatggattgctattgtaggaagcatgaaaaattgcaaagggtatttttttctcttaaagataagctccagtgtatt

SEQ ID NO: 79814 - DNA, 1043 bp, Homo sapiens
agaattgcatgattttttgtttcttcacatagagtatcttttatttttaaaaagaatcttggggtgatggtttattttagagttaaatcaatcaaaatatcaaaaagcttttcctctgatgccttagaagtgttttagtagacacagcactaccagtattttccaatatccttgaaagaaatggctgtgagcattctagataaaattgatatatttatccatatttttctgctcataaaatagaatttgagcactttcagattatattttcaaatatttagggcaatgtatttaaaatgttttaaaaattaactggggaaaaaggatgaaagagttttaatttccttggatccgaataattcaagttgcaagcttctgtattcaattttccttgccttctgttggttggtttgggatttttcttggcctgggattgaatattttgtatcactttaggaaagtcaggatgtagctagctttcaaagtaataactcagatttatagttgaatggatttagaatcaaaggattttgaaaaacatacattaggttctttgctcttttttagaatccgagtattttaaacacactttccagtgtaacacttggagtcttttttaatgctaagaataagaaaatggaaggaaggtttttatctgcctcccttcctcatttcttcccctttggccttctttccttctttttctcctttcttttttctttttctttttttttttgttgagatggagtcttgctctgttgcccagggtggagtgcagtggtgcaatctcggctcactgcagcctccgcttcctgagttcaagggattctcctggctcagcctcccgagcagctgagattacaggcacatgccaccacacttggctaattttttgtatttttagtagagacgagatctcaccatcttgatcaggctggtctcgaacttctgacctcaagagatctgcctgcctcagcctcccaaagggctcgggttatacgggattataggcgtgagcaactgcaccggcctccggttccttt

SEQ ID NO: 79815 - DNA, 1026 bp, Homo sapiens
agacagggtttcaacaagttggccaggctcgtctcaaactcctgacctcatgatcctcctgcctctgcctcccaaagtgctgggattacaggcatgagccaccgcgcccggcctgtgttacagattttaagtaaaaataagaaatatgtgatggcttgttcctactcttggcttgcaccccatgtgcattttctttcttctctgggaacttggaagggcacaagttcaaatgtctctgaaaggcattcagtttaccttctgctctagaacttgaagcaatttcattagtgctatcgttgattcacgttggacttcgtgcgcttcccacgggccattcgttatcagtcttggccctgctgcaagagagagtgaagggcatctagaggtgccattggtaaaagcatactccccagggctataggaaattactgtggagctgcttccaactacagcaattcttgaaaaaggggccgcgttaagagcaacaacccttcctacgtgcccctggagccatccgctaaggttagtgtctcaaggtggcatatggtggaaatgcattaagctgggactggtgacacttgacactgtcactattcgtgtgaccttgagaaaatgattgagcctctctgggtctcaatttccacaactgtaaaattacagaattgttaggatattgcatatgtaaagcaattaacatgatgtttcttcataagcaaatggagctgctattattattattggtattggtcatagctcttttgagttcaaatgagaaaaacagactcaaactatcttaagtaaagatgagaattaatgggctcatataactagaaagtttaaggaggagatcaaacttcaggaagggctggatccagggagtcaaagtgttcctgtgttggcttttctctattcacaggcagttcctctacagcaagagacctaagggaaaaagtctaactttttctataatgaatccttaaaaaaatactcactagcttaggctggttcatgtgacacctccttctc

SEQ ID NO: 79816 - DNA, 1099 bp, Homo sapiens
gggcaccctgcaaaacaaggtcttggagaagggtccttgagacagactcttgcttcacctgtcccaggcctttctcaccctccacccttcacccaggtgtatcccagtccccgacagcacggcacagctcgttctgtgttgttatttctgttttacaagcctggggaatcctgaaattcctcagtcaggtatatgccattgtcagcctgttatcagtttcctgatttactgtgtaagcagttttgataatccttgtcatatgtgattacatttcccccccttcccataacatctcagtgtaattggtttgataaactagacctcagtccagtagtttgcttgcaatatattttcaccttctatctgtgtgactaagatggttttgaatggctttgcatggagaaaatcaggctttgagcaccaggtccttagtttcggaaacaaatcacccagggcaggcagcacaggtctgggagagctgggaatcccagttaagcctcaggagtcaaaacgggatttttctttctttccctgcttgggccgagagtagtgtgtgtttctttgtgtgggttttttgggatacagagaatatttatcttgtacatctgtatctgattcctggggccattggactaacttcttgtccataaaaaattggattcgttcgtgtattcatttattgaatatctgctttgttccaggagtccatgaggaaaagaagctttatttttttctcatttttttttccctttctttcctgcccctattggcactgctcccgagagcagagaaggaataatcagtatgctttgaaaatgaggcatttttggtaaattaagcatttgggttaatttagggttaaattaaaatgcaaaagctacttggggccatcacttgctaacttttctttgtctgataattcagcacctaacagagttctaaggcttcgcagagaaggcagttttagaattgagatgggaagaatgaataagatttagaaaaggagagatgggctagcaggtggtgagagaagggccttcctgctcctaggagggaagagcctcagcaaaggcaggaaggctggaaagcctgggtaagg

SEQ ID NO: 79817 - DNA, 1051 bp, Homo sapiens
ttgcccaggctggcacatagtgggtactcagtctgttgaaggaatgaaggaaggatgcatttgacactaagcagcctcagtgaaaaaataggtactctctgcaaacattttgaacaaaactcattctccacattgtcaacggcttggcagtggcctttgaccagtaggaggcatctaatgttgcggatgataagtttgctgtcagtcatattgttgttcctttgcaggtaatttgtcttcctggttgcttttaagattttctctttctttggtgttctgcagggtcactatgatatgtttaagcatggatctatttatttattctgctcaagacttgtgcttgttcattgtgaagactcatgttttcctttaattctagaatgttcgtggacacttttgtcttttcttaatctttttttctgaagcttctgttggatatatgagtgatctactcattttatcccgtttcacttcttttatatcttttatctccttttctgtctgtctcatgtttcaggcagtttccttggttctttcagaatggttcactcattctatctactctgctgtttaaactgcctattgaaattcctaaatggtagtttaatatacatgaagtgatgatggttttacatgggaaaacactcatgaaaccatcactcagatcaagacagagaacatttctagctcccctgaaagcccctctgaggcaatatcctcccaaagctagatgcttttctgtcttccatcatcatagattagttttgcctcttattgaatttcacataaatggaaacatgccaaatgtgttcttttgtgtcatgtcctttgtgtaattttaagtgactatgtttgtctgtcctttctagaattttttaaaacttgcctattttttggtcatagtattctgttccttcattatgttttctatatcttcttctttaaaacttcttaaaaatattcagacttgcttgttttatattaatactagtcaattatgtcaagtacttaaggtatactaatttctgttatttgtatcttacgtatagtg

SEQ ID NO: 79818 - DNA, 1033 bp, Homo sapiens
tgcacttccatttgctgagcttctagctaatggagggtagcaagtcagtattctggatgctcctcaaatgattctctcatttaaaacctagctctggaaatgtggttaatctgtagtatgttttgagcctcagctgttcttaggtccatttaacttcctggaatccatccttggctagcacgtcctgtaggatgaaggagaaagtctattccatttgcctttctcatcttcacatgtgtggtaaatatgttttgtaggctttctctattataaatttcagaaaggttgggcccaacaagtagtatgtgtgtgtgtgcatgtgtgtatatatgcatgtgtgtgtgtgtatatatgtatacatatgtgtctatatgcatacatatatatatatacacacacgtatacacagacacatattcttctaactgcatagtgggatgaggcctacgaaagccagcagcttgcctcagttttatttagcatgctaattataaacagtatcagtaatatcttttggaatttaggcgttagactgttcccactggtggaagtgatcctttagagcatcacaccctgcctcttgggtcctgcgaaagctttgcctttgttgaatccatatggtaggattcttgtggagaaagataagccaggccattgtttagtaaacatcagaccctcccgtgtgctgagcctgagatctggcaactgggcagagagggctgctgagggctgtgtgctgccgggctggaggatgagcaaactgcatccaggtgtgatcacatccttatccttttctcccacagctttaaagtggtgaaatttttcttctctccatcgggaaggaaataggaaaaaaatgccatatcttgtttggtggtcggggtgaagggcgggatggtcagcatcctcttttatttgggcctatattatggtattatcatagttgattattgctaggatgatttatgtaggagtctctggctaagttatgagatccttgagaacagggatgtcgtggggttgtccacgtgtt

SEQ ID NO: 79819 - DNA, 1260 bp, Homo sapiens
tgcacaactgtacaaaagtaaagtatttggctgtcttagttagctcaggctgctataacaaaacaccatcaactgggtggcttaaacaacagacatttattttctcacatttctagaggccccaccttctaataccatcacactgaggattagcgctttaacatgtaaattttatggggacacaaacattcatttcataacataggttgatgcctaaagcatactaataatttacagggtggttggtttgtctctaaaaagttaaaattttttagctttgtcatttgtttgtttcaacagagttgtattttcctatgtgtattttatcttaggcatggtcacctctcttcctattcctgtactgtttgaaatcacagtagtgaaacccaaggtaattaaggctggggtatcattgttttaaattagagtgtgtgaatttttttttttttttgtaattcaacaacaagttccttcatattgtgcataattggatcacattttaattttgtggcaaataaagatctattttacatttctattagaaagacaagcccctgtggcgagctctgaattaggatgttggccattagaagtactgaagcagtgaggcttttagagctgattcagcttctgaaaaactcatctgtgaatctttagggtaaggaaagaaccttcaatttaaagcttataaacagccatggattttacctaaaaacaaatactgagaagacaagaaaacgaaaaatataagtactaacgcaagcagagaataaccaaatcatgggttatccagtatgatatataccacaaaaacattctggtcattgaatcaggcacatctgtttgtgaggatattttattatctttatggttaatgccctgagtgtttatgtgaagcaaaataatgaagacaaattgtgaagaatacactggacaagtaaccaggaggcctcggttctgatcccagcccaccattaattatgtaagtggctctgggcaaatggctttcaccctgagacctcaccttctccttagtacagagaggcactgaactacagcttcctgccagctctgatattctataatcctgtgatttttaaaggaaccaccaaagaatatacttctttattcattccaactttaaaaaaattattattgaagcataatttacttaccattacattcacccatcttaagtatacaattcaataatttttagtaaatttatagagttgtacaaccaccaccacagtctagttc

SEQ ID NO: 79820 - DNA, 2754 bp, Homo sapiens
tgtaaaaaagtaagaatgggcctggcatggtggctcacgcctgtaatcccagcactttgggaggctgaggtgggtggatcacctgaggtcaggagttcaagaccaccctggccaatatggtgaaaccctttctctactaaaaatacaaaaattagccaggtgtgcacttgtaatcccagctacttgggaggctgaggcaggagaatcacccgaacctgggaggcagaggttgcagggagctgagattgcgccattgcactccagcctgggcgacagagtgagactccgtcccaaaaaataaataagtaaaaataaagtcagaacgtttgtaagcccagagtcaggttttagaccctttgctgtttcgggttgcatttcacttttctctgctttgatggtgctctcccaacatgcctaactgatgattgaagtgttgcagccttttttttttaaaacaaacaaacaaacaaccctttctacacagacagcattgagttgtcctgtctctaaaggcaatctgccccacacttggcagaaccttaagggtgggagaaatggaatgaatagtagctgtggataggtctccttattgccctgggaggaagacttcgtaggagaggaagttgaaagagggtcttgagaaagggggtgagatcttcaaaggctgggtctagccatgggaaactaagtgaaagaatttttttttaagttgatcaggaagagaaaaagaaatgcaccaagtgtttggccaggcggatgctgaccttggttatgactgggtgggattgccattgctgcaagttgatggcacttaacagttttctagggactttcacatacgcagcagcccctggaagtcctggaaggaggttgatgatgttgcagcccatcgagggaccagaaaaatgttgtgtaattatgaagacctgttgccttaaaacaattcggatccaaataggctgactttatcttcaactcaagtagtgtggcgggagggggctctgccctgttggaaaggcatccctctgccctctgtggccatcactgagctccctgttgttttcggtgagctctgactagatgttttccctgtcaatatttcactaatgtgtcatatgaattatttgtgttatctctgtgctgtgaaattagaggccttcacccacagtgtggtaagtagattaaaaggaaagcctgttttttatggtgtgggcgaaactgggaaaatatcagggaaatattttgtgtgtgtttgatctgacagtgggaaggccttgggatgccagtgtcttctaaaacctgaaagctgagctccggctggagttttcttcaaaggggtttatattttatctgttggcacttctgagcggaaggaaggtttggaatgggagattctgtgatgatcctttttttttttttttttttgctgttgttttcttctctgtctttttaactttgcagaaagcccttccagttatacactcagaccctgttcaggacgttggtggccaaacagtccccttttgttaagcgagcgtcccatttttgtttctcttgaaaggtgccctccaggacagcagagcctttctttgggctgtttataattgagccctgaagaaaaacagaaatcattctaaacccaggccaagtgcctccttggcctagctaggcaaagctaaactcacacaagatgaaatctaaccagctggttacctgagaaccaccttcgggagttctccggcttgactgctttcgccttggccaccatctcgagctccagcgacagctgagggtcagggcctctctgtgcagaagagtaggaagagaatcatagctgttggtgaaggttaggttgcattgtttgaaagggtcctatgtcagcttgcaaaatgctatggatctgtaagaatcctgaaagaaatgggttggagaagaaatttatgaccgtaagtctagttgtctttgagtggtgcaatttagccaggaatttttcctctttgcggctcaaggtttcaaaaagttcccttttaaaaaatgcgtgtgtatctatttttttcttagtttacataaaagggtattcatagctttagcccaccttgacatacttctgtcctttctctttttgcctttttctttacacaaattaggagtcatttgagaaaatgaggcatatataggatttgataagttagaggttgtgcagtttcgaattattttattttattctgttataataggtatgggggtaaccttcaggaatcgaaatggaatcttttttccctgttctcaaattatctagtttaggtcttagactcgccttattgcctataagtacagccttcagttttggaatttttctttccattttaggtatcagctgggtcatttagatggaataggaaacagtactgggcattgtcagagaaagactggctataaaagttctgatccctgtgggcagtttggagtcttcttaagtgtaagatcatcagtatacttcaattctgagcttctgcacatgctggttagtgaagctctgcccttccttgttaactgcacattttaacatctatgtttctagaggagacacctgcctcttgagggaaccctcagcatcccgggagcatctgtccaactggcccctgtacacacagagacctgaaaagtgaagcagtttcgagacaggcatcactttaaggctgaagtacattttagaaagttagggactggttctgtggcggggaagttgagcta

SEQ ID NO: 79821 - DNA, 1074 bp, Homo sapiens
ggatttaaggctgtaccttgtctagagatgctcaggatcaagtctgtgaatggaatattatgtagccattaaaaatcatgttgcactagaaaagtatttcttatcaagaaaaagtgtctatcagccattgctaagtgaaaagtaacagctttcatagcagtgtgcatggaatgccatcttttttgtagaaggaaattgtgtgtgtgtgtgtgtgtgtgtgtgtgtgtgtgtgagttatattagtaaattaacttggacccacgaataccaaaatgatgaaatgataaagtggtcatctgtggatgctgggattacctgtgagtttctttttctttgtgcttttctgtattttttgaagttcttacattatgtatatgttacttttgtaattagaaaaaataaatcattttttcttccacaaaagactgtgtgttgtgaaacttgggatcctttgaaggaactgattctgaacttagtatgttacacagaacatctcagtgtttcaggatgggtcaagtttaccgggccaaagagaaataccacttgacaggcacatttagccggtaaaacaagggtcattcagcttgaatattacaggtcctaacactggaaccgcttgcctctcagggcgatatctttgagacattaataccgtgatccacaatgagaaaaacatattaattacattgtgaactagtacacacacacacacacacacacacacacacacaaacatttcatgtaaaatatttacccttcacttgtgatgcgtgattgtgtttgctctattatttaaaatacagattacgagccaccacattggtttcatgatctatttatgagccactcctcactatttgaaaaccttgtcctgggcatgaagtagaagcagcctttctgggggaccatggcccagcagtgggggaggaaggaagtgtttccacagtaactgatgttaagctccaggtgttactcattatgacttcagggaggaggagggggagggaaaataatgtaaatacttattatttataatcatacagtatctttatgccacttttagcacatgctcat

SEQ ID NO: 79822 - DNA, 2906 bp, Homo sapiens
ttactgtattatgataacataagttttctcccatctaatggtagacagaaactccaggtagtcctaactcttacatagatatattgaaggggtatctttggcatgaggctcttaaatcctgaaagttaggaaactctagggttagaaggaataattccaagaatgtcaacaaagaacatttcgattgccccaaaggaaaccctctttccaagcacaggttgttttcactggacgaatatggaaagcatccctggaaccacaccatcagaagctgactttctcagggatgtcccacttgacttaatgatatagtctgcagttgtcttgtgattatctttgatattgtagtgttggaaattcagcttgggagtcctgatgttcttttgtgacagcccagttattattatttctctcttgattttggagcaaagacatcaaggagattgtctaaagaaatccttagaagagaggaatggggcatgatgaggaataaatgtaccatagctcacagtttagtcaggccggctttttgcgccagctcttacatgctaatgctaaaaggaattataggtaacaattcccctgtgttggtgcaagaacaatttttttttcctaacatatttgtatggccttaactgacacgtcattattacagactgtcttatcacattacatagtatggcacattaacagtggcatggcgctgtggtttcctggtgatggttttgtccgcagaactggggccctggtggtcagctagggagccctgtacagcacccactgacagctgagagtacaggtttcacacacccttgtaggtggtggaggactccaggctgccccaggtagagcttctataccatagatgttttctctgaaactctgtgtcagaggatggaaatgagtaggaaatattatggtacagaggatttataatctcctagcctagaatcatcttaacaatgttattgggtgttttaattttgattatgaactatttttttagtttttttttttttttcttaaagagatgggctcaaggga[450 bp omitted]gccacgagaataaaaattatagaatataaaatcgtctgacttttttgtataagcaaagaatgctaccaagaataaacaggcaagaatagaggtgaaatagaatgagggggaaatgagggaccatcgtttgaatctactatgaagtatggtaatcactgttttaagaattccagactattaactactgtgcagttaggaagggaattagttgtagccaaacaaaagccataaatatgaattttaggttgtacggaagaaatcctcttgatcccaaaacataaatgcatgtactgagaagccaagctgcacatggtgtaattttttctgtcttatcctgattaattgacagtcaactgtatgcttctttcctgaaggtgactttacaatctctagacccagacatttctctctgaagtggagtgaaggaaggagaaccagaagctaaagtgtgtttcactgggtgaagtattttgggggaaagataagaaggatgaaataggggaatggactagtgcctgcagagattaacaatgcctgtttggggctggggagtgggggctgtggatgaaggcagggagcctctagagggaaaagagacttctgtgcaaaggaaaatgacattagcattgactctgaaatggctgggaatgtgactttctaattttaaattatctttaacaagggcaatgaaaagaggaaaagttgacactttgagaagttatgacgaacttgtcgagaatgccaattgacaaaggcaggtaagggagtacttggaaaaacagcaagaataggtctgaagggcacggtgagctgctttcctagggtgtaaagggaattggcagccgtgtttattgactcttccaattaattttaaagaaacctgaagaaatggacaaagacagagaaaaggcaaccagatgtgattccgcccttccagaagcaaagaggcttatttcatcccatatgatcgatgccagtcatggggaggagtggctgtgtggaaattaatggattttcaacatccaatcacagaggacacacatgtatatttagcaagtctaaaacctcttaaataaactgcattgcttttcattttcactttccagttataaaaccagtggatgatgaaaaggccatgtgacaatacagcatgtactctcaggaatgtttgtgtgacggggatattatatctgaagggacagggcaactgggagggtgaactgctcataactctcaattgtccaggtaatgaagcattgggaaagcaaaggcaaatgaaataacctgatcatcaaaaaatgattcctcttttagtgctcttattagttgactgatgatgacaagtgtgaaattgccagagttgtattttaccatttctggcactcatcacgtgctttggatgagcacatgtg

SEQ ID NO: 79823 - DNA, 1763 bp, Homo sapiens
gcgggaggagtgagcgacctgggaagtcccgggggtggagagggggcgctccggggtctgggggcgacgtggacaccttctttggagcacggcggtgcgtttgggatttgaaggaagggccgaaggaagcggggtgcgggcgggcgagctgttcgccaagttgtctggcgggcgcggcgaggggagatgcgcaagtttgcagaccgggggttcggagcccggcgcccaggctggcggggggcgtgtgcgcgccaacgcgcagagggcggcggtcctgtggggcgctccacgcgcatccggagggagcgtctacaaaagcaagcaccgaaacttatttctgctctgggaatccttccctctcggaggttccaagcatttctgcaggaacctggggatggtcagtgcaagttgtatgctggttggatagtgcaagcaatgttttctcctcccctggcgatttttactcttcattttggtgtttggtctgtgtctgcgtgtgttgggggggatgggggggactcagttgctccctcctttcctaaagtgagctgttgaggaaagctcactctttcttgaaggtattggaacctgatgtgtgtttttctcgagagtgggggattatttatttgaatgcgcctggagtttgcaaagaacaggaggaagctacagctttaattactgttgtaaataatgtataaatcgcgcctgtcactccggaggaagcgtgctcgcgcgagccgcctggagctggggacggagaggatttctccagccccggcttgggtaccggcccagcgcgccccctcctcttgcactcggcttctggcggcggttggggagggctgggtagaggcgaatgggggccccaggaactgctcccttcctctcgatgttgtagttggaggtaggaatatggctgatcatgtgctggctgttttacagtatccccccccccaccttagccacaccccctgtccaggcgctttcccattcacggaattcgagtacagtaaaagccatcaggatgacacacgcgaaaaacatttaattaaaggcgatttccaaagggtgaccgcggcgaaccgcggtttcagcgggaggggggcggcgagggctgggacaaaagggaaggggatgagggctgggggcctggacctgccgctagctcggtgagtttgtgtgcggggagcttttggctgcaaagagtatatttagaccctgagacggtggatttggaatgcgagcgggttatgtaacagggttaatcagaaacactggagaaaatccccttcatgtgtttctggggctttttttttttttttggaatgggggggacatagtatttaggaagctgcactaatttttggtttgtgctgccacctttctccttcttgacccccccacaccctgtgttattaacatcttcaggtgtcattcttgccagaaggtgttcttgcaagcgatcagggtggcaggctgcagagccgactagcaaatccgtaacttgctgttcttgcaaattatgtaacgccggagcattcagtgccaccagcccccttaggctcagcaaaaaggggagaggggcatagtaggagtgggatacatcttgcacagctgacctgctgacccatatccccttccccccaccctctgcccccaccccaactcattctttgaaccagcccctgtctgtccctcctggaagatttaatgggaggggggtggtaaggcccaaacactcaactcacatcctgcacgcaggc

SEQ ID NO: 79824 - DNA, 1101 bp, Homo sapiens
aacatgctgtgaatatttttctagcttcatgtaccaatatgtagaattgtgcttttatttctaattaattttttcctaacactattattataattagctaatatgcagtattgtaaatactacttaaatgcataacttcccaaatctagagcctggtttccttttcagaatcatatcaaaaagttggaaggagagacttaccgataccactgtgctattcctggaagcaagaagacaatccttatggttacaaataggtactgacttgaagtgacatttttccaaatagtacttagttgcataggtcacaagaattttgaaggctaaaatggcagaagagttggaaaattgtacttaaaattctccaaagtgaatggcaaaatgttcattttcatagaatcacaatacagatctaaataggtcctttgagattttcttttccgacctcctcatctgaaagatgctgaaactgagactcagtgtggcttagggacttatccaagttacacaaccactgagagaatgtagactaggctttatacctgtaatagtgataccctttttcatgaattacaagtccagttatggaggattaattcatgaatcacttttgttactaagttttattttgagtgattagcataccccttttaaagggtggcattacttctatatgtttatctcagcttttcctaagcatttggttgtggtagatttttccaaatagaagaacttatagtaaactaccaagcttattttcctgggatctatcctagataataaaattatcccaaaatgacaattatatattaataattttcagaactttcttagtgttgagctttataagagtaaggcaaagttcttacagtggcaaaatctgcattagattcctcatgactgcatttaaatttgtttgaatgggaataaagaaaagctgaatgacaggataagagaggttaaccagtcatgtcagaatcctcatgtaagagaggattctccagtcatgtgatttgctcattagttaagagttaaaaatattcacaaaacaatctaaaaagcagattttatgactttgacaagtaatcacttattttttat

SEQ ID NO: 79825 - DNA, 1819 bp, Homo sapiens
aaaataataaattgaatgttttatgtttaaccactttaaagaagaaagactgacatccaaaaaccagcgtgtgctagatatacaaaggaaattacttctgtccttaagggaccaagtataacaaaacatgtaactgttaaaagtagctgacaaacctttcttgtgcctagataatttagcattggcaaaaatgtcaccacatgcagttttctaggagagtcaagcacaaataactaattcaagatgctgacttaaatcatctccaatagttacccttcctgagattctaaagtaacaatttttaattttactggttatattgctgttttactgagacttacttttaagaacccctgtaacttaagattttttcttaattgttttgtttagctctgttattaattttttccttgtgatatctttttataactctctgtcaaaaagcacaaaacttcaagaaacttttaattattttgtctgaacatataatcttgtctgatttcttagtttttattaagatatcagacaacttttaaaactttagtgcattattataattactggaagaaaaagaatgattatacactaatgagaggacttggtagtttttgtcgtggatgtcaagtgtgggcatggataattgaaatatttaggctatttcattctttgcccatcttgctgtgatcagttagttgggtaaaaatatttattgattatttagactgtactggatatacaaaagaagccttctgtccttaagggaccgagtaaaacaaaacatggaaatattaaagagtattagagtataaaagtatatctttttagccctttgtaatatggccaaattctaaataatttatttggggatcttttgatcctcatgttcctttttctcctaagtactactttgtattctttaatatgcagctttgagagttactgaatcatatattatatttccatgagatgtactattctacttatcctctaatcttcatatatatatacacacacacatatatatacacatacatatatacacacgtacatatatgtacacatacagatatacatacacacaaacacatatatacacacatacatatacacacatatatatacacatacaaatatacacatatatacacatacatatatatacacacatacaaatatacccatatgtacacatacatatatacacatacatatatacacacacatatacacacatatatacgcaaacatacacatatttacacatacatatatacatacattatatgtatgtatatatagtcatttaatactcattttggttcacatacttatgatcatgcaacgtttaaaacagcatttcttgctttttagttttagttatatttttccatgttcttagaaatgcctcattaacatttttaattcttgtattgccatctattgaggtgacattacattgtgtttttatctcgtcttaattcatgacattaaattattctactaacagtaataatgctgtaataaacatcattatagattttgcttttttatatcttgtttgctttttcatatttccttagaatttacttgaaaaaattgaattactgggtaaagggcttttgcaaagtattgttaaattcctcgagttgcatttttggaaaggggacgtgaatattttatcaactaatttggtctccctgctgccattagtgactgaatatcttaatctgaatctcagagtgtagtgggtttttagtagtgctgaagacaagttttctaaagtgtattatggtgataaattatattttaaaaactgtca

SEQ ID NO: 79826 - DNA, 1085 bp, Homo sapiens
acaggaataaatgtttcctaaactactacttgatttcatccttaaaaatcaaaacaaactgtggtgttaattgactgtgtgtgaattccattgtcaattttaatgaaattttctttaaaactctcacctccatctgaacttttcatagtagtgggattgactacaaataaaaacttgtggtattcctggtaatactgtccagaaataagagattagtataaaatattaaaggatgcagagaatcagctctcttctgcgtttaatagatgaaagcctttattgagctcagaagcagatactgttactatcatttcgaaaattttatcttatggtgttcatgtgcatttcaggtaaaattgaaaaacaggacaattattatgtccaattaatatgtttatgtttgtgagtcttgatgatggaattacatagctttctgtttcacaaatggctctaaatttgcttaagttacgggactattacctggagcatctgctttaataattgaattgtcagttgctctgagcctgcccttagacctcaagtaataaatagttggcacatgaattttgaggatatgtttcctcttccctctttttcctatttaaccccttggtactgttgctaaataaatgatagccattttataattatgttatatacattttcagcctttagcatttctgcttttcaaaaattgaatctccttgttggttatgcttatttcataattattagttttaattaatgtagatagaagttgaacatgtaattaggcaaattgctgtgtggcacttgaatacatagatttctttattttcaaaaaccaaccttttgcttttaaatccttagagagggtttattatcttagagaaaaaataattataatcattatttttgaaattagtatcctcttaattctcaacataagttatgtttcaatttcttttttttgtaataaatgatggaaatgtttaacaatgtcttatctagcaactttcatgcttctcctcagaaatgaagccaaagtataaacttagatttaatgtgttgtatatttgaagagaatgaaactattaacatataat

SEQ ID NO: 79827 - DNA, 1032 bp, Homo sapiens
agctgaaagccttattatacttttaaaaacttgacagcttgctaacttaccttaattgtcatgttattgttattatctgtattttgactggcagattacttgtgtgccagtttacatgtttttcttcttaaaatgattacgccatttttgtaaagtgtgtcggtttccctcatatgaatgcaatggcatttatatacattgcataaaattagaactctgtttttggatcagactaatttgtattctatcaaaaagcaaagagaatcaaatgtaagtgggttgttctgctataatgtgtggtatcaaataatagctttcactaggactctaatcgaaagactttttttggtttgtttctggactacctggatcctaaatatgtaaatttttcacttttagctttcatttattgaacattatttttcttttagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaagtaagacttctgttagagtacattgagaagcaggtgtaccaaggtcatgtttctagacattaattctctccacttgtgcaatgttagcttaggaaaaggataactttactacttatatttggagaatttggttcatttgtgattatactctttaggaatgcttattgtattcataatgataaggtgtagagtcttgttttttgttttttttgattactcatatctagataatacatggatgtagaataataattgaattttttagtcatatattataaattaaccatattttaaaacataattatatttagagatatgtaatgctagatacatatgcattaaataaattgttattgaattgaaattcaacaatggtattggaacaagtagttatctgggtgaaaaaaaattccctgtagatcatttttaccttacatgtacactactaaatttcagaggaa

SEQ ID NO: 79828 - DNA, 1050 bp, Homo sapiens
cgaatgtggcatttgggactgtaattgctaagtgttaatgcagcagtattaccttgagtgaagctttcactccagtgaaaaagtctcaatctaagaagactttgatcttattaacataatttttaggagatgaaggaacaagatataactgtggcttttcactgaaatcaaagttttaacattgaaaattaaaagatttggtagaaatccttttccattttaaattttttttcttaggtattttatggtcctcattcaggaaatggccttaaaaattgatcaagggtttctaggagctattattgcactgtttaccccaacaacagaccctgaagctgaaagaagacgggtaaaaatttttatttcttggggaaaatataaaattaacaaaatttaaatcagcctcttttgaacgaattctaatagagaaaaaaattaaaatagaaattcttgattttatttttttcagacaaagttaatccaacaagatattgatgctctaaatgcagaattaatggagacttcaatgactgatatgtcaattcttagtttctttgaacatttccatatttctcctgtgaaggtttgttgtaattattattttgaaaatttagtgaaattattgtagaactttttaaagggtctgtggaccaaggtaggttttaatttgttgcatcatgtatttggtgggaattttgtttgattaatcgaaataattaagacagttctctgtagcatatgtgcagccacaattcccacagagaaaccaccagagcatgttctccagttttgaattaataacccccttattcaaagaagaagctgacaaaagcgtttcttaattaagcgtagaagtgcttgccaacgtttaatgttttggttgcactttgtaactactatcactgtctaaacagagagctataatgggtgctgtaaccagaatgtgaaaacgctgaagtaggtactatactgttgatgtggtgtttttccccccttccaaaatttgcttgtaactaagggagtggaaaattggatacctttcacttgcct

SEQ ID NO: 79829 - DNA, 1140 bp, Homo sapiens
ccaggaaagtcttttaccaatagtgagttaattgaattgtgtctgattgcagcagctaaagaaatgtatccagagaaaatgaactcgtttaaggccattagcctttcagtaggaacagttgcttaaagaattgaagacattcagaacaacctcaatagtcaattacaaaaacaaggcaaatgatattgagtggtttcctttggctcttgatgagtcaacagatgttaccaatactgctcagttatatatttgagaagtcagcacggagtctgaagtgactaaaggattaacctgtataaatagtttgcctaggacaactacaggtgagaatattttcaaaccagcgaaagaaatactaattcagtacaacctgaagatagatacaactgattatgggaaaaatatgtgtggaacagaaaaagacttagttggacaaattcataaagctagtgaaaatgtaaagcatttaaagcctattgtattatttgtgagcaggtacttagtggaaaatatttcagtccaccttttgttaccaaaccattagtgtcaaatagttaacttcattaattcatgtggacttaactatcatcagttctgtgaattttcacgagaagtagaagctgaatgttcttacttgtgttaccacacagcagtttgatgggttagcagcagtaactttttattgtactctttgagttctgggccaggattaaaatttttttgaacaaaaagaaccaccctcaaccactatgactaaacaccaataatagtggctttggaaattaatttttgttgcagaattgataatgcaataatagtggctttggaaattagtttttgttgcataattgcagaattgatgatgttttttaatgaatttcaagctaaaattagaagacaaacagtgcttatgtgaaaaatttatactacagtatagtcaattttgaagacagctaatgtttgaatctcaggtagtatcaagatgttccatgtacttcctgtgctgtccaaggttaaaacatgaagcaaaatctccacttccacatgtatttggagaggatatattttaaggcctgcaactccagttccagcaacattttttctgacctcagtgcaggtgtaaggaaatttccacatttc

SEQ ID NO: 79830 - DNA, 1016 bp, Homo sapiens
tatatttataacagatcagagccagtttgctttttagtaagaacttaaggaaacaggccgggtgcagaggctcacgcctgtaatcccagcactttgggaggccgaggcgggctgatcactaggtcaggagttcgagaccagcctggccaatatggtgaaaccccatctctattaaaaagtacaaaaattagctgggcatggtggcacatgcctgtaatcccagctattcggaaggctggggcaggagaattggttgaacctgggagatggaggttgcagtaacccgagatggcgccactgtactccagcctgggtgacagcaagactctgtctcgaaaaaaaccaaagcttttgtgttttacgtaatattgaaattccatatgtaagtgtagattaaaccagtacatcaaacatactttttttttttctacaatagaatgggggtatcttggtggatgtaaacactgccgaacattcaactgtcataactttttctgattaccatgagggatctgcacctgccttgataatgaaccatacaccatgggacatcctcacatacaaacagaggtatgagaaaaaagggttaatgggaaatacttttattggttcatagtaactaatgggaaacactttggtttcatattcaaaatgtttttagattttagaaaggtgatatggaacacatggtatttatctttaatacccttacatgttttgagataacactctgtaaacacattaatatttctgcagcaaaactgatgaatattcacatcaaatgggataaatagaaattattaatagtttcgtatcaattcaggtcaggttttgccgccaaatgagttttgataccaaatttccagaaaaatctttgggcttttagagctttttaaatttcaaaatggcagataagggagtgaacctgtttaagtattccctttcctggtaatctggtaacgctcagtgaacctcttcctataaatctgtatttagtttttttgggtagggatagt

SEQ ID NO: 79831 - DNA, 1045 bp, Homo sapiens
tttttcatgtgtactatcgcaaggacaaaaaaccaaacaccgcatgttctcactcataggtaggaattgaacaatgagaacacatggacacaggaaggggaacatcacactctggggactgttttggggtggggggaggggggagggatagcattaggagatatacctaatgctaagtgaccagttaatgggtgcagcacaccagcatggtacatgtatacatatgtaactaacctgcacattgtgcacatgtaccctaaaacttaaagtataattaaaaaaaaaaaaacaagttggctcctaaagtgtaccgaaatttgaatttcaagtgataatgtggagggctgttatcactacaaatttttatggtcactgataccagagcaaaacctgaatttgtctaagtttaggacattgagtttaatccatccagttgagcaacttggtaaatattcacagtatgctagaatccttattctgtaccaccccttgccagacatttcttaaatcttaaatttgactagtatgaaaatttgaataatatgatgccaattaacctattttattactacttcaaaatttttattttactaatagcagataacaaagcctgtacactaattataaagcaatttatgtttggaattttaaaaagtaaagaatgctagacgtattaaatctgtcattgtaagtcgttagttaaattactaattgatatttcttgaattgtttctgatggagccaaactaaggaactataatttttttctcagaagataatcttttgcagaatgtaacttatagttgctttatttaagaattattattttaaaatattgtaagaagtttgtgtgtgaatgaggggatgtgtatatatttcaaagacattgaataaactggaaaataagcttttttcctttccacaggttggtgttagcatcaaaatgagcagtttcaacctttcacgaatagttaccctgactcccttttgtaccattgcaaacaagtcatcattagaactagaagttggcgagattgcatctgat

SEQ ID NO: 79832 - DNA, 1065 bp, Homo sapiens
caaactaattgggtgggtgaaggtgagattaatacaagggcacaatttgatctcttctataaaactttatctaaatcccagaaccagaagtaaactatttatcctctcacctctatagcattttttgcctcttgtatggttcttatcccattgagtcttgtatcataatttttcgtatgtatttcctaatctctctgtctagttggaagctcatcgaagacaggaactgtgtcctgctgtcttccattctgcctgtcacaatgtctttaatgtagtgtctgctgaacaatgttgaagacataaattctctttatgctaagactttaaaaatttgttagctctatgtcataagtctatcactggaaaacatcgttttgcattataattctttttaaaaacaatacataatctcattggtatctagatttactatactcattgcataggtgaatgagaaagtcagaactttctcattcaaactttctcaggaagtttttgttttgttgttccctagagttttttgtggttctgttacctgtttgcaatatggctttgattatatatttctgtgtcccacggtactaaagaaatttctagtagtccagcaactttctctcaaataaaattattatagtgttttagatttcttatatgacgatatgtgctctctggtataggtacaattaaaaatttcaaccagtgcctggtccagtagtttctcattggatacagtgggaagttatgggtgtgtgaagtgtcctgccaacaatatggagtacctggtaagattctgcttccttatttacctttgattccgttcacctttgctacagttcaacaaacaagttggaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgt

SEQ ID NO: 79833 - DNA, 1522 bp, Homo sapiens
gtagaagtcagtgttgcatgattacttggcttgacacataattttgtgttctctcttgtttttcttggttacgaatttattcaaaatttaaattagttactttaatttaaaattaaaatttaatttaaaaatgtcacttataattaatgtatgtcacttaaaatcatgtatgtatatattctcatctgggaaagaatttattataaatatttttctgctttcttttttaaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtatggccacatcacttaataccttcagagacttcttgaaagtgcgattttggaattaagatatacacttttcttgtttgtgcatggccactatgagtacatatgtgaatagatagtgtgttctgacatttaatttgtcgatgtattgttttttgataattattttttaaagattgatttgctaaataatttatgacaatagagtaagagagtaaaggaaaatacactctatatattgttagatgggttttgaaaatggctaatgatatataacattgattacttaataatttccctattggttacagaaatatgtaattaaagccaaaggactgtcttataattttgtgtgtatctttccaggtgcactattacaatgagatccatgctgtctgggagccactgattgagagagtggaggggaagagacaatggaatttaaggcttgatgtaaggaaatcttaaaatatctttggatagaatgatactatgcatattcattcatagtttttatttcagtgattcttaagatgtggtctaggatccttgaagcccttttaagggctctgtccatgaggtcagaactcttttcatatgtcattttcattctcattctctcacgagtgtatagtggagttttccagagactaatgaaggtgatactgcaacagattgaatgcagaacagaaacgagaatttatctgtcttcccttaaggcaggcagtaaagagatatatgtgtatgttcctcttctcactgtatttttaaaatagttatttttgattaaaaatgttatttatattagcatgtaatttttatttttaaatgaatttttaattttttttcagttttaattgttaatagagtacatattggtagataaaacataaatgaagctctttagtatactcagtgatttttaag

SEQ ID NO: 79834 - DNA, 1045 bp, Homo sapiens
agcacacttgataaacacttgatgatttgagttgtattgaatactttcagactcaaattttcgtaggatgatctttgaagataaattccttcagggaggttttatttcataaataatattaaaaggctgcctttattttgtgtgactacactgatttgttttgttaattgcccaaattcctttccggccattattggtttgtttctttagtattgcattataatgtaatactcaaaaattgcattataatgcaataacatatagaattgcattgtaagtataaaatattcagtaattgcttaataacgtatatcttgctttggagattagtagtcttgtttactaatggataaattagattctagttaatgttgacctgttttctatacagattagaaactgaaaggtgaaataaagattattgaggtatataggaaattcttcatcttttttattgttttagcaagaataaaataatgaatagcatgttttttttcagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaaggttagcagaatttatctgtcatagatgacaacttgtatattttgacaagaattacaaaccagaaaaaagagaaatgaaaaatttaagaacgtaaaattagtcttttatatttaaacatattctatataaaaactttagctttttagttttttaaaacatttttaagagagaggtacagtagatattggaccaatggccaggaaagtccgctggttccaactgtgccatgaacatttctttactgatccagaaatgaagttaatttgggtcagtggttagtggcctgttttataggtgg

SEQ ID NO: 79835 - DNA, 1071 bp, Homo sapiens
ttttaaataatttttctaaaatacaaggtttctttttgatttcttaaacagattatattacatataatttcactcttttttcataatttaaagccattgatgtgaatattatgtttaattagactgtaaataggttaatattttcatggctaaaaagagatgaagtaccccttgcccatatagtaaatggtcctggctgctgtgcttttctaatgctctcataccatcagctgttacttcaaatgacagtaatcggtaaaactaccagttgatataccatatcaacactgcttctcctatagttaggctaggtgtgttttgaaatcacacaaacaaatgactagaacagtgtgcaaggtttctggtttaagtggatagttttaagtattgcataagcttgatgaggtcaacatctccccaggtgaagtttgtgccaccatacagacaaatgctagataaaaaggctgttgttatagttagacaggaactatgtagagatgaataaactattaacaggcaagccttatgtgattaatgatctcactgtgttcagccgtgatcacgatcatgtatctggttcttgctatatggacaccgtgtcacttgggaaaatttgtgaattcaaatggaagctgcaaagatgatgaaaattagaatataaattatttctcagaaaaatagaattttctaacttggagaaggcttacgtggttaaagttacgcagtatttgtttttccagtaacttgtaaaaacagactgttctatagtatgacaaaaaattagagtcagtgttgaaaaagattatagaatcagtccgtaagagtgattgaaagcaagatctattcagtctgtgtgatctatctaaagatgagagaaaagactgacttacttcctgaagtctcatttgtctcaaaattccaaagcacccactcctttcccctgcatcatatgtgaactctgtttgattttgctattgagttatattctgttcttctgataaagaaaatggattgggtaatataggtaattaaagataatgaggctgggtgcagtggctcacacctgtaatc

SEQ ID NO: 79836 - DNA, 1101 bp, Homo sapiens
tatatactgagatgaagagctacgtagcaggagagcatctttttactatttggtagagactagaaactgaacaacactcgtcctgtatttagtttcaaggagagtaaataatatagaagaaggaactggtactggttgagatgagagagagacagaatggagatgggaagatagggaaatgggacagataggcacgggtccaggaacaggaagacatagtaacagataagccatagagagtgttggagtgccagaggcaggggcctggatatgggcgaaggcagaagtgtgtgtgcacacagtaaacaaggtgaaatacttctgttctggtatttatagtcctaactctaactctcttctttttaagtaggtgaacaattaatttgaaaaaccacaaatcgagatatagatatgatagtctacattttttttattacttagagttaacaaattattggtggtttctaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaaggtataaattgatgatatttactttatggagaaaaaattggtgttaatgtcatatttatatttagtatttttctagctgtccagcacaatgtggtatgaactaattcagtattgtactacttactgtggaaattcggctggggctgggaggtatgtctgttctctgctacagggggaagggtcacttgttgttggcatggtgcttgtttaccctttacttgtgaatgctaaatttgctgaattcactaggcactgaagtggcgtatcttgagagaagaatcaagctagataggcagtgtagtaaggtcccaaattaattaagagagaaaaggaccttggtatcacatgtcatactcaggtgattgaaccatgagaaaggaaggtattcttgtaacagctttatttatctggacttattggagcgttatgtttcaaatacataagataatttttcagatcattaatttgaacctattaaaa

SEQ ID NO: 79837 - DNA, 1066 bp, Homo sapiens
aaaaaaaaaaagccttatcagaaataagccggcagaagcttagtttctaagactaaactttattgctgtggcctagcagtacagaattgaacccaattttggagaagtacggtactgcccttctccctttcatttaaatttgaatttaaaataaccaacattcttaataaaaaggagatttttaaaagaactgttgcaaaaatttatcatgagaataaaataattctcaattattttatattttataaaatattttataaaatgaaaaatattttatgaaatgtaagaaagagctctttcttcctacagtaactattgttaatagctcagagtgtatgtttctagacttcactctctacatacacaaaatcataaataacatcttttatattacttttttatttagtttttaaagtaaatgctttttaaagttttttcttttaaaaataaatgccttttttcccctaaatatctgtctcttccaacagaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaaggtataaatatgtaatctaattgtgtattgcttactagaaataggattttcatacaatttttacctaaggtaaaatgttgtagtaatttgtggttttcattccttatttcttctaattatgaaaccttgaccattggcttcttggtcagtggttaaacagtcatgtatgtgcctcatggagtctgtattttcccttactacatatgtaatatgatttttttcattctataaaaattagctattataaaattatagtttactcaatacttagttt

SEQ ID NO: 79838 - DNA, 1196 bp, Homo sapiens
aaactccattctgtttgcaaaacctatcatgtgttatcattccctggttttgctcctttctagtaatgtctccaccgtgtgaggaggtcctttgctctacttgaataatacctcctctaatacatcctttcttgacttctgtataacagtgtcacgctttgttctgtgcttgcagtgcattttatatagagtctattaacatttgttcacttaatgtgactaggtgtggcctgcttgtttgtttgtattttaaatgtatatgtctcttccactaaaccatgagttttccaagggctagcgctgttactaattcgtggattttcattgcctctaccaggtccagaatactcatataagtccacaataaatatttgtggaagaaatttgtgaataaaagtaatgaatttcttttaaacatttcaggtgaaattaaagagccccttgaaatctctatatcacaagatgtacatgattcaaaaaatactttaacaactggagtggaagaaattaggtctgtagacatcattaatatgctgctgaattttgaaattaaagaggtgtgtaattttcatctgtttttgtaaagtgaggtgaataagtaatggatattggaattacctctactaaacttacagataattgatactgatgaaaaaaatctatgtgggctgttcacatgtagcagtgatgttttaaaaattgaaagtttgttaaggatttgggagtttataatatttcatagagaaaatgacagcatgttgtataacatgctttttaatgattttaggacagttggaatgtcacttgctttggatgtcatataagaaatgcaggaaaggacaatagtgtcagataaattcttttcaaatgttagaaactcttgatagaataaaacacaatatgcctgcattttaaaaaaaagttacattactaatatgtttgccatctgcatactcttgaggaaagatgaaatacattttcttctttattcacccatccaacaaatatttattgtatatgcccagtgacaaggatagaggtaaaaggcgtagagtctgaactcatgcaggaaaactgttaacatttttgtaattatttcacgaaaactctgctgaggatactaattggagcttggggtgctgatggtagggagggggcatttaagcaaactgagagggtcataaaagattttccag

SEQ ID NO: 79839 - DNA, 2175 bp, Homo sapiens
ttgaaaaggtcacttagtaacccattcataattgtcctttttatatttaaatttcacggatgccacctttgaagtcatttctagacatagtagtagcacatggtggttctgggatttcgccttttgacttataattttatataatcataattgtccattgaagatccaagaagccgtctgtatgttgaatatcagcatagccatgagaagcagagtatagacttcataaccattatgctttggaaatggagtaattaggttactgtaatattctgatgtacccctgaagtgtataagtgtaatttttctctgtatattccctttttaaggggattgtgaatcttccactttttactcttccttcagagtggtggaaagcaatgatgtaagcccacctgagaatcttttgggtctgtcgtggagactacaggttataattggctgtggaaaactaattttctctttaaaacatttttaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaaggtatgaaacatacatttttgttttttgttagcaagggttttagaattctaaagctaaatgaggaatactagagactatctgactcagtcatttaaataccattttccccttttcttcaaattaaattatatgcgagcacctgatgtataaggcaaatgtaatcaatactgttgtttttaaaaatgtttcttttagttcttattttggtggtggtgtaggaagcccttaggtaggtaatagggggagaagatctgtatttatactgagctcttcctccccgctcagtggctcctgaaggggctttataaagagttagtctttctttccattttacacataaggaaattaaggctcagagacacaaaggtagggaagggttcaggagtagcatctaattggccaagagcccagattttggatcaggaagaactcagttcacatcctgattttgctacttcaaccatgtaaccttagacacattatttaacttttctgaggttcagtgtccttatttatttattgtagttttttctcttgcttttaaattataaaagtaatatctcactattaaaaatgcaaactttacagaatatataaagcaaaaaaagtgtttgaatctttaagagttggagaatgttataattttttttaacataacagtggttcacttaatatagcgaataaaccttaaaagaatgtagatgactagaatctcaccatgtgacagatgctttgttttatttttagcgattgtatcctccagagatagtgacattattgatttcaggctatttgccaagttgaatgctttctgtgtcattgtttgcaacgaaaagaacaatatcgccgaaatcaagattcaaggtaaaagttcacacggcattgaaaattggcgaaaagataaacttttccttctttttgtctctttgcaatgctaaagaatgtacaaataaagggctctaagctgtgaaacctgaaaagacgtaattggattgtatgcttcctctatttgggatatagatattggtcagaatctgaccatcccaattgacctctacacatatcctggtgtttgggaccttcctgagagttatctaggaagtggaaaagggatactgatgtcaatgtaggaatgctattgatgggctaggagaagtgtcagtctagattttaggtgaaggtctgtggacgtgctttctagtaactttttaatcttttttttttaccttcatatgatttttatatataattatgtatttgtctttatttgtctttccttatgaaaagcaatcttataatggtgacaatatctatgagcccattatgttcttttaggtaaaagctgccaaaactcatctagcttttcctctggcttacttttactagcttgttgtgacctggtagaggtcaagaatatgttgaatatgtttaatgaaattttttaagaacttaaaaactagaaaactaggggcttttttcctttgtcctttccaaactggcagcgcatctactagtctgaatttgatttgtgaaa

SEQ ID NO: 79840 - DNA, 1019 bp, Homo sapiens
tttccattatcttctctcttttgattcttttttttcctgatttcctctctgatatttattatttctttcttttacttactttggatttcgtttgcttttcagtcctagtttcttaaggtagaagctgaggtcactgatttgagaccttagtttttttccaatataggcatttagtgctttatatttccctctctacagtgctttactgtaccccagtgtggcatccagcaattaggcatctgtcagcttgagctgttcacagcttagtcaggaagccaaagataaacaacaacagctagaaagagctttatgactagctgccacaaggctattgagacaaataaacctgaggcaattacattgagtagggaaacagaatagaagcacctgccaaaaagtaagcaactgataaaagcacagtggtgattcgtagtgagtaaaacagatgtcctcatggagctgacattttaatcagaggagacataaacaaatataaatgtgatatgtcaggtgctgccaagtgctatatatagaaagaaataaagcaaggcaatgggatagaaagtgatgaggttaaatactctttgatgtttataataagaatctttgataccaggaagtagtgttttggttttgaaaggtagagaattgtgtttggaaagattttcctaaaaattagttaagttaaagagatttggctacttaagagggatatgttgaaattatctgaaaacttagctaacatagaacttcccatttcctgacaatgttgtctaaatgaggcattagtgtaattagattaaaacatgtcaaaagtttaggcatgttttaatctaattacattaatgcaattctttccctcgtttgtaatgtagagatgctgacttaaaaccactgaattgtatttttagatttaaagtgtcaggaggacttcctttgatgcatgtgagaatttctgaccagaagatgaaagatgtgctatatttgatgaacagtatacctttgccacagaaatcatc

SEQ ID NO: 79841 - DNA, 1071 bp, Homo sapiens
ctatatgcagttttcaccttacatgctgaattgagaatctaatttgtgagaaaaagtaatactcctttgtaatacttttcttttttttttattttttattttcttttattttttgagatggagtcttgctcttttgcccaggctggagtgcagtggcacaatctcagctcactgcaagctccgcctcctgggttcacgccattctcctgcctcagcctcccaagtagctggggctgcaggcgcccgccaccacgcctggctaatttttttttgtatttttagtacagacggggtttcaccgtgttagccaggatggtctcgatctcctgacctcgtgatctgcctgtctcggcctcccaaagtgctgggatgacaggcgtgagccaccgcacccgacctgtaatacttttcaagtaaaactcttattctagttgttaataatatgattacatatttcaacttgaccatctaatctgtcattatttcttacgtctttaggacttacacatattattgaaactcgaaaagtccttgatttaaggataaatctgaagccttcttatctagtagttccacagacgggtttccaccatgaaaagtcagatcttctgattttagattttggtacatttcaggtaggtatatatgcgtttttttgtctgcccatctttgacctgcttgctagctaactctccaacagtttgctgtttttttcttcagagttcactaaactaaatgtagacttattttttagcctgtgtttcaagccttgcttggagtattttatatatgttttatgactattaaaacaaaaaacctccaaattttctgtagtggtagggtgatttgacagtaaggactggattacatctgccttttcctaattagaaagaagcattcgtagttttcatagtttccagggcttaattatacagtgttatttgttgcttataaatttgacaataggaaattgtacatatatgaatgtatatttgttaaaccactgtcagtaactaagtagagcaagacaacttttggattttggattttgaatctcatagaaagccaagc

SEQ ID NO: 79842 - DNA, 1036 bp, Homo sapiens
tcaagaactatataacattagacagctctaaggtaagaaggtattgtaaaattaaatgcctcatagttaatgctacacgagcttagttgtggaagagaataactgagctaggagaaggcctaggatagctgaatggaaatgactaggagaagctggaatggagtaagagggtgttaagagtggcatagaaatagggagaggagttcatccatgtcgtgtgatcttttattcatacaacagtgatcagaacttttacagtattctaaagttggttgaagtgagtttttcacgtagatgaaaggagttaattaaaacaacaagagcagcaaaccagattgtgtgtgagcaattgaatgcctggctaaggaggttgagcttcagctctggataatgtgcatggatggtcctggttctcaaagacgtttttaaaaggaaatttgtattttagtccattagattacaaaagaccttgtctgcatctttccttgttcttcattggattatagggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctgtaagtgcaaggagaaagtaactctttatttaaatcatcttatgcttctgacatactgttttcttatttctcctctttcatatttaacatttatttacttaataagtaagtttcctaataggtttttcttgtttcaaaagcagtatatgttcagcagctaattttgatttttttcatatgcaatacatttttccctactccaaggtttatttatctacgcctttgttaaattttaaaaaatctaatatacttttaaaaattcttgtttatttgccaacgacttccaaattgttacacgtttacttcctactccagttcttttttgtatattttctct

SEQ ID NO: 79843 - DNA, 1131 bp, Homo sapiens
gtatttttagtagagacaggctttcagcatctcgacatcttgaactcctgaccttgtgatctactctcctcggcctcccaaagtgctgggattacaggcgtgagccaccgtgcctggcctaatttttgtatttttagtacagatggggtttcaccatgttggccaggatggtctcaaaatcttgacctcgtgatctgcccgccttggcctctcaaagtgctgggattacagacgtgagcaccctgccggttcccaaattcttaacttaacattcaagacattcaacatttttataaaagttttatcgcttatcagtcatccacatagactcagtgttataaccatactggaatgctatttcccacatgtcgttttgtgccttttggattttgctttggcaaagtctgttccttaagggttttcttatatctaagtctatttaagtcagacaattttactgggaattgctgagctcttataggaagacagttaagaagaacaaaaaatttgacagcataagatctaaaatgtcaagacttttcctgttttctcttaaacctttatattaacatttacgttaacaaaatttgattttcaggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggtatatcttgcatatattagtgagagctattatttgtctaatcatcctttaatattcttctgcatgtaatttgaatcaaaaaataattttaggaagaacagaattcacctctttttgagagagaattatgtgggaaaatgcagaattttttttttccagtttttcttctttaaaaaaactttttttccccctgcaaatatcagataaaataaggttactgtaaacaatttggggaaaggtgactggtttttataataatgtttaggaagtcagtatcagagctgtttaaatatgtgtttattagatagatatatcttgttttgttagtaaacatcctgtatttatacggtagtggcttttc

SEQ ID NO: 79844 - DNA, 1029 bp, Homo sapiens
attatgatacaacatgtttgggttataacttattatttaggaatagatcgtaacacacaccactggagaataagagagagagaagggcagtatagctgtagttcattccctacagccaactttctttgaattccatgtattcttcttagcttgctactgtattctttgttttaggatttagattttctttcttttttcaaaaagtaactaaatctctgagattctggtattcaggtcacccttatgttactattgcagtgttaacataatcctgccactctagagaatttttttagtgagcttttctatttcttggcagcctcacctttattttacaactggatctctaacaaagcttcctgttatttatttattttttccatctgttttctttatttcagtttcatggtaatgaagctattggttttttattagtatacccctttatgatttttctcagctttcatactcacgttgttccgtattactctggttcactgttgttttcttcgtgttcttttataactaattgacgctggataatagttggcacttatgttacatagatccctacattttttgatgataaaactttcaagtgctgctagtttgtgaaatcatttaggttcattaatggtaataaatagttaaggaaaatctacaatttcattcttaggcattttccatttataactagcttttaaagcagttgaaaattttgtacagtcttatgcaaattgtaattaccatgagatatcacagtttttatagtttgatactattcacagttaaaatttatcaccttgcattcccctatcatcttccctgatacacctttttatattacttctcaacttgaagattattttctttagttgattctaaggttatatacgtaatgattattttgacaataataaagtggtgagcagtttctttttttggaatgaattttattcatgattttgttactaaattctgctagtgattaaataagacaaatttatcagatcttatttccttttttgt

SEQ ID NO: 79845 - DNA, 1050 bp, Homo sapiens
ataattaaacagatacgtttcattttattttaaactatagagctttagatatgttaacaaacactgtgaatctccaagagggctatttagtatgtagctttcccaccttgttgaccatagactcctctgctaccacctgttttcaggaaacagctattcatatctgctggagggatcatgtcttttttttttcagcaaaatatttacagggtctgttaaatactaatttctgaataaatatttgataattgaatgaatgagttccttggaaatagtgttcttgaaagtgcaatttagcaaatgctagacttaataaagtctgaataacatgaatatattttcccctcatttttatgttattttctttcctttaaaaattcaaaatggcatttgggtaattttggagtggtgaacatgagaataatcttttaatattgattcataatttcagtgtgttgattgcctgatctctttcatttttctcttatagcttatacgacttgatagtcttagcgcctactggaatgtaaattgcagcatgtcttaccagagatcaagggaacagattttggtaatattaatgtatacttggaagagctaacttcactcccatccctaaatttgtttaatataagagggccttcatgaggacaggatatcagccatttgtttaacttgtatttcactaaatcagaaatatgaaaaacatcctttcaaatccactatgtgtcttcacaaaagcagttttgtttttgaagatgtttgtgaaatcattcactgggcagtgatatcagagcccatggtattaaattaaaactgtatttatgcttttttacattctcattttgatgacattcttgtcacattctgatatttcatatcagaatgattaagagtattataaagataatatttctcagatataaagcatgtatctttgacacatgttttagacatttgtgatgattttctgaatagtagaagattaattcaaaacttcaatgtgctaaaccagtcttagccatgtttatttacttagagattaaagaa

SEQ ID NO: 79846 - DNA, 1207 bp, Homo sapiens
gccactttatttctgatttggaatgtgaaatgaatgtcagataacagtataaattcaaaaacaagttttaagttggaaatgcatattaaaatataaataaagacactattggctgtaatttccattgagtagtaccttagctatcctttggttattaattttgaggtatatgagaatttcaactcttgagcttgtatttttctattttttaatagataagccaaaagaagccaaaaaggatacatttgtggaaaaattggcaactcaagtaataaaaaatgtacaagtaaaaatcacagatattcacattaaatatgaagatgatgtaagtaatttttatttactcagttaataattaaatatgtattttataatattcttgacttttctatatgtggattatctgtgcccatttttaaatccgagattaatttttttcttatgagtacactaccatatcctcttgtgttagcctcgttttattgggcatttatgtacataaatatactataaaattaccatgtgttcctttctgaagctgatataagaggtttttggattgtcttctgttattttttttgaattttattttacgtgttaagacataatattataactttaaggaactaatttttgctttatgctgacaaaagagttaattctaaaaggtgatgaataactaatgataatgttaattggccaaaaagtgactaaaatctggtcacttgactgtagtctcattctctttacataccactgagttggattgaacacccaaaattattcacacacatgtgcaacagtagttgcacagaagaaaccaaacttcactcataaccaaaagagtaacatcagctgattaagaactgtttaactggctaattttaattaacatacaacacatattttgaacaatatgcattgctttgtttaaaagtttgaaacatgtaagaacttgaattttttcgtttatctaggaacctggaaatgttcattgcttctaaaaatgagtttgcattctttttgtttttaatttgaattgaattaaagcaatactgacatttgtagaatttgtttttcttttcttggtaagttccctatgtaacttgataagtcagcaggacacatttgtagattgtcaaaaaataccacctctgtcttatactgacttgatttatggagtcattaaaatgaattgtgttaacaa

SEQ ID NO: 79847 - DNA, 1025 bp, Homo sapiens
cttgttgagtttgatatgaaaaggcaatgaatatgctccccccttttctaattatatatctatagtgagatcagattttcatcatgtacttcaattaaaacaacatatctcaacaggttgaaggcagaagcagatatgctaatccaactgtcttctactaagtgagacattaaagagatttgtaagaatgtaaaaccatgcaacttttctcacaacattgtgtttaaaaaatatagctatttttataactgtatgttattatgtaatggcctatttttaaatgaatgtcttttttcagtttttatttataatatggtaaatatcagtagttataacccacataaataaaaagttctttagagtcctcaagttataaatgctaaatgggttgtgaaaccaaagtctttgagaactgctttagtttgtgattgagaatcataaatttattatttattggattaattagaaactttctctaaagagctatattagctctaagattagatttaaactgtttagagaggtttaaacatggtgtatctgccattgagatgaaagacagaacatggtgctagaacaaatatgaaaccagaaagataattggtcaggtaagaagagaatttaacacgaggcagctgagtctatgtctttgaaagctgttctagccaagtggaatggttttcagggctagactggctttcttacttgtttcttttcaaatggtatttctttgagaactcattctttttatgtatgtttgatttatgaatagaacagagtcagtgactttcacagtggcaagaactactggaatagcactatcctgattgtgttacattacttattaaatgtttacttcttgaaactgagggttttatttttgtagttgaggatttgtttcttaatttttgtagtggcagaacaatttgcttttaaaaatcaaggaagaaccaattaaaaatttcaagctccatttcacatatattctctaaaatatatataacatgaatttagttggatctgaa

SEQ ID NO: 79848 - DNA, 1366 bp, Homo sapiens
aatggtgtcactgtgaatatttcctcagaaataaaatagttttggtgtcaccaaattttaattaccctgttacatgatttctaattatatgaaattaaatttaggtatattttacatgtgaaattaaaggtgtctttaaattgctttgcattttggttattgctgccatgtgggatgcaggcacacattcaggggagttcatatatggcttggagaactttgtttacaaggacatcaagcctggtgggtatgcatggttaattatattcaactatataaacatattcttgtgtatgcttgtgcttttggtggagtccatttgatggcatgccatccttttagaaaatatggaaatgcaatttttgttttccccctctaccatcatttccttttccttacctgtagtcgtttattcatttactaaatatttgagtgtcttgtggcaatcactgtgctggatgatgctggatgtttgtggggtaaacaaacatgattcactgttcttacgaagcttagaatatgaactacagataactttcagatttgggctactcttttgagtttagttctagagttcagtagtttctgaattaagcagttcctctctgatagcggtggttttggaacgtaaaaagcaataaagtggaatttttctttgaattcagaaccgtgacaggaggtgttcctctgagctttgatttgtttcacctctgttgtagctctggaggtgcctctagactactgtcctgtacagcatattgaaatttcaagcttcgcaaaaggcaaattaaagtcttactgtttatattaggatttatgatatgattcttttatatactaggaaatctaccaaatatattaaaataatactttttagtattttacataatcttatttgttaaactttatgttttatatcatacttcaagagcttgttagatgaactcagtcacatttaaatttgttttgattaaatggcaagtgggtctgtatcttgaaatttgtaaacaataagcatcatgttagaattatttctgtagctaggaactttaataggttgattcatgtgacagatggaagtggaattttcatgacaggctttacagcattaggtgaaattaccctgaaagcagtttccgttctaataaacctactccttccgtaagtgtgcctgtgttgtcttatagttactttgtttaatatcaaagatagcatggagatactcatggctcactgtctggttttgtaggttataatcaaaccagcttactgtagtctgggtagcattgttaaaaacagcagactataacagctgtcaccgtaaaagaaaacatcattgattcagtttttttttaaaggtatatta

SEQ ID NO: 79849 - DNA, 1082 bp, Homo sapiens
cggtgcggcaggtgctagatgcgggagcctctgccgcccgcggattctcggggtcccagtcccgactccggctggggagatgcggcgggatcccgcccgcgctgccaaagttcccacctttctcgtcccccgaggccaagccctggccctgctgtccccgccctgcccgtttctgtggtcctctcgctgcactcagggtggcccctttggccctacagcataaaaacagagccctttctgtttcggtatcgcgtggagtgagcatggttgtctggtcatatacgctcgaagtggcactaagaaaaaaggaggaagttgcatctcgcagttatcttcactatcattttacagggagcaagaactgggttccttctctttaggattaccgggtttggagaggaacgggcaggagatctttaagataggcgtgtgcttagggattcttactcttaatgctttcagctcctgtgaaaatgatttcttcctttaatatttacttttccgtcaatacgaagaggattttgaattttgttttggagcaatagagagaaattcaagcctcgaccagcatcgtcattaattaggtgtctgcttggttgcatgctcaggaatttatgccaacgtttttatcctggagattaagtgtataaaagtattcaggaaatagtgtacttaaacatacactcttcaacgagcttaatcgtttgcatgaattacgtgttaagctttgaggactttgggactttctcactccacaaaaggtttgggaactttgtcagctttggaggaaaattcaaaaaacgactcaaatgtatggatctgcttttaattcaagcaacaacaaatagctatagacttcccctgtccactagggtaaccactagccactgtagctgtggagcacttgatatgaggttagtgctaattgagacttgctgtatgaattaaaacatcgttttgaataagcattactcctaatgaagtaggagaaaaaaataatacctcaataatttttatgttgcttatgtgttgaaataatatttgaatatattgggttaaattaaatataatattaaagtgta

SEQ ID NO: 79850 - DNA, 1051 bp, Homo sapiens
gacccgggcgcagcggtttgcaaacagcctcgcagtcggcgccagagagcggattcctggccgtgggcagccggtcccctccggggctctcgctgggtttccggtaactgggctttgaaaagcggccccgcctgcatagagtgtcccctcgaccccagccgggcccccgcgccagaagagttggcgctggaggagcagcttcattccagcactggccgccgggactccagcgccactttgcaaacaagtctcccgccgaggctctgggctaagacagcccgccagtgcggagttccttctccggtgccggacactcagacctgccgatcccacgactgccctttacttggcaatctcgccacgggcgaactgctggccgctgagcgacgggggcagtgccgggccgagagcggggccaggctttgcatccagtgcggctggcctcacacagactcagcggctccctctccttcctcggtcccacgagctgaaattttgcgcccattggaagctggagggacctggagacgagtatttcgggatccctgaggggaccgaggaacgactttcgagggcgccatattttcagtgggtcttgactgcggaggggagggggcgagcagtttctgggtcccggggagagccccgcgccccagtcggagaggcctgatcggttgtcgccgggaaagtttgcgcgccgaggcaggcgcggaggcggccgcacaaggcgcgcacgactgctgtccccgcaagggcgcgcggactacagcgcgtcgccacgccagccggcggggcttgggaacgagagccgccgtcacggacagcgtgctgggcttgccgccttcctctgtcccgcctggacccggccttggggctccgaggctcagggaacacgcccctcttccccgcagctaccgctgcccgggtgctcagccggagccgtgcgctgggcggcgtcccggggctgggcgccgagtgtagagcgttctcccggtgcccgggctcgcctgggtgctccgaggggcgcagtagctcacttcctgggggagag

SEQ ID NO: 79851 - DNA, 1035 bp, Homo sapiens
gactagttaaaacataagccacacataactattacaaataatagggataaatggtgggtatgaccagatgttttgcctaaagttcaaagagttagggaatgtgaactctgtcaaatttcccctgcagggcccacaccccctcctcaataacctggagaaaggcaaagaagtcagggtggaggaggggaagataacatgcttaaggtagacctctcttgtgtgttgaccaccctgacaatctttggcttggggcaggtgccatttgaataacagctggtggacaaggttgggtacaaaatgctttagttgtgagagtctttatatgtcacccagagctatgaattaggactgggctcatttgccacccatttcacagtggagtttcagagacggtgccaagaccatggttttgtttttctcttaatcaacaatttaatttcagtcaaactgatgctgttctgaaaatgtagaacaaggaatgaacatttgtattttctttttactcttttagctgcagttttaacaaacttaattccctacgtctgttattcactcattcagtgtatgtttttgagggtttaccatgtactttatgctgagaagacatcccctgccctcacaatgcccacacattgtgttccgaggaggtgatactcttttgtactttgtgtatctagtagccagggcgggggtggggtagagggtggggagatgagaatgtgatgaaatagtaactgaaatacaacattataaaaagatgagaaaaggatgtgagcaggcagttcccagaacaagggatgcaaattattgtgtctcttctcaccttctctagtggacagagaaatacaaatttaaaaacagatattatttcctgtccatacaattgatacatcttttaaaaggttggtaatactctctgctcgatggggcagggtgggaattctcagaccattgatataagtgtgaattgctacaaccttttggaaaagcagatcatttctgtgaaagtttggagcacacgtgccatgtgagcca

SEQ ID NO: 79852 - DNA, 1062 bp, Homo sapiens
gttgagagttaggggttcaagtattgaatgaagaaagcacatccttattaaatacttgttgagtggtagaaggcacctgcagaggacagctggatggagacaaatggttgcagttctcatctttatctctgaagggggtacttaagcagtctacttggcaacttttgtctctgggttgaagatgataaatggacttgtctgaagtgtttatcatggaccttaatgttctggtgacttgttttggtgaatcactcatccccagagtccacttcttcacagggggagatgtctccttcttctcctaagcatttgagctcattggggagttcagtgggccctctctgcgctgctttcagacacccaggttaaaagatccccaaagcattctcgtcctgtgtttaaattaaatctcctcttctttcttcatttgcattgcttcaatatagtccatttaattacttggcaccgcacctaggtcctagtttcatataaatgaggctatttcccaagtgtagcccgaggtcatgcatgctggatcttccaaggggggcgtggattattcctgggtttgggagattacatggagagtactttaagaggcttaattttctccttgaagggctctctactggactcaacacctgtcactcctaggctctccctgatggagttaaaggagcttgccctgtgggtaaaacatcagccaagggcagcctgaggcacagccacaaagcagttaggtttggtacactcaagaagacaggacgtttagtacacccaggaagacagggcagatgtctgtgtgggaaaactcagtgactcgagggaagtttacttttattgtcagtatttattttattttaaagaaaggtggttggaatggctgtaggtgggtgtctccctttgatagggaaagaactgaggctcagaggggtgtgacgcttgacaaagctggcaccagaaccctgcttcctccttttcttgggatgtgctgttggaacctgtctgtaattcagggttgcggttcttagccctgggtacgcttcagaatctctagggaag

SEQ ID NO: 79853 - DNA, 1014 bp, Homo sapiens
gacaggcaccctgcagggcagatgcctgctggccatgtacacttgacagacccaactcctttctgagacacaacacccatctcaactgactgtgtcgcagtttgctcctcactcctgcaccgcttctggtttctaagaccctgtagggctccatttaaaatgcatacagaaagggctttttattttctttggggtaatttaattttctggcattttcccaatgtgttttgtcctacttaggtgagaatgaaagctgcatttagtgtgaggaagtcacctctctgagggcttttatgagtcctcttgattagggtccctaggtgaggctgagactggctctggggtggggtttgggtttaaccagctcttggagaagctggtggggaaccagaagctggcctgagtgctgctctgacagaaggagtagaagggtacaagctggctgcgcagggatggattttaacagtaataaaggatggtaaattgttggctggtttttgctggtgaacctgtcacatgtttgagtgccccgatcttgtgacagtagctataggctggagacagcccaatggagcctgcagcaatgccttgtcgggctgagctggctctttgatgaacctcagaagttgtttagatggagctttatgaatgtgcctggtgaagggcctagagtaagccctggggaatccgagaagcatcaggtggccgtatgcctaaccatagggacaggagaagggcatttttctcttgaattggaagctgacggattgtattagttttctagagctgctgtaacaaagtaccacatactgggtggctgggatcatagaaatttactgtgtcagttctggaagctagaagtctaagagcaaggatttattccttctgaggactgtgagggggagcctgttccatgcctctctgtgtttcttgtagaagggcatcttctccccgtctcttcattgttgtccctctgatgcagggcagatgagccccaaagtggggcttagtcca

SEQ ID NO: 79854 - DNA, 1029 bp, Homo sapiens
atgcacacagtaaaggtttccaactagaagcttattttgtttgtttgtctttgtggatgcacagacatttccttctttacttggttcctgtggtttgcgtttagtgtagacgtaatgtttgtccctctagaatttattttaagaataacagtaggagcaggattgtaaacttggttcaaggaagaaagcacgtgaagccacgtgccttgatcgcccggcctattaaagccaatttcactccttgcccggtgtgtctggagtgggttgattaagttttgctttccatattctcaggtgaatctctttagattctttcccacaactgaatgtggtaaatgcttttgagaagaggaaaagctctttttatgagagttacctgtgcttatttctctaaagagatggcatgtgaaacctggcaggtacctctgggaaaagtatactgatgcatgtgccaggtgtcatacgtcgtgtgttaaagtgtgaattctgagagtgccactgtagtttccagtaggtaatgttataatgtgtgcttattaataatatgaatttagtatgcattaattcttgatcctgactgatcttcaagaatcacctgggacggctttgaatatccagatttcagaatctcacccagactcactgactcagagcttctggagtgggacctggggccctattgaaagcttctctgggggagacagatatcatcagcctgacttccgtctggagaccggccctggagcagcatgccaattttgacaggtcaccaggccagagcttgtggctctgggtgggaaccggggttggcgggggttgggggggtagtggtgagccctaagcaatcactcaagcggggtgcagtgatcttgtgatggtactgtttcaggaaggaggaggagaagatgcctggtagcaaactgaggagaggcctgtgtggttggatggttctgcctgggatatctgagtttgctgttctgggaagccaggaggatgaactgattcatcggttggtgaaagcccctgaac

SEQ ID NO: 79855 - DNA, 1046 bp, Homo sapiens
tcgtgtcctttcagcctgtacgtgacttatccaagatcactggttaaggtttttacataaccgatataaatgcggagacttcctgagagacctggcccgaactgataagaaaaaaggttttgattttatgatgattccaatttagtgatattcctaaactagtttattctagttctcctttgagtcccctggaatgtatatataagtgtacagattttaaaaaggaaaaaattaggtctttgtggctgtgtttacatattctgaacacttattggacttctgttgtaagctagcatttattggtgtttcagaggtggaaaattccattacagttcaattgactttggagaacataccagtgtctagaaagttaaacaactgttttgtgtcttaagtggaaagcaaatttgtatgactttggaaatagtgtatctgtcttattgggccaatcatggttaaattgaagacatggaaactatcaaaaacaattacaactgttattttctgtccaaactcttcccggttagaggaatcttggcctcaattagaactttagcttctgttttgttcgctagatgtttttactctcaattacccttaatctggattatttgcgaggtagcaatttttgttaggaggaggtagcacttgtttgagttaatgatttgcaccacatttttggggatggtgactttaatactttaattctgcaggagttcagatgtatagtggacagatctcatctctgtttgagacttagtcaaacgaaccaataaatatttattgagcatttactggtaccctgcattgtgctcaaaccccatgtcgatcatgagtaaagtataagtcatggcccggtatgtcagattgaacagtaagatggttagagggaacaatccacaaggtaatgtagaagtgtgagtaattcaggataaattgtttgggacagttactgagtgatactcactttagccattggagagatcaatttggtctagaagtctcaaaggcttcctggaggaggcgagaaagatgataaacaggaa

SEQ ID NO: 79856 - DNA, 1436 bp, Homo sapiens
tttgaatctgagatgagagcagcacagcagtagggataaacaactaattaaggccgaatgttctctacatatttgtggaatataatttgactgtgcactgatgacatgttaaacacaaaattagatacttacataattaggcaatttaaacatatgtcatatcccgaagtcaccggaacaggtaacggtaaatgtgaccatactgcttgtttggtttctcagggtttgtgcctggaaggatcacatgtagcctgagactctggaattttgaaaccaaacattgacaagtggcttgtttgatttggtagtttaagtttggatgctgaaagaatctttatagctcagcaaacatggacttgtgcagctttctttagctttctccatttggaaaaacattcagaaagaagaaagggaaaatggcatcagtcgttcctcaaatatataaataaaataaaggaaatttctaaaaatggaagaccagaaacccatgtatatttaattctatgcctctgtgcagcttggtgtaaatattttgtggatttcatctctattggaacaaaatatcagggatacaaatgtagagtgggtgagctccaggccttgggccccgggcatggtcccaggcccatctcttgctctgggttaatgggacttctggaacgctccttggaaaggacgtgttgctcttttagctcctgaatgcagacaacaaattcacttgtgactcagaatcatagcaggcctcgtcctggtgtaatagcagttgggctgtattccttcagtgtctcagtgtgtgtatgtttaattaaatttttttactttttattagtgtatctttattagattttttatcgaattttttattaggtcctctggaaaagaaacactctgggaaagtaatcctctaattgaagacaaaatgaccattttagtctgtttcatgatgcaaaactaaatacctgaggctgggcaattttcaaagaacagacatttatttgtctcagagttcgggaggctgagaggtccaaaatcaaagtgctggcttctggtgagggccttcttgctgtgtcctcacatggtagaagggcaaaagagcaaatccactcctgcaagtgcttttatagtggcattaatccactcatgaggttggagctctcttgacctaaacacctctcaacactgttgcattggggattgtttctaacatatgaattttggatcgtacacagggtaccatattgagatgatgtatgtgaaggcactttgaaaagaaccggaggcatgctaatgtgtgttatgtgatttgatttaatttaatttttaaatgttttgaggtttgggttcttagaggtgaagaaactgcaggaggtgttttatggagcttttactgtgttcttggcaatatactaggagttgttttgctccttcgagtacat

SEQ ID NO: 79857 - DNA, 1147 bp, Homo sapiens
cttggtttaggcacgtttgtatttactcattttacagatgttcatgaagaacccgccatgtgctggacactgctgtctatcccaggttcgttttataccttggctaacctgtctcctcgatctcgtggtcttcctgtctttcaagtctcagtttgggcctctcacgaacttgattctttctgcctctcagagggagaatgtaacttaatgttagcatttaattaatgctgagttgaaacattgatttatggtatgacttacctctttaaactccttgcatttaagattgagatagagaccaaattgtccctaattcttacatatcttccccctctcctttcttaagtatatggtacaggtttcattcattgggagaacagcactgtgaacttggcaagagcacggtcctggctgcagatcggtaaatacaaccaaatggcagagcattttttctgtaatagactcctaacctaacgggtggggtggtgtttgtgccaaacgtcagggaggacggtgctgactgtcctcactgtcctcctctgctttggtgaatgtttccatggcaacctctcttgctgttctcttatacccctatccctgtcttgcccttggctgtggcctcctggatccccgcagcaggaattattgaccgtcctacttttacttaggattgatacctcccttctaaagtagagctgtcatggaaagcagcatgtgataccagtgtacatctcttatcccttcaaaagtttagctccttgaggcagtttcaaccattttttatatcctccctgtgtggtgctcagcaaatactgaaagcacgaatgactgtgacagcaaatactgctctgaaggaagcagtctataaaacaggctatttctatcctggaaaacggcctgtggaaacaaagccaggttctggttatagtcacattggtatataatacatagctggttcatcaggtgctttatccatctcctgctcacttcacattcatgctctgggacagcgtttcctgatgaagctcatttcctagtgaaaatccatcgaactaatgatgggtcagatgtgggtaagtgtaacgtggttccagtacaagcagagatggattggtcatgaagattagctttagggcccctcacatgg

SEQ ID NO: 79858 - DNA, 1518 bp, Homo sapiens
cactgtcccacctcctgtcttctgactttggtcctcctacctcccctcttttcaggacctttgtgattacacgaggtgcacctggataatccagactaatctccccatctcaagatcctcctcaatcatgtttgcaaagttccttttgccatgtaagataccattcacaggttctgaggattggggtgtgaatattgttggggggccattgttcagactactgtagttataattttaatattaaatttgttatattctttggcaatccagcttaataaatgccttctgttatctcttctgatagcagtgtttggtttttgtgcccttcctgcttccttaactggttctaatataaaactttaatttgttttatcaccattaacaatttctgttggacactgacattaattggcaaaagttctgcatctttgttataatactaacacttgggcaataggaacgtattttgggctatgaatgagctttttattaaagctgtaaaggaagatttcttttcctcttcatcaatttgtattcccagctacctcaaaggaggcccaatcaacgtctattaaaattcctgaacttcaaactttagattaaaggagcattggaaagagattagatgagagtagggtatggacattcctccctcattttccctgatttcacctgctgattagagaatctgagattcagtctgtagggtgtgtataaaatgggagtctgagccagatgcagtggttcatgcttataatcccagcactttgggaggcagaggacagaggattgcttgagcccatgaatttgagatcaaccttggtaacggcgaaaccctatctctacagaaaacaaaaaattagccaggcatggtgatatgtggctgtagtcctagctacttgggacgttgaggtgggaggatcccttgagcccatggcagtgagccatgattgtgccactctgctcctgcctgggtgacagagcaagaccctgtctcaaaacaaataaaggggagaatctgttttctagcagttcattgatgttagcagtttaccatccagtcaagaacctttattgagcacctaccgatgtgagccttggagggattttaatagctaatggtggggtggagccgtttgaacctataaagaagtctgagaagccagagagggagaaggcaggccagggaaatattgaggaggagggtgaggctagtaattctggatgctgcttagagggcaggacgaggagatctgagaaatgggccttggtcttcaatgatgtgaggtcactggtctccatggaggtgacaaatcccatgtggaccatatcttcagatgacttcattctctggatgcagtggtttgaatcttatgtaagaagtaagttccatgaagcggcataggcctttgtcttggagcttttgtgaattcccaaatttgtgaatactcccatagcatataacttaacctataaaatggaataatgtagactttgaagattttgaattggtccata

SEQ ID NO: 79859 - DNA, 1373 bp, Homo sapiens
gtgactcacatgcataatacactggtgcacacacacacccttaagtagcatttgtttgaatataatcaggccttacatagtgtataagtaaacataaatgtagctgtttgagaagtaaaatgctgaaactattaatgtgatgttccaataaaaagtcagtcaagcgtcttattcagctatacaaattacagatgtcagtattagatttttttttttttgagggtgggtgttgggggagacagggtcttgctctgtcaccgaggatggagtgcaatggcctgatcacagttcactgcaccctcgacttcctgggctcaaagaatcctttcacctcagcctcccaagtatctggaactacaggcacatgccaccactcacagctaatttttaaatttctagtagagatgagggctcactgtgttgcctaggctgatcttgaactcctgggctcaagggatcctcccaaagtgctgggattacaggcatgagccatcgcctactggccctttcttgatattcttgatactgagctctgtagtcttttttttttgtataaatttatttttatttttatttttttgagacagagtctcactgtcgcccgggctggagtgcagtggctcgatctccactcactgcaagctccgcctcccgggttcacgtcattctcctggctcagcctctagagtagctgagactacaggcgcccgccaccacgccccgctaattttttggtagagacagggtttcaccgtgttagccaggatggtctggatctcctgacctcgtcatccgcccgtctccccaaagtgctgggatcacaggtgcgagccaccgcgcccggcttaagctctgtagtcttaaactcctaataagcatctggaatcttctgagcgcttaactcccattttagcagagcttgggtcttctttttgtattttaattccttgtaattggtatgcctctgtcctactgcctgtggtattcagatcactagactaccttagattcctttacctgctggaaaaccagctggagtctagaagagtgcttacttaaatcacagaaggaacattagctagtgagtcagacgacttgggttctagtcatggttctactgttgacttttttgtgactttggatgatccgttttacatctctggacttcagttttcttatataaaaaaatgaatggaactttacctgatcgctgtgattttaaacatttttttgtattctaagacacatctgtgatttttaccgttgggtctaatactttcaaatcaaacaatgtattcagtatctctacaagggctggactgggggctgtagggtattcaaagacatgtaagttgtgcttctagctcaaatga

SEQ ID NO: 79860 - DNA, 1025 bp, Homo sapiens
agtctttctcctggaagtgctccttggacagagttaactttacttttttttttttttttttgagatggagtctcgctctgtcgcccaggctggagtgcaatggcgcgatcttgctcactgcaagctccgcctcctgggttcacgccattctcctgcctcagcctcctgagtagctgggactgtgggcacccgccaccacgcccggctaattttttgtatttttagtagagacagggtttcactgagttagccaggatggtctcgatctcctgaccccgtgatctgcccgccttggcctcccaaagtgctaggattagcccggcccagagttaacttttctccagagttccatatccccagaggctatgaagggtgctcggccccgccccactcactcttgtgcatttctggttttgttcctgctatgtcccattacaagccaattcgtaggcttgctcagtctgacaggctacaaatgaggtgctcgtgacaccagaatagaacttggctattcctcactgtgagtgggccaggactgagcttccaaaggctggccaagggctggctgccactgatgcagaatcctcccaggaggagcccaggaatctgtatttccaacaggccccaacgccttggatttaggagacgaacttggagcagaagcagcatggctctgactgggcccagggagcctgcatagtgcctccttacattagatttcactggatcctctcagttgtcctggggaaggcttgggtgatctatgtgctatccgctgcagtccacagcactgaggagtgacaggattcccagtcagggcctaattccgtatagctgctcttgaacaagtacatcccaatgctttacagagttaggtagcagttattgagtcactcatttgcaaatgtagttatagaaatgcatgatcatattagaaggatccagggaggaaagagttaggcttgtactgggcaggctgaatgagcttcacttctggattcggtttattctgttgtgtgtttgct

SEQ ID NO: 79861 - DNA, 1071 bp, Homo sapiens
gtagatacctattccgtgaagttagagatgaattagacacaagagagagaaagacctggctaaactggaaatgagaaggacgtcgacagtttaaaaacacattatggtaaaaataaacataacacgaaatttactactttaaccatttgtaagtgtatagttgagtggcatgaagtacattcacattgctgggcagcatcaccaccatccatctccagaactctttcatcttgtaaaactgaaactgcccattactgcttatcctccttccctccagcccttggcaaccaccagtctactttgtctttgtgatttttgactactctaggtacctcaatcagtggaatcataccgcatttgttttctaagttcacatttttctgtgtcgatactttaagtccaataagttaagaggagaagggacttaacttgcctctcctttggagacagtcctcctgctcccttctgcctgtccttgttgcccagagtggcggggccagtgtactgctttacctaatcctctgtgtagaatggactggcagctgggggctctcgaagtttgcttccagctgttcttgggatttagtgttttccctggaatgaagatgaagcagggttgccagataaaatgcaggctgcccaggtgaattaaatctcagataaacagtctatcatttatagtataagtatcttccaaagactgcatgggaaatacttatactgcagaattatctgtggtttacctgaaattcaagtttaactagatttgctgcatttttgctgctaaatttgggtgatccagtggtgaacacacaataaagcagctcattggtaaaagggcatgcggttggctagaaagattttgggagatgggcagatttgatggtgcagagagagaggccatttggcattgtcaacctattttttttttttttttggtagaatattaacttggatcctaaaagtaggattggaaagtagctgcatagactcctgtcatttgttcttcagagaaacaagcagctagtactggctaatgagaatatgatctgcacatggcaggtgccaaaa

SEQ ID NO: 79862 - DNA, 1086 bp, Homo sapiens
tgtgttttctgtgtggctgtttttcacttaccttctcccctttgggtctaggttcctgtggctggtttgctttctcctcagtgttttggaggacataaaatgatagttctcagggtttgcaaacagtgtgagcccttcctgcagctgccggtgggtaggtggataaaatcagttttgctgctattgtccacgggccaggcccacccccaggtgccagtggctgacccctggccacctgtgcgggagtgtgagtggctgcctgctgcaagggcccctgtggctcagaggagacgggcacacgctatgctcccttcagagcagtggtagacatgctttattttggggttttgaagccctagcatttagtggctcattttggcctttttcttcccctaagggattctgtgatgtttaatgactcaactctgattgtactccggatgtttcttttccactgatgtcagtttatagagcagtcctccagcaaatgtttgtgtgggcaggaggcagaaagggaaggaagaggtgagggggcacttcgggaccccaagaataggcttcaactgctgccccacacaccagggaggccaggccctgacattttaatgcccagtgcttttgcttccagacccattggaggggtctggttggggcttggatgaatgggacctgagagccgtctcctgcagggctgctggttctctgtgagaactttgggatgccaggtggggcaccgtcatggggtatgggattatttgtaggtctggtcattaggggtgggatgtctggcagatgccttagagcaagtgtatcaagaagtggggtacagcacaggaccctgtgccccatccttccgtgagtccccttctggcttgtctccataggacttcagcttaacacagggagtgagggagagggcaagagcatgggcaagagggagggtttagttttgagcagatagatccagctcctagtttgccttagaccctggaacactggcttctttcattcggccctttagaggagtggcccagagtagcctagcagggactgaactctttcggatggcttccagagcattgttcc

SEQ ID NO: 79863 - DNA, 1048 bp, Homo sapiens
tcttctgaaaggcccgtgggctgtccacttgaggaaactggctggacacattgttagggccatctgttttggaaaccagcactactcttgggttcctggtttttaaccagtgattcatcttccctggaccctcagggtccagattgccaggctgagagtgtgccaggcatgttagcatcttggggatggagggaagtctggttagccagaggggacccctgtttttaggagacaagtgaggtagtgctataggctgaataatgagagaccagagctggaggaaatggcctggcgctgtgggtgtggctcttgccagctgggctctgggcttcccttccggaaccagaaccagtgtggtgtgaggctctggtgggaatgagacccacatgcaggctggacagcatcctctggccatttctctttccctcgttcattgccttgtgtctcatctttaatgaaaatgcccttgttaggaaattgtctggttctggggaaaatctctcctgaccgcacagctgccacccccatagggaggaggatgtggaaggagacactaaggacagcgccaaactctctagagctccctctttgctgagcagctggctgatggccgtggccacgggggtacttattccccgtcagagtaggggtgcctcttgcctttcccccaacccccctgcctctggcagcccttttctgaacttctttggatgtttttctagtgtatattttcaccctctaattttattagtgaggaaagaagataaaaggctcttgtgtctttcatgaagctcttgaaactgtccctcttacagagcaaggctacagccacccactgacttcccactttctgaccgtccgcccacctctgtgttcccttctggatctcttcctcccttcaaaagtcaaactgcagttctgtgttttggatatgagtggtgagaaccgttgttgttaattgacaggtctttaattcctgattgatttctctatttcacttagcttgtaaatctgaaatgatgtagaaagcataaaagtttgattctag

SEQ ID NO: 79864 - DNA, 1948 bp, Homo sapiens
agaaacagagttttattagagtggtaatttacaggtaaaatgtaagctttatagacttgattctgcaattctattcctggccttgctgttcctcgctgctgatttagggcaaggcctatcttctgagtcttggcttttctcatctgtgaaaagaggggcttaggcctgagtatttccaaggacccttggcagccatatgactggactccacggtgggatatttgcagagaggcttctctggagctgctgcttgtgggctggcaccaaaactggaggcagagggtgccagctgtgttgctgcacagagcctcaggagcatgaaccctgtgtggcatttttccctcctcctgctttgtcacctgaaccccagcagtgttgttcagtgccgggaggatgtcgctcacccgctgacacggctacctgcactgacacatgtcatttgtgtcttctctgccagtgcgctgctgcagggtgacatctggactggcctccttgtccctcggatgctcggctgcccagaagtttctggatcaacttgttgaagaccatgagtaatcttcatttctacttcgcaagcagctctagacctgtggcatctccagccaggtctggctgatggactcctgccctctgtggccagcctctctcacacccaactccaagagcctggaagatggcagcagggactccgtacagggcccttctgttgcccccagcagtcataatggttttggggccttctgaatctaccttcttggagctactttgttccatcaccagagccaaacctacgagtcctgattctcttctttggcagttaggggagttttgaccactttcctctctttcactttgctccagccacaatggcctgcctttactggccttcgagaaagcacccgctttatggtggcagatgcagatgccatttcctctgtccaacatcctcttgcctggcatgtaccttctcatccatcatgtctcatcctaatgccaccccctttagagatgcttatctgactaccttgtttcaatgtcttcctccatccccaggtatgcatcctctttctgtctctgatccttccgtgtgtctgtctttgcacttaaaacaggttagatctctttagtcgttagtagactgcctattcatccattcattcaacaaatatttcttgagtatttactatgtaccagcagctgagataggcacagtctatgctgtctagaaacttccaatccatgaagaaagacgagatcaagtaaaagcctaagtaaactgtcatgctatttgggcagagtgctttgttctaattactctaaagcatcctgggcatcttgttaaaacacagatcctaactcagtaggtctgggtgggcctgagagtctgcatttctaacaagatacaggtgatgctgctgccttctagaccacacttggagaagtaaggctgtaagctttttgatgaaaataagacttgtcctggagtgtgactcttgctgaactgcctgggtggatgtgggtaaagttactggagaccctcagggttttgtctggccttggagtctcttctagctgcaggagactgagtggtctgagatgtgagcctgattgaacagtaggggaacctgttaccatcacctgcatctatgtgcttgtcctccttaaggttatcataggttgtaggtttgtccattgaaccctcccttaaatgttgtgcttttcacattcacttggtggaatcctatgggctctctctgtagggtgtgttctgtataagtcagcatttctgaaaatactgcggatgtttggtttttaagagcagactgtatctgctgggcccatggggcacttgcagtgagatgttgagaatggagaccatactggaagctggggactggggcagaaaccttcgagcaggtagactgagggcaggtcagatgcagggcac

SEQ ID NO: 79865 - DNA, 1032 bp, Homo sapiens
gtgtttccttgtcttctgtggacttcaggagtgaagacctctctggggtcttcagttatttgagtaaaaggggagagcaggtgggtggaaggtgttggatgagtgtcttaagaagtgtctgctccttcctataacagattttgtttatatatcttatttgtttattgttgttattttgagacagagtctcactctgtcgcccaggctggagtgcagcggcgcgatctcagctcactgcgacctctgcctcctgggttcaagcgattctccagcctcaacttcccgagtagctgggagtataggtgcccgccaccatgcctggctaatttttgtatttttattagagacagagtttcaccatgttagccatggttggccaggctgatctcaaactcctggcctcaagtgataacagccacctcggcctcccaaagtgctgggattacaggcgtgagccacggtgcccggcctatatttctttaaaatgtcttcttattttacaaagttagaaaagtaatttacaacctgttgatatatttaaaaataagacaaagaagtaaacatttataaaaagggaaacagctttttccatagtagtcttcatcaccctggtaagctgccagtgcttccagtcttctggtcctgcgttgcatgccctacgttaccacacttgggactgtcttccctcattgtgccgggatgtactttttttctttttttgaagaagtcacaatgtaatataaattttagatggccagagacacaagccctttccctttctgatactgtgctaaagtgttcagacctttcctgcattgctttctttgcttcctggctctgcctcaaggtgggattctgtcaatctcccctcattcgaaatgtccccaccccagagctagcactattgacagggcagttgggatgaggggcacagaagaattttacctgcagcctgtggctgagtacccatgcttaaccccattccaacgaactagtccattttttcattttattaccttgtctgaaattatg

SEQ ID NO: 79866 - DNA, 1012 bp, Homo sapiens
actccaatgttggtaggaagcacatttcttcacggcagagtcacagcccttctctgtcattctgcaggcatctctggcagatcttgcatttaacaggaatggacaatgacaggattataaaaggctgataagattccctgcagggtgagctctgctgacctggctacccaccacaggctgcttccttctgtgttgtagtcagcaccctgcctggcccattcctgtaccaaggtgcttagaacagacctctttcgggccagaaccatttctagtgcaagttcttggtttaattgtgctgtttcctttaaaaatgatgttctctatctctggattgatctctcagacagccagcctctgttttaagtatgtgaaatgcaaatcatcaaaagcaattgctgctcttttttctgggtctaccttgggccgccttgacttccttcctctggaattgctctcctggtgggtatattctctccagctgttggcagacataagaagtaggagctccaagtaggctccactctaaaacgtaccatcttgataaaagctatgagtcttgggcatgggtcttattagttgggacagtagctatctcccccagatgttttgttcaatggaaacatttcaatgataaaaataccttcaaactcccttctgagagcagaggcaatcagttaagtagctcctgctgtgtagctggagcaagccaccacacccatggattacatttggcagcgtttctttggccagctgcatgcctcccagcagataaaagggcagtgcgtagagaagatgttagggaaagtggtggggtggaagtagggaggaggtgagccttgtgcagcagctgaattcccagggtgaagtttgggccttgctgcccccagtttactgtccagctgctgctgctgcttgggcctgcagtgctgcgggatgactgggatctggaaggcggctctggtgatttgtaggatcagaggaaggacaaaagctgggtcagggtgggtgtggc

SEQ ID NO: 79867 - DNA, 1116 bp, Homo sapiens
gtgatcgcagagaccaagtgacaaaaggcactgtgtcttctccttgttctctcacggattgcttcctctgaaagaagtccgctgccatattgtgaaggtgcttcagcagctgatggagagtcccacaaagtgggaaactgcatgttgcccattgtcaacagccatgtgagtaccccatgttggaatgggtcctcagccctggcaaaccttcagatgattgtagctcctgcccacattctgagtccaactcagtgaaagaaccacctagttatgccgctctcaaattcctgactcatgaaatctgtgagattgtgtttatgtgaaggcattgcattcgggggtaatttgttatgcagcacctacaataagtaacagaccttagatcttcagcagtgattttagcatattcgtagtgagactcagtagcactgagacataatccacagggattttactattataagcattgttttgaggcttttaaagtgatagctaacatcatgcgatagatatattaaccacttccctcccctggtgtttattttaaagggattgttaccacaattaaattgatttatggattcatttgtttatgaattttttaaaaattatttgttctggcagttgttaatgcttgaacttacttatgggggttatctctatgtgacttgggatacacgtttgtctctatcctcagaggaattagctgtggcagtagggccttcagcacatcccaaagacagttggttggaaacataaatatacttgggcatgtattcccagagattgtgcttgtgtctaaattggagtaaaaattacaggcagccttaggaaaatacatttggagacattccgtcttccccaaaaagatgttaattatttaataactccttatcttacaccttggtattagcaggagcttctcggtgttgtgtgtgttcttactttttaaagacacagctatatgtcacttgctgttctacctgtggaatttttttgcatgaggaagctgctttggccaggtatacatcactttttctacacaagtcctctgtgtttgatacagaaatgctaggtaaatgtgctagtgctagaaatgccagaaataatttccag

SEQ ID NO: 79868 - DNA, 1096 bp, Homo sapiens
cctgggcccctgagcctagagttccttcactgcacttgcaattgcactgtgcaatgccttctcagtctcctggctagaaaatggaactcctggaggacaggatgtttttcatcctattatttccagtcatttatctagtcattcatttctttatataatgaccctcctaggacctaagaatagagagatgaacgcgatacatgtggtaggaattgtaagttgctgcttctttttgtttttgttttgagtgatccactgatggttgagaaagcctaggatctttctccccagagagaatgccactagagagggggcagaacatgaccctgcctgttgaccccaactgtgacacttctgaaaccaatcttaggaaagcctctcatgggaatggcatttccaagattaggggtaaagtgggacctccctgttgaaaagttgtcctgccctctgtcagctagacatgccataagcaagggaaagaatgacttttaatgacaggggtagaaattgggagcaagaggctgaacacatggaacagaattttttgaagtgccttgttaaatggaaagtagatgtaggaaaatttgaaatgctggtatttcagatgggcccaggcctatcacctattattccacctggagagggtagacttatattactcctcctttttccagaagcagtttgtgtgtaaaagccctaaagggccacattccacttgatcccttttattaacgaaattgtactttgcagcaaggtggggtgtggccacagagctctttaaagatgggagcctggaggcgggaggttggctaattgcatgttgccttttggcttctttccagtctttaatcatggatgacctcttatctgtaagttctaggccaaaaaaaaaaaaacaaaaaccaaaaacaaaaaaaccttctgtttatcttctttgtgtgctttttatgaagctaaacagatgatgatcatgatctaagcactagctttggaaggcaattgtagtggatggaaagggtcagggtggattctacgccagatgtcagcctgcagaggctgtgattccaggcttcacttggttgaagtgaccagtctg

SEQ ID NO: 79869 - DNA, 1067 bp, Homo sapiens
tcagaacccactgtttaaaggatggagaagccctgctccaatatggcatgtggtatgatcagtgcctgattgttcccggaaatggaacattgaccttatgcattgatggctgtggtttaccaatacctatgctcctaagaactgggccaacatctgcatagatccaatttttaaaaattataatgtgaatcgtctctgttatggatcgcgaccaacttctaagttgctttgccttctattgtccattatacacacatcaatggcattcatttaaatatacttaatttgtaaaatgagctgtgttctgtaggcagataggagtatttgtgttctgcctttattgcatgtacacaggcagagcacaggcctctgctcctggtgatggtaagtagtctccagtcgtgcctccctcccctcagatggaggtaatttcttcctcctctggattatacctgtcccttacatgtgtgactgtgattgcacttgccctgtgtgttggaattttttgttgacatttctgacacccgtgggaatgaggccctttttattcatagctgcatcccctgtgtctaagagggcatacttaatacatagcagagattcaataaatgttcgctgagggagtggatgaatgagtggggctgatgattgagaactcccagtatatcctacatatggacttgtgttttctccattccttcctccccaaaatatctggggcagcatgtgagagtctcttcattttctattggaaattggagtacttgaatccagaagtttaaatctatgaaggtgaaatgcggttaggctaagtggatggacccttagttagatcctctctgggtgatttgtttccccagtggtactttcctctgctccttctggaactccagcagttgctccttgccctccaatggctgcaggatgcctgcttcctctgtgtgggaagaatcctatttcctaatccagcaggcatttttgttggtaattctgaaaatcgtttctcagggctctttcctaaagttgtggccacccagcagtgagttagccacaaatggctcagtgat

SEQ ID NO: 79870 - DNA, 1125 bp, Homo sapiens
cttcttagggaagtgattttctttctgtggtgtgaaaaggaaataacaatgtctgtcttgctctttaacctgtctcttcttggaaattcccaggcatcttggaagccatgtgtctgcccttggctgtgctctgtggacctcctgcagtatgcttgccccatttcctctcttggctctttgccagcttgtggcctttctagaaggatattgtcctgttgtgaattttcatcatctttattggtttcttctcattcctctccgttctgtgagcttgtcagagaacctggaagcctcacttagcttctgggagcaggtcctggagctgggctcacaccccttccccagttgtttttctctctcctgccagcctccctttgattcttagttttcagtgaactgtacagtatcaaagaccctggaatctcacgtagaaaaaagagtaccgggatttgggcgccacatctgcctgttttttcatctgtgcttttttgagccttttaaaaaaatcagtggcatcagttgcatgtaaggttcatgaaagaactgtgtaaaattgtaaattattttgcagagatttgctgttttccagcaactcctcccttcttgacacacaggtagtagctctagattttgttgttgttcttgttgaactctgataggtctctcaaataaaaggaaacagataccgtttttatagattagaagacaacattgttaagatgtcatctcaccaaattgatctataggtccattgcattctcattcagaatcccagaagggggtgtatgtgtttgttttaataaatcaacaagctgattctaaaatttacatggaaatgcaaagggctcagagtagccaagttagttttggaaaagaacatagttggagggcttacactacctgatttcaaggtatacgtcaaagctatagaaagcaagacagtgaggtattcgtgtaaaagcagccatattagatggatggaacagaatagagtccagaaatagacccacacatgtatgatcaatggattttcatcaaaggggccactgtaattcaatggagaatggatgggcttttcaacaagtgatgctgaaacagttgggtatccatatggaaaaaagtgaa

SEQ ID NO: 79871 - DNA, 1071 bp, Homo sapiens
cagaaggagaaaaagaaggatgagtttctaagataaatgtgctcagataattgctttttattaaaagatactgttctttttacttcttaggtgttgaaatgtctgtttttaatgagatcgtgcttcgaggttggtttctcaagacgaagttatcagtcagcacaatttgggaaaggtgggggtattctgctatggaataccaaagtctggtaactggtcatctcattgagacccccgtgtgatgcttgagttgcccacctcccgcaaccgagtccccatcaagtagggatgtttatacagtgagtcccttgccctaaggctggtccttctttgggcagctttgactgagtttggagaataattgctattctgtggaaatttcataatcataacccaggcaagtgcctgggaggcagagcacaggtgggtgggggtaaaatgcagagtgggctttggatatcaactctgtgatttctgtggccaaagcagaaatgcccatgagcttgagttagtgcagtgagttaattgcatggtaattaaatgctaacatgattgatcagaggaactgtgtaattgaagcatagtaaaatgtggcatgcttagtaagcaattgagttgtcttcccaaggatgtaggcagtactgggcagaagcacagatgtcttgaacaagctgtgcagtgcacagttttgcccttttgtcttctgaggaagatgtatgggactctaaggagtgaaatcccacattccgtacctgagaacgagattcataactgtatgtgagatattctttattttgtagtactttgcatactttttggtatatagaatatttacttgttatcattggtgaaatttcaaggtttttttttgtttatgggtttttgggcttttctgtatgtattctggaatcaccaagaggcttccatattgaattttctacagtagctctctgaataagccttaattgatatatttggtagagatgaatgaagataccatttaatcgtggtggtaaatttaaatatatgatgtttccttctggatgagtgactatttaagccctatagatg

SEQ ID NO: 79872 - DNA, 1182 bp, Homo sapiens
ttttaatgctaagatttttattatttctgtttctctgatttttttcatcttctatttaaatctgtgtggtagatggctatcttcagtcatactcccaatataattttaatccccccaaaagtatatttatcatatcagttagctcttgctattagctcagcactgtgttggtgagattgatccatgttgttgtttgcatgactggtttgttcatttttattgctgcatagtaatccattgtgtgaatatactataatttatccattttactgtcactggaaatttgcatagtttccagactttggctactccaaagagccagcaagttgtggtcttgttttctggcatacctgtgtgcaggaatttaaaactttctctttctccttttctttgaaatataactataacagatcctattatgtgttgggtttagtaaactttgtgatgagtgttctccctgaaggagagggcatttcttacttagatacaagaaattatccttaggcttatctgtgtagacatactaccagtgactaaaggatcactgaaaacatgcatacagtttctagtttttaatttgatcttcattttaagtgccttctgtgcatgttggggtttttggtgtttttcacacatctgattttttttcagacgtgtgtttttatatcagactccagtgaattcttttggtagtggacaggtcgtaaagtataaataaatccagcagaacatacttgccattcctcttgtaggcaccctctgcctgtcctttatgtgtgctgggcttgccccatagcagctgtggttgctggcatgtcccgctgtgcagtagctcgctgctgctgaaccccctatgcaacaagatcctgggtggggaagggcagctcaggtatgatgtggccaggactcgaagggagccaatcaagtgtgaatttcaaaactgaagacatttgattagtgtgactctactttgtggatcatccaatgcaaccatctctttttacaggtggagacctgggtttagagaggtcaagtgacttgtgcaagtagagaccatgtcttttgctgccgtttccgttgcagcttatatgaaattattatttatagttgagagggtaaggcagtatgaaaagaagacagtgtgctcacaatttattatagtttttggcaataagagcttct

SEQ ID NO: 79873 - DNA, 1033 bp, Homo sapiens
taactttgactttgacaaagattcactcacccactgggatgtgagagaatgttacagaggatttggaagctgctaatgaaatgagtggtctgccctgaatgtggcttacacacacacacacacacacacacacacacacacacactctctcactcacactcattcacttccctcttcccacccccgacaattctatggatcctagggctgggataagtcctcaaaggttatctatagtttagatacaactcttgcctgccttaaatatgcttaaatatgccaaatatttctcaggaccagaagtttatataaagtacatcatggcacagctgttcttacagagccccgaagccagcaacaaggggagataaattccagagagaatgagttaaactgggcaattaagttggggaagataaaatgtttagctgacatatgacttaagattctcagtgaggtatggacatggtggtgttctcctgcacttctctaaccataaagttctggaataaatactttgtacaaacctgccttcccttctgccccatactgctttctgattaagagaagggggtcagagggctttaattctatgctagtgaatagctgtatgtccttagacaagtccaggactattttattagcagctggcagcttcagagctgaacactatgctaactatgttatatgtgctttatataaggatatatatagagagaagaagttggctgaatcttggagggaaaagttcacaaatccattggcgtaagtgggagaatttatcccagtaattgatatatcaaatgggcagaaaaataaataatagagaataactagcttgatctagtggacacacatagaacacagctttcacaacttggaaagtacatatttttaaaacgtggtacatttatgaaaagtgacagtgtacacacctcaataaatgttaaagaggcagtgttgtgtgggccacttaagtcaaaaccaattaagttagaaattaaagacaaaaggcaactaaattgcacagtgc

SEQ ID NO: 79874 - DNA, 1055 bp, Homo sapiens
atcaataaacctaggactgtcattctgaaaaattgttacaatttctaagaacaaatggaatgctttaaaaaaatgtaggggtaagtatatcccatttgatctactttggagagagggtaagtgctttattacctgctgattaccataataaaacatctctgttcttcagagaaacataaaatgtaaaagatcttaaagtatagtagcttacttctggtaggggatttaggagattcagttgtgatttgcaaagggagaatacccatggagtctaaatttcagggccaaccacagcaaaaaccatagcttacctgccggcaaagatttgatgactttctctccctgctcttcccttctccacccttagccaaattagaagcagacattttagggagcttaagcaatgaaaatctgaggcagtgctgatagaattgaggcgtgctttcttggaagcattttcatttttatacaggtaagatgttgggagtgggagaaggttgtcctgttacagtaaatcatgtgtgtgccaagattgagtggtgggtggggttgaaaccttggctcgctgtgctgtgaatagtccttaaggtggtgatggtggcattctcaacaaatctgtcacctagtgggcccatgtccagaaaaggacagcatatatgattgaagtgatagtgcaccttcactgggaggggctgttccagagattagaggtctataggcagactaagacaagggcctgaaggaggatgtgattaaagtcagcatcactctgaaagggcatcagcagagggagtgcagtttgtctaccaaatacctgagcactggaattagtgggcatcttggaaactagaagaaggtagttccagtgcctggtggggccgggtgggtaacccgaggggctcattatctcaggtgaaccactcggacattgagcatctacctggcatgaagcactcattgggagagatttctaatgtttaaggagtgcttcttgctgtctatctggccatcatctacccttttgtttgcttcttttatttattaaacactaactg

SEQ ID NO: 79875 - DNA, 1426 bp, Homo sapiens
tattattattttaattgagacagggtttcactttaattgaggctggtttctaatacctgtacccaagcagtccttccacctcagcctcccaaagtgttgggattacaggtgtgagccaccgcccctggccactgaagtttaatagtgccactcagaggcctgccatgcatgccatgcatccatccatccatccatccatccatccatccatccatccagtgagttcctgctatgtgccaagaactctgctggccactagaggcgaaatctaggtatggcacatggtccctactcaagagctccagtctggttggggaatttgacaaatctacaattttgaatttatgtggtatatactgtatgtagtgtgctgtggaagtttagagaagagtggtttctctcaaccggaggtgtcagctgataacattgtttagtagaaatgatgtttaaaatgggcttagggaattggatagggcagggggcagatgtttaggcagagggaaacatgataaatgaatcaaggccacaatgatgtcatttccaggaagccacaggtgttgttttatagctaagtcttaaatagctgcgaggtggagtggaaatgcagattcccaagcctgccacctgagattctgatcaatcgattgggaatgtggtctgggcaacatactttaatctacactttctagctggttctgatgatggtgatccaaggagtaccagtctggggtaagaattcaggtatggggctgggagggttgagggatgaggcttcaaatgtaggctggggtaggggaagagcaggagtctggagagagtggtcagagtggttaaggaaggatggaggagagcttccaggtctgagtggtcagcaggatcttgtaggaagttaaaggcatcagccagcagagtatgtaatgtccaacagagcatacttacaacaggaaataatagtttaggtttatttttgcagagatgagctaaaacatatttacaggggggaaaatacctctcggaataatgacttggctctaaactcatgcagccgaaaattcaggttccaaacttcaagtgcaattcttagtctgcaagtcggcctcccagttggaaattatttatctttgttatattagctcagtgattttggaatgctcttgagtaactttggaggccactctacaaattgcttgattcattatttaaaaatatgatcgattcaagacagaataaatgttcagaatactgagtatttttcagtatttagaataatactgaatccacatgggtggtgcattaaagggggtgtgcagcatttatgcagtaaggatatttggggggtcacttaaattgggcctcttttcatagaattgttaagactttgcaggacattttaatttcttcccttagacaggtaaccacaagaatc

SEQ ID NO: 79876 - DNA, 1049 bp, Homo sapiens
agctacacaggaggctgaagcaggagagttgcttggacccggaaggcggagataacagtgagccgagatggcaccattgcactccagcctgggcaacaagagtgagactccatcttaaaaaaaaatacatatatatatacatttttttcatatatatatatatatatatatatatatatatatatatatatgaaatatacatatgaaggcctttttaagaatgacaccaaaatatgcaactataaaggactgagacatgtagctagtaacaatttttttaatctaaaatttttgaatggcaaaaatagagcagaaattttaaaaacaatgatacttttgtcaaaaaataaaataacaaactagcaaatgagtactggtactcatttgcttttattttgagtttattcttccataagtagggagagagagatgtagagttttctttcctaaatgctaaacaacaccatttgttaactagtctgtcatacccacccagatttgattgcacgtacttgggactgtttcatatgaatcctgtatctggatgtttattctgtttcgtagataacgtgtgtgtgttctcacacaggcgcctgttcctttactgtggctaggccattttgttgatttctacaattgattatagtgcttctctgcttcaaattgggtttccatggagcaagttcccagtgccttagagaaccaggagccacatgggaacagcaaaatcaagaagggaccacttcacagatgtgttagaggagctaaataggaaaaaaagaagacaagagcacctcatgtaaactaattttaaaaagaagcagagtgcaatgcctgagatttttgttttcgacattgagggaggtggatgtctgtatttggtttttgtttaaattcaaagccattaaagcattcctaccacaaggaagaagaaaatgtgttttgtctctctgccagcagtaacataattttggtcttcaaaataagtgtcttgggacctgaattccctgtgggtaaagaaaattcccagcccatgtgttgtggcagaa

SEQ ID NO: 79877 - DNA, 1121 bp, Homo sapiens
ggtaaggaattaatgtagaaacttctagtggtcttttttttaatttttattttaagttcagggtacatgggcaggtttgtttcgtaggtaaacgtgtcatgggagttcattgtacagattatttcatcacccaggtattaagtctagtgtccattagttatttttcctgatcctctccctcttcccaacctccatgccccagtaggccccagtgtgtgttgttctcctctcttccccattgtttccgtgtgttctcatcatttagctcacatttataagtgagaatatgtggtatttggttttctgttcctgtattagtttactgagaataatggcctccagccccatccatcttcctgcaaagaacatgatcttgttcttttttatggctgcatcgtatcccacggtgtatatgtaccacattttctttatctagtctgtcattgatatctccagtagtctttgaactgaaactggttggtggttgctggagccctccatggttgggaaacaattgttctagcatgagataaagtaaactttggttgtagattattgttttccagttttggttgtcctgggggggttgtgtgatcccaagtagtgtgtacgaagcatcctgggcagagacacagggttcttctgccggtcttagttgatgctcttactcggtagctgtatcatggcacacccagatgtatcagttctgttcctgaccagctgcagaacttgggacaggttagttaatctttgtttccttctcttctttggaaattatgtagattggtctaacctggtcatgcctctactttaaaattttgtggaataggaaaaaaaaagtcaggacctatttctattttttttttttggctgtatataaagaaagttgatgattaaagctggataggtgaatgagggttcactatatatttacatactgttctttgtattttgtgtgtggaatttttaataatcaaaggtttattttcacaaaataactaccatctactaatataattttgccaaagagaaaataatactaaaagaataggattattcctaaatttgtctttagattgtatgtatttagcattatgaaaatgctgtttatttcctatgtc

SEQ ID NO: 79878 - DNA, 1155 bp, Homo sapiens
gtgattcagtcctttggaattgtcccttagtgatttctggctttcatttgtcttaacattctgattttctgggaaacccaaatgaaatttgacagacttacctagttgttttctgttgtgtcaactctcggtttgctgcctaattggtatgcttcacatgggtttcctctacccaggaatgtttattctcttccctttttaggaaaaagctgtattgaacaacaacagaaacatttgttttaaatgtatagtaatatgagagattacctgaagtcctaacatgtctgaaagtatataaagtctgaataaatgctaggaggagcttttattttgacataaaccagaggaaggagaattgctttaagtgatgtggaccagtccaaagtctgaataaaagttaatgaatgaacaatgtaaccaatcaatcatgctcttgagtctttcacaaggctaagacattctggatgagatcttgtagggatgagcagttgagaatttgagacggccacgctttgcaggaataaacatgatgctttaaagagttacatgcattcatggatgtgtgtgcatgtgagaaaagggtgattgatagatggggtgggggaatgataaatgatttgtttggcattttatgtaatgacttgtgatatattctggatttgagattaaatgcaatattctgaccttatctctgtgttccctgaaagcttgtaagaaaaatattttaaaatctattttcaatgaaaaatattgtttttggctctcagggaatttttagttcccactgctatttagggagaattgttgaatctgtgaaattcaaaggaggatctttgcagctctttgtcattctgtaccagtcatttaagggctatgacgtcagtgaagagaagttgttccatgcttccttcattaaaaatgtaacctgttatgcacttttgtcttcctgccaccctccattagctgattctttggattatgcttcttgatgactgtaggcatcatttggtctcccacctgcaggctccctgagtgactgagagttcttcttagcactgtcaatcaagattcctggacctaggctgcgctcctcactctgctgtttgtgcttagtaaatgtttcagaacaacaataacaatttccaggctattttt

SEQ ID NO: 79879 - DNA, 1036 bp, Homo sapiens
gcagaccccaaccgttcatcaagagagggaaacatcagtgaagtttacaaagcctttttacctgatcctaaatatttcccagatatgttctatattcttcagtttatttatctctaagggatgaggagtgactcagtctctcctgcaggagaacttttggctctggtcacccaggtggtccggatgcttggttcatttgccttccctttggagaggttgttgccggcacagagggtgagctgtgtgaacgtgggagtgagcgcttgctgtccctgttggccactcttgtcagaagtttggattcagaggaggtggattcaataccctaaactaggaaggaaataaaaattgaccgtggaggatacaatgacttgggcgttgttctgttgtgtttacatgtttccaaaaacactgcagtgccgaggggtctctggtagatgacaaatgagcagaaagaaagttgagaggaaggaggggatattgctagagcgggtagagcagctttccaagaggaggtgggatttcccgctgagttgatgtgagtttttgctgcttgtagttgaaaagactgaaaacaacagtgggttatacaggacagaagtttagttttctgtcacctagaatgaagtcttgaagagggctgttcaggactgatgggagagctcacagaggttgtgcagcgacttgggctctttccaggatgagtaaaattttggtgcggtgcagtgaaaccttacttggcatgaactaaattcagcacattaggcaaaaattccttatagacaaaattgttcgtgaataccccttaggaaggtgccacattagaggccagtattctgtctcccagtgagtccagcaagtggacttttcctgcagtgttggagtagcctgctgctaagcagttggcccctgtgtttaaggaccatgttttcaacaatggactcactctcagcatcaagacaggatcccaagaggcactgacaagcccagggcactataaattcctatattccctcccacggtcatgtggtctcac

SEQ ID NO: 79880 - DNA, 1038 bp, Homo sapiens
tttctatagctgtgtcatctgccgtgtagtgtggagtgaagtgaatagcaccctcctcgcagtgtttgttgtaaggtgatgctcagcgcaggcttggcacagagcaagtgctccacggtgggccactgttgttgtgtggtccctatcaccacctccgccgctgccaccatcatcatcctcctcctcaccatcaccaccaccgctgcctgtagtcttccgccccttcctcatctccggatgagttttccatatggttgggccactcatgcctcttcacagcagtaattttctcgcccgtgatcctgggtcccttggatgttacttcctttttgagcttgtggggcttgctcctgcccttcaagcacccttggcttcctattagactttctctttcctctggggaaaagatctctcttcatgcttaataggcatcagagcagccttgggtcacagaagtcatggtagctttctatttgtcatcctgacaacaaggcctctctgaggcttgaaaggatgatgctagcccacccgcaccacctcccttcttaattagattactgattccatttccctgatggttttaagctaaaagagctttattctgttgcctttggattgttctttcttgactccatctctcctttgatttgcagcaatacctgaagtaaagtggatgacagtagttgggagcatattggctgctattctttagcaaagcctccagaatgggtgtatcataatggagtttagagaaaatataaggaataataaacgaaacgtccaaaaggatccctcctttcaaactgtcatgtaccaagtgagtttctgtagaaggggcccttttggtttttagctgtgattttgtcttcattccttagggtttatttgacccctgtgtggaaaaggcccgatttccccacttccccgctcttttttgtgtgtgtgtgcacaagtccatgtatgtgtatgtatgcacatacacctctctttctgagttcaccatccacatgccatggggagtgcacccacacattagtg

SEQ ID NO: 79881 - DNA, 1115 bp, Homo sapiens
tgtcagccagtcagtacataaccttgttttatgtgtgtttctatttaaagataccttacttaatatatattgttgattcattaacattgaattcatggccaccagcctgaactaagcttatttaacacatgcattttctctgtaagatacatcacagcctccttctgcttaggaacgctagacagcacctcggcactatgtttaggggccattttaaacagcacaatcaacaaaaggcagaagatggaaaaagcttggcactaaataaactgtgaaacggagacgtttaggagactgaaacaagaaagcagagagttgctgggtgacctcagctgggaacatgcaagcctggcagctcaaatgttttgctgttctgcactcgtccatgagggactgcaaacgtgccaggagtattgattttggggtcacaagtaaattttaacatgtggatttgcaaatacaggctctacaaataatgaggatcacctgtgtatctctgtatgtgcacactgctgcagggcacacgcacgggtgtgtctaacttgaaacccgtgattcacaccaatacttcagattccagcttaacacaatgggcttccttctaatttttcccttttctgggccaccatggcaccccctcctgcatcccttcctggcacctgcctgatattttcccacctgatggctctaagcctgagtttctcagtaagggaagagccgtgggcaagaagcaagagggatgtgattatgtcttatgatgacatttatgttctagtgtgctaacttaagatagagcgatattaacatatttataaagcctctttatatcctcataattgaaaataatgcaagtgtcatcaaaattaagaaaaaaatgtttaagctggtgagccccaatgattgaaaaaaactggctttatgctactggtttatggcagtaccatgccatttgggaaacagaagcacctgctgttttctctaggctcaggtatggatgctgggtgttgtaagagtgtcaggagtatgtccctggctgggagatccactcttgttgaagtagcctgtttcccttgatagacagtagtccccagagggcaagggactgtgtctgattt

SEQ ID NO: 79882 - DNA, 1067 bp, Homo sapiens
caaattcccattgatgaggcccctttccaattcagggagttctttagtcctgccatttctttagggattcttaccttttatccctgtctctctttgactggtctgtgcagttcttctgttatttttccagctttatcttaagttttatatttatttttggaattgtttttcaagaataagtccaggttgtggagatacaacaaacgtgacagtatcttaaaacaatcctttaaaacactgtcctcaactgtgctgtagagaattcatcgtttcatgtcatctctcatggggacatgtttatttcttccttatgcttttgatgaagtaatatgtacgtgtccaggctgcaatttgatttgtttttttgctgtttgaaaatacaaatcttattcataactgactgatgaaattggtaagactttttatctggctttattttattaactaaaggaaaatgatacttcatcagcatacttcaatttagttaatattctttttgtaattcgggttcgatctggtaggcagttctaaaaacctgggcttgcagaaagcagcacgtggctgctcaccatgcacatccacatggctttctgtagtaaagtctagtccaatccttcttcttctctctgtcatttcgactgtttgcaatatattttaaaatttgtattaaacatttatcttttctctgcctcttttctgtaaatctagtttattgtctatgctagatggtttttctcccattcattcctttgtcaattctgtctcttggtctggtcccttgcagcttgagccctggatggcaggatggttctgtggggtggattgaactataaaacctggattgattattggccttctcagttgttaatgcatattcatttaactaacgcataaatcaaacagctgatacttgtacattcagatttcattatttcttgttgttttgttatcttctgggttgttttgtaaaaatactgatgattcctttaacaaaaggaaaaaattttagcttaagaaaataatctgaaataaaaaacagaagaggtttcaaaaaaaaatccttattg

SEQ ID NO: 79883 - DNA, 1927 bp, Homo sapiens
ttattatctcccattttgtagaggaggagactgaggcagatggcagttaagtgaccagctcaagtcacgcagctggtaaggcaggtggggtcagggcacttcgtggtcctcccttacaggcagagatccaagggaaggctgctcatcttgaccaatgacaggcatttattttgaagagaaggaggcctctgctggagctgaacttgtttgtccctgggtgaaccagggtgatcctgagcagcctgcactgctgccatcatcctgggctctttacagctccctgggactgaaaagtatattttaacaggacaatgtctgggtttcaccactggtttcgtcagctccgcttccacaaaggaaaccacagaagggttttgtgttggatcaagcaaccttcacacatacaatgagggcagaaatggtcagagtgagacaagattatgaaaagaaacacaatgcaggttttatgaatttatacccagtctttgagtaaagaaaaaacaaaaacaaccttaagatccaataagatagtagtcattcaaattcgggtaaacgaaaaatgaacaataagataaaatagaaaaagggattagactataacaacactgcaagaaattgtacacagatttggctctgaagtttcacgcagtcaaactagaagaggaaacctgatcagcaatcctaacctcagagtctgcaccatgaaaagcccggagaggggttcgggtgcagaagagtagacgccaggaccagttgcaggctttgctgccctgaaaacatcacagtggacaaggagcataaatctttatcgaggtgtgttgtctgagctgcctcattttcacagggcttcagtggatgtaaatttctcacaagtgtggaaaatacacactcatctttagtctacatttctaggttgctatatgttctaatcctactttctttttgttgttgtttttgtttgtttgtttgttttctgttttttttttttttgagacagagtcttgctctgtcacccaggctggggtgcagtggcacaatctctgctcattgcgggttcaatgagcctcccgggttcaagcgattctcctgcctcagcctcctgagtagctgggattacaggtgcccaccaccacgcccagctaatttttatatttttagtagagaaggggtttcgccatgttggccaggctggtcttgaactcctgacctcaggtgatctgcccaactcggcctcccaaagtgctgggattacaggcgtgagccactgcacctggccttaatcctactttctttttgctatagggtaagtcatagtacttgattccaacaagtgtcctttttgccaggtacttattttgttgtgagtggtgctagaagcagctcattgctgtggttcttgtggggtggtgaataaatcccatatgactgggtttccctatgtcagtgatcatcttgggtgaaaataattaaaatatcttgtctttaaatataatgttgtagattacaaagtattggccttttagagacattcctgggaagtcagttgttggccttatctcaagcttggaaaaactaaatcttaataaaatggggagccagaagtgagaaggcaaccctggggccttttagtcttacactcgtgtgcagtgctctgtaagaatgattagtttggttccaggatttttttttttttttttttttttttttttttttttggtatattgtgttcctgtgatgcttttttgcaatagttgtttttgggtgataaaaaaaaagttgaggccacaagtctcatagtgaatgtagtatttcttgtctgttgaacacctaccctgaactaccctccattccatgccctgccccctcttgagatgtaaggatgaggagactgaggatccaacgggtatagttggccaagcattgagta

SEQ ID NO: 79884 - DNA, 1123 bp, Homo sapiens
tgctgagtcagcaggctcagggcctggaagtcagtgatggcttcatcaccactttgccttctgtttttcttcccatttatatttcagcttctgactatggactctttctttcggatgaagacccgaggaaagggatttggctggaagcgggcagaacactggattactacatgttgcggaatggggtatgctgccaatcccagtgctgtttcttcatccctttgtccctgggccttcttccatagacgccaacacggttacgctattttgattcaagggcatcttattaatagttcgatgcattgtactttgtaagggctgttcaggtggtgatagaaaatgtcagatatccaaattcttgagattccatagaaggattgaagcagttcgaggttagtattttaagtagtttctacttgtcgttgttggatttggtaattgtgagataagatacagcatcttactgtaagtatggaagagatattcctatgcctggagatgggaagtaagaacaaatgagagggaaaaacgaaatgtaaccctaatggtagttagagactgaatattagtgttttgtttctgaaaaagaaacttcaatttgagatgtgagtttaataatgatcagtagtagtaacagcaacaacaaaaatggttgtgttatggaaatagggagaagtaatgagtaaaaacatattaaacattttgttcagcttaacctccaagataccgggttttggtatgtagggtgaagtgcacccatcagattgatgggtattccataaagtaagagtgaaatatgtgatgccaattaatttggataagaaatgaatagtttagttttaggaagttcatacttctagttttaggaagtgtagtaaacaagttacttaaaaatatcccccaaacatgttacccctgtttggtcttgtcattaatgtattttaacacactcttttgaaaatcacgactactgtgatactccactaatatgaagaatgatgaggatgctatttatgtctttcattatttctaagatataaggtaaaatgtatttatagtaaaaattaaaaatatttttatatgcaaatagtaaagacatagagatagtaaaaattgcttatga

SEQ ID NO: 79885 - DNA, 1067 bp, Homo sapiens
tcccaaaaattattatagatgagagaattgaatgtgacataagttctactatacgcgtgacttctttgggtacgatttcactactacatttttaggaaacctttatgaaaggaattacttagcactggagattctgtattgtagtgacaataaccctgtgaaaatgtaggaaggtttcaaagacattttggaagaaagaggaaatcagagtctgatttttaaaaattcgtttttgaaaaaaaagtgttcaagtttgttacctgttttcccccacagtgtgaatatgacttaactagctgaagcttcttcatttaatttgatgtggccacctccctgaccctcatatttgtaaggccgtttctggttctttgccaccaggagctccttggaatatcacaggccttaggctggaagaggttgacagcagtttaattatttataattataacctaatttccaatgtttaggaataacaaattatgaagaatactccttaatccaagaaactattgaagaaaagaaagaggaaggaacgggcacactcaaaaaagacaggacactgttacgagatgagaggaaaatggagaagttgaaggccaagctgcacacagatgatgaccgtaagtgtttgcagaggaagcatgatacagacacacaggctttgctaagcctcacttccctcccaccatccatatgacccaggacaggacttttgatttttgtttttaaaactctattttaaaaaagtaggctgggctcagtggctcacttctataatcccagtattttgggaggccaaggcaggtgtattacctgaggtcaggtttgagaccagcctggccaatatggtgaaacctcatctctactaaaaacacacaaaaaattagctgggcttgctggtgaatgcctgtagtcccagctactcaggaggctcaggcaggagaatcacttgaacctgggaggtggaggttgcagtgagctgaggtcgcaccattgcactccagcctgggtgacagagtgagactcggtctcaaaaaataaataaataaaaattaaaaaaaaaaaag

SEQ ID NO: 79886 - DNA, 2099 bp, Homo sapiens
tcctggtagccaacactgtgtccctctctgccgggctttgagggacagttgtatttcacttaactggctcaccatttcaagtgcactaaaggtttcttagctggcatcttagaatgcaagagaatgttggtcagaaatcaggactctcattaactggaagatatcctctcaataacctttcatgtctttacccttaactaattgttaaaactgacaagtcatttaacatatctgagttgcggtttcccagtatgtaagatgtggattgcactagattgtccccaaggtttcttgtggctcaaggaaaacatcatccatctttgtcctctcctaccagcttcctttcttcctttccttccctccctccctttcctctcgttatttatccatctatctgcccatagaaataatgtaggggttggcaaactacagtcatgccttttgcctgtacttgtcaataaagttgtattggaacacagcttatgtattcaagtattacatattgataaatccccttgagggttatgtaattgttacacatatcttctgtggctgttctcgcattctggtgacagaactcagtgacagagactgtgtggcccaggaggtttgaaatgtttactatttggcctttagagaagtttcctgacccctgagttagtggacggaaggatggcatggaaagagggctgagaggaaagaagtggggaggccaaaaggagagagatagcagggcagtgaaaagatgcttgttggcttaaggcttagagtgatagcttggagtgtccatcttagggtgatctgggggtcatttagagaaaggaaaggctgaaaaggtgggggggggaagcaacagcagtgatggatggagaaactgggaggaggaggagttcagacacaacaagctccccattttaggatgcattcgcttgtcatttcccctgctgtcttgagtattgagttcttgtctgtgtgtgtgtgtgcctatcgcctttctttctcttcctctattacattggtttttatctggggatgggggttgggttgattttacctctagatatttgattagctagctttgtgatttaggattgtaaaaagtacactgtatttgtcttttggcctctttgaagctgatcatttcatatgagtttcctttgcctctttttataatcacttctgcctttctggactgtcatcagactttgcttttgctgtactggacacctctaatgttttccatctacaggccattttggacaaaagtttgtttttcttttgccttagttttctcccatgcggtgatcatccactgtgtcctgcacatgtcaccgtgggttggctggcactgtcccctgctccacagagggtgtactgggccatgggaatgcgtcagtggagagaacgtgtcactccccgaagcctctgatgcttttccttcctcttgtgtttcaggcacgggatgacatcctgaatggctctcaccctgtctccttcgagaaagcttgtgagtttggtggatttcaagcccagatacaatttggacctcatgtggaacataaacacaaacctggatttttagagtaaatgacattttgtttctcttttttctcttttctcctgtcttctttctctttcagctttttatttttgagctaggtgtctaagatcataccctaatttcaatcatttgtgagaatgctagcttttcttccatcgagtagatgaccaaatttgcagattttggggaaagcaagagaaattcagaagtttcttttgctgaatagaaattcagtgatctgtgtccccctccaccccctttttttccttctacttcgtcttagtgaagaggaaagtaaaaaaaaaaaccaaaaaaaaaaccgctccagtagggccaaggtgtgaacgccagtgtgggggttgtggggaggacatgagctttcctgtaggatgtgccagtcagcatgagatgtgtccagcaggccattcttggtattgtgcattcattgtattgtttcaagtgtattgcagggagaggataacggagaggcttctttggcccttgaccccagtttcactttggtggaaagtagttggga

SEQ ID NO: 79887 - DNA, 1004 bp, Homo sapiens
gcattggtattggtcttaaaattaggtcctgcagtttgtggtcctattgaatgctccacactcacactccagcaacagtattcttcccttaataatctgagaccacaagagttaagcaattgcattgagtttgtttctttttttgtaagattataatatcaagtttatgcctgtagtggtacctgtacccttattcagattccaaattaaaataaggtggttttgcctggtggcaattgtttttccttatgaatttgatttactttttaattaggccaaattaggtaatgaggcatttttacttaatgtagatatttaattgggtacattattgcttataccatgcaggtaaaacttcttgaggatataagtcccttcttaattaaaacaaaacagcgaggccacattttgctgatttgcgagttggatagtcaggtcctgtttttacctgggctgtccctggtgactggctgggctctcttttgcagcctttatatctttcccaatctagctttcatatgtgtgatctgcttaaacaatttagggttttaaaataataatgagaaggttggacttgtgacagtcatgctgaagatgcaacccccagaaatttcagttacgtagtttctgaggcaggtacataggaatgtgaacaagggcatatcttttaattttttgaaaatttgctcagcatttttgctcgaagttgcaatatggacatttttatgagattcgcttcgaactttcttcagactctccagtgatttctggatttgttactttagtgaaggtactcatttagaataatgaaaatcatcagagcttgaaagattttcagagttttcagggatttaaggatgatttaatatatccatctactttattgatggggagaataagtgctagagagagacagagacaaggcccagaacagtcaagtgtggggagccaggaaaaagccagttctccttaattgagtctgatgtgctttatctacatgacag

SEQ ID NO: 79888 - DNA, 1028 bp, Homo sapiens
cctctgagtgaaataagccacacagagaaatgaaaatactgtgtgatctcacttatgtggaaccttaaaacataacaaagaactcaaatacatagaaacggtaggaaagtggttactgagggtggggaaatggggagatagtggtcaaagggtacacaggctcagttacatagcataaataagtctagaggcctaatgttccttatgtacagtgtgagggctatagttgatactattgtatactagaaatttgcaaagagtaaattttaggtaattttacaaaggaaatttacaaagagtaaattttaccacacacatagaaactgagatgatggttacattaatttgcttgactgtagaaattccttcactatatattatatgaaaacatcacgttgtattctttgaatatatacaataaaataacaaaattgcaactcatccttcaaatagtagaaaatgaagttttggtgacatctgtgtttgaattcagatcctgctcccctaaatgtgttaaattccccttccctgattccactggcttctgggcatttctataaaactcagtggccaccacctggtcttcattgtcatattctgattattattttattccacagggtctgaaatactgatcacgtgggatgttgtttgcctacagggtaacttggaggggtcagggtgcgtagtggcccagagcatggtccccagtgcccacggatgagacggcgtgtgtgctgtgaccctgggcaacttagcatcgctgagcctcagagtcagtgtgtagaattatctaaagggcttgttacaagatgccggcttcccacggcttttgtcagtactcagttaatctgctggtgcttgtaaagcacctgaaacagggtttggccttcagaaaatggcagctgttttaattgtagaaactctctctcaacctggtttggactattagttggataatccaaaaagtcatttaaaatgtagaatcataacaggtgacatgtaccacttgaaacccattattctaa

SEQ ID NO: 79889 - DNA, 1011 bp, Homo sapiens
cattaccctgtgttgggtgtgtgtagacacatccacaaatgcatagatactttgtgtgaatgtatatatctaggcctctgagaatagcagtttaggtgttgttgctaggtttcagcaaatatgagttgaaaaggttttcctgacagccctaaaaatacacacttaatagtgaaattttggaaataaggaaaagcatgaaaaaataatacaaaacacatgagatgttcagtgcctttttcatgtaatggacataggcctatttttaaatttttatttcctctaagattaggccctatattctgttttttaataatatattatgaataatttacttccataaaaccaattgtttttctacaatatgatttttaataatgtagggtaatctgttatctggatatatcataatttatgtatcaagtcctgtgttattgaaaacttggattgtttcatctacagccataccaccctgaatgggcctaatgttgtctgaaaattgggtggtttctagcttttcactatgatgtactgtggttgagcttcatgtggcataatctttacacacatttataacttttttttaaactaaatttctcaaagctagctgtgtcaaaagtaaggactttttaagggtttggatagatagtgacacattttcccccatgaaggctttgctatcttaagctttcatcactagtgacccgcttcacatcttcctcaaatctgagtattaattttaataagaaaccttagctattttaagtgaaaacttatttgcttatttattttaaaaacattttctgttcatattcttcagcagttattttgttgatttatgaacacatcacatagacagtatatgaagtctattgccattacattcattgtaaatatttattgcccagtctttttcattttttatgaggtttctttagcttctgctctcctccccctggtctatcaaaagtatgtatattttgagttaagcatattaatcgtttcctttatggc

SEQ ID NO: 79890 - DNA, 1076 bp, Homo sapiens
agactttttaccttcagatgatcagcgtcctttgcacttattcttcattctaagacaatatgaagtaaaaaatgcaattttttggctgggcactgtggctcacgcctgtattcccagcactttgggaggctgaggcgggtggttcacctgaggtcaggagttcaagaccagcctggctaatatggtgaaaccctgtctctactaaaaatacagaaaattagccaggtgtggtggcaggtgctggtaatcccagctacttgggaggctgaggcaggagaatcgcttgaacccaggaggcagaggttgcagtgagccgagatcacgccactgcactccagtctggatgacaagagtgaaactctgtcttaaaaaaataaattttaaaaaatgcaattttttccattagataccttaagaatcttcccaatatttagttgaaagcatttggggaaggttccaaagcctcacatggttgaggctctagaggcgatgaaacatcctctgtggtcaatggtggtggacctgaggacccgagggaggggagctaagatgtgggagattttcccctagcttcatttccacatttcccctttcaagctaaagataaatgatctgtatctctgatgcctagaatggaacctggcacaaggttgatacttgtttaatgaatgttctttcagatattatttaccaaaaataatatatcaacatatcaatacattcacttaaaacctggaacatcattattatgggaatctctgtgttgttgtcattttctcttcttgagacagagtctcactcttttgcccaggctggagtacagtggcgcgatcatagctcactgcagcctcaggctcctgggctcaggtgatcctctcacctcatcctcttgaatagctaggactataggcatgtaccaccactcgggactgagttgttgaattttttgtagagacgaggtctcattatgttgcccaggctggtcttgaactcctaacttcaaggaatccttcccatttggcctccaaaagggctgggattacaggggtgagatactgcacccggccttgtttttt

SEQ ID NO: 79891 - DNA, 1059 bp, Homo sapiens
tgcctcctctaccctccatgacacctcctttttttctttttttaaacattcctagaaggtactgccctagagtatctggcttgaggtggcagtttgggaataggggatgagttgtttaatattccttttttttaggacaaaatcagttcttactgctgtggagacctcgctgcttaggtctctcctctctacctcttgctgcccaggagccatcttactttcttttcatctctctatagcctggaagcaagatggtgtcctctgccaaagccgcagtgcccaccgtgagtgaccaggccgcagccatgcagctgagccagtgtgccaagaacctggccaccagcttggcggagctgcgtaccgcctcgcagaaggcaagtggagcgtgtcataggggttaacttgtcaggaagggagctggggtggcatgggtaccacccagggcctgaacactgctgaacctatttcttggcaaagttgtccattctacttgcatgactattaaagatgcccctgtgggttggcttttgttgcattaagccactatctcccagacttagtattcactttttgatttcaaatgcctttcgttgaactattttgagttgtgtacttcctcctcctcctcctctttccatatcctggaacaagcagtggtccatttttcacaagtcttaggggagaatggtagtcatcagtgtctcagtgccagctaaattgtagtccagaataagtgatcatatattccaggtatcattttgtgaacttaataacaaattatataggcagaaaatctattttgaagtgtcatctttattatcttttttgccctgcaaagttttcacttattgcgtgggagcattcaccttaacaaggtcttcaagagaacagagttgaggactaaatttctgtctctggagcatattaattaccaaagggcctcatttactactctgtttgatgtggtattagcatgaagttctagcatgaattcacttttcttcattgtagcaatccctttatagaaacaagcagcctcataaattggtaagagaagaa

SEQ ID NO: 79892 - DNA, 1009 bp, Homo sapiens
gagcatcggggagtccagcaagaagctgcttgtggattcggtgagaggttcttagattgagaaaggacactgggggactaggctcgcgttaggtgtgagtgaagtcttcttctctccatgagatctctgagcagctaacccttcctttaggagtcctgtttttcccgccagtctttgttttccatgttttgctgtctgatcaacaaagttcccaggtggagcttttaaagtttactttttctttgagcccatgttgccatttcctctcggatcgtcccggtgagacaggcaaaggggtatgtgatcacctgtcttctcatcaggacatctcagatagtgacagtcaggtgttggaagggtacgtgtgtccaagcctcagtgagagagcgagtagtctgaggaatttcaccttggggcctgttcccttccctgctttgtgagtctgctgaaggagggtttgtgctggtgcatctttgtttcttctctgcacaggtatagaggcaatgtttgtgggtgatgaatagagtctagcttaactccctagaacttttcacaaatggttatcagtctgctagatgacatttaaaagttattagcaaaggccactaatataattggtggctattagtttggaagaacgtgatttgaagtttgagagcatctgccttttagtttacaaagctaaaacttagctttcatcttaacagagacaaaatagggtagagttttagagaatggaccctggagtcggattgccttggtgtggatcctgtctctgccacttaggaaaccttgagcccctgtagatagcttacatttttagatccacagtgtctagcactgagcaggtgtttgatacatttaaatgaatgaatggatgtatatgttggtggtcaaacctattaataaaatgggctcagatgactcagagccttttaatcgtgatgactcaaatgcatctctgaagagtctgtctcccttccacaataccttccttttatccctcccc

SEQ ID NO: 79893 - DNA, 1050 bp, Homo sapiens
ctcaagaatatctcgatggcatccagcaagctgctgttagctgccaagtctctctctgtagatccaggagctcccaatgcgaaaaatctcctggctgcagctgcaaggtaggagtgggacacaatgtgctttcgtgtgtggttagacagtgtcattgcagtctgaagatgtgcctgacatcctcccacttttgctgagcaaaagaattggtgctgtccttaggtcatgggaggtggagctgagagtgatggacactctgatattttataaaactggctcatttccatgttctttccccactaaaaatatcttctgtcttctcatacagccttttcagtagagacttgtttagacgtaaggtccattttgacttgtaaatgcaatgaattaaacagattttttttaagtagcattatatctttctgattataaaatagtatatatgcttcttgaaacatcagaaaatactgaaaagcgtaaagatgaaaagcagtgctcatcaagtcattcagcagacttttattgagcacttaaccctgtgcctggcatcagtgttagattgaatgtaacatgttgtatctgtcacatggggaaggctccactttaagatgagtagggaggcagtgggaataaattgtttttggaaatatattaaaacatgagtgtgaattttggatgatttgggtgtccttctttcctgttggtttcacccagggaagtggataaaacagtatagtttctgctccagggccacaagttagttcagtaactagtggttgaatgtggtatgtggagcactgcagtgacagcccagggggttctcgtatcagcagcccctctttcattttcctgaacccagagagtagggtggtcatgattctgtggtggtgcaggcatgtttttttagcattatttaccatcatattacgtataagaaagctgacagtggagagagattaaaagcaggactattaggggatagagagtaattggaggcctttttataatgtgcagattcgtgatttttgaaaagcatagctttgattctgc

SEQ ID NO: 79894 - DNA, 1042 bp, Homo sapiens
aggaagctgggcagaagggatctgatcatcatagtctcagtcctcagtcctctgtcctccttgttcttgagactgtcaggtcctgcctgtccttcctgtgtgtatcctcaaagtccccagaaatgccactgcggggacccaggcctggaccaactcagccctgtcccactcctgtgttaacagtctcaaaccccttattatttgtggtctctgtggtccttcttgctctgggaagaaaaggtttgcttctggagaaaaaagtagaggatgtctttttcctctgttcttaattctgcttccgagcctgggtacgtttttgggaccctacctatccccttggttttggatgcctaggggagaggaagtcatttgctatttagtgcctggtttgttcattttcttcccgtgtaactgtttgggttctggctcttttctgacaagttgggtggagctggagaccctttgtcacccattcatcagcctttttcccccaaccaggggctggtcaggtgccccctaaacttagtcaaggaaatagaaagctagcttgcagttgccaaaacgaagggggtatcctacctctgaacaccttccctgaatcactgctcaccaccacagtcatcctggccagaaggactccagaactgagaaggctttaagcccacagcggccagcatcacacccccgggccaggtttcagctgctttccagtccacagaggatgctccctaggaactcaaggtagcacctgcccccctggctcccctttggtctgaggttcttgctggacggggctcctcctgtccccaaagactgtgaagatggatggtctagcaagcagcacaaacgagaagagtgcatttgctccgtaaacagaaaggtgtacaagagacctttgctctctgtgggtcttacctagaatgtttccttccctccatccaaatcaggatgtcactcagccctgacttttccaattgcttcagtctacatcgagccctccctttcaggcagactctgtgcccggcagctgaggctttcattt

SEQ ID NO: 79895 - DNA, 1031 bp, Homo sapiens
ttatcctgctgagaagttgtgctaattgaccacgcatgtattgccttgtattaatgttctaatatgttttaaatgccatccttctgtgtttaccttgtttcttctccttcaaaactgaaaacaagagattctcatctctggccaagctaaccagagaccccctcccctataatgagcattgtgttgctaacaggaaatctgaagtcatgataccatgatgtaaattctcaaacatctgagtaaaagtgatcatgaccagaaacttgtgtatggagggagagttgatagttggcagttgatgttgaatttcttttgctctatgacatttgcttgctttttatgttgtgttcttcttctgtagactgtgaaggggatgttggacaatcctaatgaacctgttagtgacctctcttactttgactgcattgagagtgtgatggaaaactccaaggtaagactgcctatgccgtaagtcagaagttagcattgcttgtcaatgtggggagaagtttagacgtgccttctgtgcatctgcctgtggctggtctgcagggctagccacatgtagcatgaagcctatttgtggagccctttgctcaggagcttctcaaacttgacggtgcatcagaatcacctggagggcttgttaaatacagattgcctacccccaagtttctgtttcagtaggtctgagaggaagctgagattctacatttctgactatctcccaggtcctgcccctgtggtccaggaaccatactttgagaaccatttcctctcttttttcacaaatgggtcttattgtaagtcaaatcgtgtattttctacaccggaactgatttggaaagtccttcagtaacttgacttacgtgggatcctcttatgtgttcttttgcagtctattcatggcatgcattctcaaggagggtgaaattgttttgttttgttttgttttggtaggacattggagagatgttgaaaaaaaattaagataatataatggcttgttaccctgctcctatcttaacctt

SEQ ID NO: 79896 - DNA, 1046 bp, Homo sapiens
tttcttttaaccatgaggatgtgcccaagcctaaatcccagctgccacacccttatagtcatgaagaagggaggggagccaccaagagaagcacgagggagcaggagcagattacctcacacagtggctcatcggcatcagtcactactgatggcactctttaaaatcccagagcagggctccacgagaatccatttctgtgtttctgcctcctgccagggatggctgtaaatgctgggcatggtagaaggatgcacacccctaaccacagcggctgtctctccgagtcaccacatacgctgttgcctgcctttttcctttcattcagctcattacctagtcttgaatcagatgtgtggaatggaatgttattttaaatgtgcagtcactcacatttgggtgccaagtagaaattatgcaacagcagcgtttgtttttctgagaagttgaagtttggccttgcccctcacagcagagttaaagctcggggtttttgcaattaagcactttcagtgtgtaccacagacacccgatccagctctctttaatcgaatttgacttggctgtgagtatgctttcttggtcatccctatgtttggattgggaaagtggtttctttagaaggaaaaggaaaaaggctgttgggctttttactccttgttctgttgcctttgtctaaggtcagcaggagagaagggagccaggaggctcggttcattgtttgaggcatgccagtgagtagcaaggtgaccttgtcaagtcatgtcactttccaggtgctggttttattgtctggagaattgggagtttaagcttaaattgtctttagggtcccctctaacccccaaagtccatgaatctgactttgtgcatacacagaaattgtttctcccagatgtccgtggtattttgctaagggggaacacttggagcaggctccgggcttgggagtgttcttgttctggtggggcctggaaatatggctgagtaaatttaccctttcatcattatggctggtatgccagatgttctgtgacatggaaact

SEQ ID NO: 79897 - DNA, 1837 bp, Homo sapiens
tttttttttatcccaattgtctaaattggctttatatgttgctcataagggttaagttaaaagtttaagtggtcatttaacaaggaaatttgcattcttctgcaaacataactgccttgtcaagtgtagccttttgctgggagggagggtttctgtcattgggtcacaggctgtaggttctaacagtcttgatcctgaggaggtagagtccagggctgggaacctcatcgaagtgttgaccctctgttagcagtctagcatggatcacaggccacattcctggatccttatccatccagaccgtaaatcagcaataggcctgatcatgcaatgccattgtgttacctgctgttagttttttgtttttgtttttttttaattatgaagcataagatacacacagagaaaacacgttatgtttagagttcagtgaattttctcaagtggaacaccccttggtaactctagccagattaagaaacagaatgttattgacacccagaagctttccttatgctctctccggtcttatctgctcttctaacaccctagattaggagggtcacctgtgtttgcacttggtactaatggaattgtacaggaggcacccatttgtgggtggcccgttttgttaaatatgatgtttgtgagatttatttgtatggctgggggtagttctcatctattccttctcattagattccattgtgttcatttcagaatgatgacagttatgcctgccttgcctccatcagtcattagggaatatccaggtaaaacttagaaaaagttaaaagtactgctttaaaatacaatacggtatgtttattgtttggaagagaatagatttaatctgagtaaaatgaaggcaaagatcccaaggattgtagtctcaaaagtgaggaggaaagtagtcccgctgcatagtctggtgcagggggtcacggggcgttgaagagcagggtgctgtttaaatctgtgtctctgcttcctgggagtggaaagttgactgtggagtcagttgtcctgtgagctacacatttaattctccacaacatctaactgggcccctctgcttgatggcaggggtctctttcatcagttcctatttattgtttatgaagtcaccagagattttcagtgttccggttgaaccaccttctttcactaagaggtgattactgtggttcagaaataatttgtgcttctcaattgggcagaatctccctgttttctcccatcaggccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgaggtagggagtgtttacaggaacatcatactaaggtctttggctaactttgtgtggcaccaaatgagttactagttaaaactccaacagctctctctgtcaacatgtaggctactgttactcttgtcaatgatggcatgtgcacagttagtgaaacacaatgactacacctctgttgagagataacatatatgtagagaacaatcttactgcctaggtttggggcgattcttgggatgtgtcacactcaaaaaatgctatttaaggggcaaacatgggcttgagtccccgccatgcagacccctggtaatccagtcttcatggttccctgccctctttgtctccttcaaagggcagaggtggtgatttggcaaagaacaggacctttcagggcccacgtcattcactcatgtcttcgaccctgactttgatttctctgctgtttggtctcaggg

SEQ ID NO: 79898 - DNA, 1038 bp, Homo sapiens
ggaggtgctggctaaaggtttgatcttaagttctcttaaagggtgtaatttagccattagtcattaccgcacagaatgaggcattgaacagaaaagtgtgattcatgccattgtattttatctgagtgaggatagattctgagaggggatagattctggtgtctgaagtgaatatagcaaaatgttaagatctcatattctgatgccaggtagagggtcatccaaacaccaaatgataaacttctaaaagtgcggtgctcccacagcagcaggactggcatcccaatgaaagtgaaagagaccacagactgtggcagctgagagccagggctgtggggtgggatgccgctgtctccacctcttagctgcatgagatggagcatgcgtctcaacccctcaaagcctcggtatcttcatgtgtatctgcctcttaaagttgtggaggctcagtgaggaaatggaagttaaactttcagcagagagcctggcatagggggtgcgcccgctagatgtttgcaacacatggcccacagcgcccagctggtaggcgagctttagtgagcgtggatggatatgcatggcagtgccctcctggaaagaggcctgtgcggaggcagtggttcctgtcgggataagctttttttgttctcccaagttgggcgaatcataaacagagcatctaggctgatgtgaaatcatttgtgctgtttttccaaatcaaggcttggtcaaaatgctctgggcaaaaggcagttgggattggcttcctacaaagcttttgaaggtttctttcatctcctgcttttttctgctcccctgctaccttacccttttccactcctccttcctcctgagtttgtaagatgtctttagttcttttaaaagttgttaatttatagaaattgacagtttgtaaaattgaattcaattctcatatctaactctggatcttggaatgggtttcttagcacctctgccatatttagagagatgaagaactccctggagaaagtaaaaaccaagaaagagtccattaat

SEQ ID NO: 79899 - DNA, 1123 bp, Homo sapiens
tgcctggaagttaccactgaaggactagagatcagagtttaagtaagcagcccgaggttcattcacaagccttggaaacacattttgaatacaaatctcctacaccaatatgtccccaagccttcaagggacatagtcccattgtctcagttcttccaccccacagtgatcttgcccttctctcagttcctattgcatttatagtcaggtgagcaacaatttattcctagtgcttctaattccttctattccccgattgtgctcataaagaacggttccgtggatagccatggactcgaccattcctcaggaagtgcttcctgatggagagtctgcctcctttcccacctcatcttctggcactttgcgcttccctagaagtgtcaggctggctcccgcctccatgtacgtgaattctgttcccttttcttgggatgcctttcccaccttttacatgtggcagactcttcgcctggtaagacttggcggaaacatcactcctctggaaggcctcccactcctctcaggcaaggctgggagcctctccttgccatgtaccctgaatgccttatgtgcccttctgttgaagtccttattgcacaagttgggtaattgagttgacactgggcgaaagaatctctgaggccctctctgtttttcaaagttcctaattctcgtaaatacagtctacacttcagcaggcttcttatgacctttggattcttttcctctcctctgtagctggatgaaggcactcctccagaaccaaagggaacatttgtcgactatcagacgactgtggttaaatactccaaagccattgcggtgacagctcaggaaatggtaagagggaagagagctgccctccccactgttgtttgcctttttatccactgccgccgctgagcctgcaaatcccagatctgtgtcagagagagagcccagaccactctctagtccctcaggggctccagcttctgtcctttatctgtggtctttctggctgcctgtgtccagtagccccagtctgctgcagttcttttctcatgaaaaagctgcaagagggaattaaagatggctgagacttgggcatgaggacagaggagcaaaggaaggagagaaa

SEQ ID NO: 79900 - DNA, 1041 bp, Homo sapiens
ctctccccctctcccctgccctcctggctctctcagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtaccagcagggcctggggagtgcgtcctcccggtcttcccgtgaacgctgcacatcgggcctcagaagaggcctaaggcagaacaggaacttttgaagtagacaatgtgtgtgtgagtgtgtctggtttgaggaaccggtaggaggcagtcatccaagcgagatagtggcacagactgtggtggtggccatggggatggagacaagcggagggatttgagaagagtctagaaggaaggcttggcctggcccggtgaaggctggagcacggcatacctgagggaggggaaggagtgaaaggcggctccttgtgggccagagcagggcacaggagctccctgaagggagagctggtgtgggcagggggaggtggaggagattgaagtgccggagccacacacaggtagaactagtgagtgcgcgtgagcctgcccaggcacggggctgtgggttcagcgactgttgccatagaggtagcgactgcaaccacacgagaggaaaagccagggagtcggggcagagcctggaggaatccagcatttaggaccactttaccgtgcaagtggcacaggagacggagaagcagcagctgctgcagggaggaaagccgcgggcatcatgttgccaggatggagtgtttcaacccaccagagacagagttaagaaagagggaagactgggaactggttattggcctgttccggtaaccatcgagtgccatcgaggacattggtgtccccagctgcttgtgtggagtggtggggcagcagccagatgggggtggggaaatgaactcagcacctgtagatggcccaggtgag

SEQ ID NO: 79901 - DNA, 1160 bp, Homo sapiens
aacatccttcccttgtcttgagcttaggggaaaatcattcagtcttttgccattaattatgagtgtccgcaccatacctttaaccctttgcttattcatgctgtgttggccactttagagaaaccatttaacaatgcctatggactgcttagctactgagatcctgagccataactattaataacctggtagtcgtacagcatatattgttgcagacaaatatggtacaagccttttgcaattaagtggtgacaaatgccaccatctaagtctagagcagtggtttacaactatggccacatgagtcacccagggaacttaaaaaattcttatgcccaggctacacaccagaagaattttatcagtagctctttatatatatatattaatttatataacctcaccacagctctataaaggaagactgttgtggtcgcttaataaactgaggcttagagagaggataagtacctgtacacaggtacattgatattgactgctgaacctatgcctaactaaattgcctgcccactggctgtcttggaaagtaaaaggcatttatccccttccttctatttctccatggctctagtgttcttttggaactggtctaggaagccatcatagtaggacttgtcccaataatgtattggtttgcttttcactcattaattaatttgttcattcaaaggtctatgctgagttcttaatatctgcagaatgatatatatataggccctagtgtgagagagtgagaatcacagagcacctggaatcatcatggaacagtagcaaatatgaaagaagtataaaagattataagaggagggaagatgaggatagatacatgtgaagtagtgctcaaagattattgactaatccatttgtgcgtacgcataatgtcatctgtacactgccgtgtctagggctggtcatggtgtaacccattgactcctctcatcggtttttttctaagctttctttatagtcatggtgcaaaggggttagtcctggggtctaaaaaccatctttccagattcctgagaaagactgtgctacctgggcaggggaaaggagtgtggggcaccaagaagggaattcacatttaatgaatgtctattgtgttccaagcattgtgagaaatactctccatgtgttat

SEQ ID NO: 79902 - DNA, 1074 bp, Homo sapiens
gagctaagaaagctgttccggatgtgctgcagtgtcccacggtcgcgggagccgtggagctcacatgagcagtggggtgggtcggagggttttctacaaagtgttaggtccatccagcttgttgctttctttctagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtg

SEQ ID NO: 79903 - DNA, 1062 bp, Homo sapiens
acaaaattctttaaaatatgtccatttacatgtaacatcacacaagtatgcagagatttgataaatggaagcattcctctgcctgcctacattggacggcagggaggtttgcccgaagcatcgtggtgatgaataccagtggtgcccagcatccaagatggccccagtgagccacagctcctggctttcaaggctttgtatgaaagccctcgccacattgaatcaaggatgtctgtgtgaccaacagagtatgatagaagtgacaattaggaccaaggctaggtcgtaaagggcattgccatttcagcctcagtctcctgcattgctcactctggagaaagccagtaccataccataaagacactcaagaagccctgtagaaagactcatacggagagaaacggaggcctctggccaacagtcagcacccacttgccattcctgtgagtgagccatctcagagtggagcctctaatcccagcaagcacttacatgcagccccagcagacccttgacagcacttcaggagggaccctgagccagcacctccagctgagcctctctaaatccctgccccacagaaatcaggagaaatttccaatgattagtatggaagctgctacgttttggggtgatttgttatgcaacaattaactgttgtgggcaccctacatgtgttgtggggcccatgggagcgtcatccactagacaacggtctggctataacagcatttaaaaatagaggtaccaattgtgtgttcgatttaaacaagaagtcatgtgctccggcatccttctgtgtgaggagcacaaccactcctaccacatcacacacactcaaattgataacgctacctgttttgtagataatatttagtatgtgagtgttgtgtacgactcaagtatgagtcaagcatatgtggaggttttcagatgctatagttttaggatttaattttggaggaagtgaacttgaacagtttcaaactgcataattaatgacattccattttcatgacaactactaattaatcttgcctgttatcataaacttttagcctg

SEQ ID NO: 79904 - DNA, 1229 bp, Homo sapiens
tggagttgttacctaagaacaaagatggggcggaatggaggctacagcccgaaagccaggccagcagtggcgttcttctgtgtccccaagtagtggacttgagcccgctgagacctcggcaggagtctcgtcccagggcaggtgggtgtgcggggtgagccgcggagcggttccagctcgggtaaagaggaagttacctcgggtcctttgcactccaactcggcggcgccccgagcccgaggggccccagccaacccgacgcccgtgtgttgtgtgtgtctaacacccggtccgtgccggccgcccgcgcccgcccgccgctgcccccagctcgaggaggacatcgcggccaaggagaagttgctgcgggtgtcggaggacgagcgggaccgggtgctggaggagctgcacaaggcggaggacagcctcctggccgccgaagaggccgccgccaaggtacccggggcgcgcggcacggcgtggcgcacgaatggctaactctttctctttctctctctccctccctgtctttccctctgtctctcccgctgtccctgtccttctggttctgtgcacccacacccctccccttcgggatcacgctgcctgctgcacccccctccctccctgtaccccctggccaactcccagctggaagatgagctggtgtcactgcaaaagaaactcaagggcaccgaagatgaactggacaaatactctgaggctctcaaagatgcccaggagaagctggagctggcagagaaaaaggccaccgatgtaagtgcacgctcacactgcttccctcacctcttgcctgcgtggccactccggggtcaccacagggctggagagcaatgaaggaagtttaccttttcctgctggacacctgcacacagccctgccatggcccagagcattggatgccgcctctgactgctactgcacacattcatttatatttcatccactcctctcttcttctcctttcctttacctccctgggggtggaggtgggtggatgagaggctgggagaatagagcagctgaaattggactctggaggtgaacttcacctccctggtggcagaaaacccttgaggtgtcatcaccaaggtttgtgtagagaatgccaggttttcttcactttctttccttttgccgtttccagtgggtgggaagttctgggtttggtggtgggtctagtcagggttcagagaacctggcctcta

SEQ ID NO: 79905 - DNA, 1053 bp, Homo sapiens
agctcccacctacaggatgcaaggacccaagctgggatttgtgagagtctcagcagaggctgtgaggaactccacagaaaatgaggcaggaaagcaaaagttccttgttagggcttggaggaggagagggttgtcaagcatgttttctttattattcccacacataagggagctggctttaagagctttctgtgacaaacctgaggagaaaaagccctgagacttagaaggcatttaagaatacagctcaagggggaaatcggtggagactgtatctgcggtggttttctccacctgtagccagaggctctctcatagggttctgtggctttccttggggtgccttttaaaggcatcccagtccagcccaggactgactggattccaggagatctcagaggctggtctgacaccaaagaaggctgtaaagagaagagaccatttggatgactgttttcatggaaagtgagccccagggaggctggcctgagattacacagctgattatgggcctcagcctgactcttaaaacaatgcttgtgtatttcttaatcgtagctatcatttgagtttttaactatgtacaaggtattgtgctaagcgctttacagtccttcataattctcatagcagccccatggggaaagtactattattattcccacttttacagatgacgcccagagaagacaggtaatgtgtccgaagtcacgcagcaggaaactaggagccagagtcaacctaggaaaactgcatttagaacaggaggtctaaccactgtgctctacacgcgggtggttttcacttcgtgaagttttggggaatgggggtagtgcttgggttataatcttgcggttgggatcaggccctttagggcatattccggctccagacccgccgctcagcttctctggctcccgggcatgggaatctggactcgggagcggagcgctcccgcggccagcaggagtcgctattgcccttagcagccagctccgttaccccgggtcaccaccgcgccgcggaggggccctagaagtggaagccagagcc

SEQ ID NO: 79906 - DNA, 1057 bp, Homo sapiens
tttgaccagagagttggcctaaattcaaatactcagactgtaattaataggccctattaaaccagcccttaccttggaaaaagcagccatcccttacttcctcctagtctgtgtttccaaggtgtgtggatccttcaaaatgttggaatgaggctactttgcttgacatgattgattccagatcttgtgacccactagggttatgtttgctttttttcattatttaaagaaaaaggcaggatgaatcttcctttctgagtagtatccagcaaacaaggagacagggagttgtggccagaaggttcttaattagtaacatgattaaatcatgggaaataaccaatttacaaaaattcccagcactttccctctttacacttggtaagtatttccgggataggaaaaccgagggtgcattttgtgcttgcattggcactcccagagtggctgttaactggaatgtatactctcgatttccgctttcatatgtaggcaaggcagaggcactacaatgccttgttcatgtctgttctccctcattatacaaatatgcttcataaattatgggctttggcacacacaggaggttgtgtttatctgttatccatgggagtgccccttaatgtcatcagtgtttttttttttcccccctttccttaccatataagggcagaagtttagcttggctgtggtcacttggccttacacagcaagttgggtgaaaccttcttcgtataactacagtttgcatgaaataaaaagacctgacctttgatcatcccaagttccactccagttcagtcaggactttggaaacatattccagaggattgatttctagattataatattctcccaccagtattttttcttaataaccttaactggaatacttttttaaaaagtaaaagtcactgccatttttaattttctgttgttgtattggctaaaacatctggatttcatgaaaatctaggcctcataaaagttgtttttttttttttttttcaaatctgatttgggataatattatactatggtggggtgggcatgccct

SEQ ID NO: 79907 - DNA, 1912 bp, Homo sapiens
actccccaggtgccatgatgaaaagaaccttagaaaatattgaaataagctcaaaacttaaaaaaaaaaataccagaaataaaagctagtaaaggtgagaggtgtggggcttttggaacatagagcataataaatcagaataaaaagtaaaaataagaaagagaaaaaagtggccctgattaaattataaaattaagcatatcttgaattctaacgagccaaacaaaaattctactaggccagtataatagggcctgcagagcctgtcatgggttcagggttttcccataaagataggtgtacctcagatactactcctaggtcctggctttaacctcaaagcccctctgcctgtcctgctctgaaacctctggggcagtaggcattgacttctgggctagggagtaaatgttccgtgtccttatgtgagcttcctattacccattagcattgttttatgaagttttcaattttatatcctgcctcatttcaaaaagattgtgataatcactttagcagatgatttgcattgcagcaactgttctcccagtcctggttaggatctgtgcctgaggccttttgtggggagttggggtgggggccggagaacatctcaatctgatctcaggagagataaagacacaggagtgagaactgccagttccaaggtttccgtgatgttccgggaagccaggagaagtgacatagtggagagccggcatgctgggagcctagtgacttggatcttaatcctgtctcacactgatggctgtatggcctccacatacttctgtgcccagggtcagagttccctcctgccgcctgtttctagtcaagagctagaagaatagccagcttctttgggtggtggcaaaggggattgtttatttatagtacagattcctgccctccccctttgacctcctgaatcagaatctctagggacacggcctggaagtttgatttttttttttttttttttgtttttgagacaagagtcttgctctgtcgcccaggctggagtgcagtggcatgatctcggctcactgcagtctctgcctcccgggttcaagcaattctcctgcctcagcctcctgagtagctgggattacaggcatgtgccaccatgcctggctaatttttgtgttttttgtagagacggggtttcaccatgttggtcaggctggtctcgaactcctgacctcatgattgcccgcctcggcctcccaaagtgctgggattacaggcgtgagccacagcgcccagctgaaagttttttttttaatgctcatctctgagttgattctgacactcagccacttgtgggaattgctgatctggacaatgcctagggatccttctagctaaaaaattgagaccctattttttggatttacagggcctcctcaggaaggggcagccactctcaggtctgctgtgtgtgccctaccattcctcccactatatcacaaactggcacctagaaactggtctccatgcccagtcgttgctggggcaccctgtatgaagccctgctggctggtattcctgtaggacatattctctgatgtccaggagtctgaggttctacagaatgcccctggggaaacaagagtggcatttagacaacagcattctgtaaacacagtgccaagagctaagggaaagaatgggggtgggggtgatcggagggaagacacggatggattggtaggggccctttgggtaggaagatctcatgtgcaaggctggaatgaacatgaggtgctgtttccttcctttctggtgactcggctgtgtggggagctggggatagagacctgtcacccagagggttctttccccaaagcataaacagtcgtctttctgtgagtacaaagtccttgaggttcaggcccagatctaaagcaga

SEQ ID NO: 79908 - DNA, 1141 bp, Homo sapiens
gtatttttctgaaacattacaccacgctataggaccctaatatacaccatgccataggaccctaatacactcagtgtagaggacagtgtcaggcctgtctcccagcattgctgtcatgaaagggttccattataggtaaaacttaatttgatgcattcagttgaaccataagaaattgccattattacttgtctgaaatggtcaaatatcagcattctttgtggacttaatagtttattaaatctaacattaagtctaatatttttgtttatgggtggcagggtaagaagattctttgtagaaagaggtatataaagataagtttgattttgttctagctttggttcatgtgcaagctgaggcttcccacaggaaaggcaagaaatctcattatctttttaatagtaaagcatattggcttttccggtttcatactgccaagattcagacagattcctgacgtggtacctttcgtcatcattaatgttagatgcctgatagtttcatcagtactcaaagtgagagagttcattcacagtgaacagagagaaatgtgtctcttttttccacctttagctctggaaattgttgtttcctggtttggaaaataaaagtagctctgtgctctattttggtctaccacttacactaagcctcacaagccacagcagtgcagtgtgcatttgggaagttcagctctaaatcttgggttttcttgcttgtctttcttttcagaggcatgaaagtcattgagagtcgagcccaaaaagatgaagaaaaaatggaaattcaggagatccaactgaaagaggccaagcacattgctgaagatgccgaccgcaaatatgaagaggtcagatcctggggcccaaagccttgtggacacccagcagtggccttcaggaagccagggagcaatgtacagtcttgattcccgagtgaggccatctgctttgttggcagaaatgggtggttttgagaagcagagttcctttgtgtccagaaaacggttctaattttaatcctgctaggggatcccaggctttatcaggaagccaatcagtagcactgcgaagaaggaccaaaactcctctcccccagccacaaagacccggacaaaagatctttggccggaagggag

SEQ ID NO: 79909 - DNA, 3135 bp, Homo sapiens
cttgtctcacgttagtgtctcttgtattcttccactgcagtaaggaggtagatgcacagatcagccatcaaattgatggagttcttaggtttactttgttttcctggcagcccccacctttttagtacatgtctcatcctactgctgtttttgagattgtgaatgtgtattttatccctccttccacattttggtctggctgccggttcacctaggtcagacttccaattgagactgcccaatcacagctaaccattctgagtcaaagcagaagcctctgatctcctctctgctggcactcctaatagagagttgcttctctctggtctaccagaaagaggatcatattgtttgtagacaaaacccttagggcctgatgggatctgatctctacccccatgcccttctgttacacaaagcttgcaagacccatggtgtgtgtgttgtgtcttcctgctgcaggtggcccgtaagctggtcatcattgagagcgacctggaacgtgcagaggagcgggctgagctctcagaagggtaagcgggcccggcgccaggaggccacgaatggggtgctgcagagcagtgactaaacagcatgaccttctggcagctgcacattacctgtttcagctccgggctccttttgtgctcatttgatgtggatgagccacgagtatggaacatggaggactcgtgtggggtgtcttatgtatgaatgcgtgtatcactgcatgccttacctgcacactgattttgtgaatggccttgtgcatttcctgtgtccactaacagccaagtccgacagctggaagaacaattaagaataatggatcagaccttgaaagcattaatggctgcagaggataaggtactgatggctcgtgtggtttttaggtttaactgcaacccagacatctttcagcttccaatgcctcctggttcgtttggtataacgactgcaccttcacttcaccctctgctatttatatcttgccttaagtgctttcccttggtcctttatgctcctttgttttcccttcataaatgctctttgggcagccaaaaaaggagccaaattatcgcacttcaaagttgttggatttggtcaccctgccttctgctgttgcgaggttggggggcagtgttcctggaaaacctaaacattttaatacctgatgatttggctactttaaggcagcccttcgtctctaggactcagttttcattttttcccatccctctcctttttctctcctccttcctttggcttgtctcccaccctttctgcctctgatcgaaaacattagcaaatgtgccgagcttgaagaagaattgaaaactgtgacgaacaacttgaagtcactggaggctcaggctgagaaggtaggccaggaggatggtgtgggggaaaggcatcttttaagagctgctcaaaagaggccctgccagaaagcaacacttacagtagacattttagtaaaatggcaatattgtgaggtgatttttggagagttactagataacaaattcttttttttaactagagaatttattttatgttagggatatgaggcatcaatttaatttaaaccaagtgccaagtggataagttatcttgttgttatcccatgtaaaacaataggcaagaaagcagagaatgtattgcagtgtgccatttgatatcagaggttccattacctcctaagagatccttaacatctgttggctgagctggcgagttctttgcatgagaagccatgagtagattgagctgcagcctgacatctggaatgctctttctaattacagtactcgcagaaggaagacagatatgaggaagagatcaaggtcctttccgacaagctgaaggaggtaatatgagagttgtggatgaagccaactggattttaaatgagtttgttttcatggaaccggtcagggccttttcattttaaagttccaatgatccaagtcaggaatattcaaaggtcgccttggagtttatgtactgtgctaactgccatttctcacagaggtgactgaaactgacaagtagtttctgatccattttataggtgatgtgcttcattttcatcctctagttttccctatgtttgtagctacaggaaacataaaacttcccaactttaactcaaataaatcattacaggctgagactcgggctgagtttgcggagaggtcagtaactaaattggagaaaagcattgatgacttagaaggtaagatcttaagtagtgtttttagtttaatccttatggttgaataccaacctggcaaaacaattttccaattcaagggcatccacattgatacgctcctttgcacttgcacattcttcctgtgtgtcctctggggtttttctctgtggctcttgaactcatgaacctaagtcttctgctcacgaggtgactagttagccaccagccatagtggcaaatgccatccagcttgacttcatgctcattacaagtgtggcaggtttatttttcactgtgagtgaggtgcttattggtgagaatgactctagtatattttatatctttagtgttacttcctaattaaattgggaatgatgtggtgattgtggtcttgtttttagaagaacccatcttcttccaagtatgaattcaaagtaaggatttaggggttattttaagtcatatattatcttaacaaaatactttatatcctgaaggaggagggaaaaattatacttaagcatttcttccctaaggcacttaggttttattttagtaataaccactctatctcacagatatcctaaatgttgagctttgaagcttgtgaaggattagctgtgaacaagaaagaaaaaagacaaatatctacatcacagaagggattagagaaggaactagtgtttggtgcagataataaccaaaatagtggagaagagagaatgacaaatggttgcaaaatgatctgccaaagtgcagcaaagtatgaaacctgcagcattacaaaaactaagttgcagacttgccatataaagtgtggcgcccattgcttttcaagcctcctggaccagtaataggcagcttgagtgggaagaccacaggagtagcttaaatggcactaagaaatcgctatccca

SEQ ID NO: 79910 - DNA, 2966 bp, Homo sapiens
cttgtctgtgtttcaagtgctctcatctattggtttggtttcctttcttttttttttttttctcattgtgccactttttttttcctcccacctttttatcttcacgcagataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagctatttctgtttgctattctttttacttcttatttattgacattttagtttcaacattgaataaaactacaaagctgcttcacacatatgagggttagtgtttggctgctgctttttctttttaaatactgaacactatacagaattatatcaggagtttctaaagcagtagttccttgttgaacttcaaaaaaatacccaggcctgcattccctctcagagttctgattttcaaaggttagaatgaggtctggacatctgggggggttttgggggaattgtgatggctctgctttgcagtctgggtcacacaggggacattgcttgttgagagttgaaaggtctggcttgatcagtgtcttcctttgctggaggtttagctcgggatgtagtgacccctctgtgttgattatttcggtggccttacttgggaggacctggctaactaatgaaaggctcatgatgaatggttctgtagctgtcccatattactaggaagttatacattgagaagggtgaaaaagaacttggattcaaacaatgtaagttttggttattgtcgatcatccttttatagcacaaagaaaagttcaagcttttttgaagtatattcatgactcagccacctttattttgatcatgaaaatgacatcttaggttttctaaatatgattactctgtttagtcgtgatttgttttgtgctttttagcacatactctttgggagggattgtacataatctttgtgttcaatggctgtgttttcatttgtggacatttttaaaatatagcaatgaaagtttctttttttttttcccaaaaagatagttggtggaaattgttcagaagacaattgtatttcatttgggcttctgttttatttcacaaacagcaattaagtgatttttttaaaaaaatacattgcaaaaaatagaactttaactaatatggactttagtgttataattcccaacatttctccttcctcaacaatctagctatatatttctcctgttttttttttaacatggatgatctgcatgttttgtatatagtttttttagcccgagagggctgatataccaccatactcaaataaatttggacaaactcagaagatagtgtcattctcactctacagagacttcaaagcatagaggaaatacttttttttaaagaaagctgtgaattaaagtattttagtcatagtatggtggaattttagaatctggacaatgtctctcccttgagtttataaagacttccatgatttcatgcttttcttttcttaaggctccttgggcctgcttctgactatgattccttcctcattcttttttaaattcagaataagagaagtgtacccttctctgagtaaatcctgcttcctgatgtagacaaaatgccaagtctgaaagttctgctgagcagatgttcatgtaattctggaggcacatctgtgttttggaaatccttccagagactttcgcactttctataagtacactctacaaggggaagtggggcactaatggactgggagggcaggtcaggagtagcccaaggtatgcatgtgcaagaggaaaacttgataaactcaagtttatcaagaaattgttgatttcttgttcaactgttgatttgaaccaggcttctggttcaaagggccaggccatagctacagctgctctggtgggccaaaccaaaagcatcactgagtttgggcacttgaagtttcagacagctgggagtctccatagaaccggaagggaaaacacttccaaggatatgagcatgtcttgtccctgcctttgggccacccatgcacaccagctccacagcagctgaagcagagcagatccagaggaggctgtcggagggaccactgtccttcctgctgaattcatactgaccctctggattctccagattttctccaaagttcttccattctagcctggccaaacatttgggctcagcaaactgagacaagctccccacccatggcgacacttcctatgtccatagtgtgaatgtagtaatgggatatatgtcttggaacccccaagcatatgtcacgtgcaaaacaccgtgggaagcagtgggggtgtggtaaagagatgggctggaaaggctctttgtcctcaataagctgggcatctgatggggagatagaggagtgaagcgagtccgaactaataggcatgtgtatttggaggcaacaaggaagagagaaccattctgactgggagctccctggaggaggtagcggacgtttgactggggtttggcatattcaaaaaatgtggatgagcaaagaggacagagcagcagatattccaagcgagaaaacataacgagcatagcatcctcccatgtcctaccatttataagagaatgttaatgtgagaactgctcagtctcctgacagacccgggggctgcaggcacattttccctaggggtaggtctgttagcttttcaagatcatgaagtatttttaggtccaagttgtcaccagcattcaaagccaccgtgcatcctccagctgttcccagtgcataccgggctcttgcttgtcatagcttggatgtcccctggatcatcagatacagactgactcctgcacttgttttcccccgtaagcagatcacgtgtcagtg

SEQ ID NO: 79911 - DNA, 1453 bp, Homo sapiens
actagggaggctgaggcaggagattggcatgaacccgggaggtggagcttgcagtgagctgagatcacgccactgcactccacgctgggggacagagcgagactaagtctcaaaaaacaaaaaaagcaagcagataaattctaaatcagtgttgagtggtgacaagtgcttgttcttttgctgtttgaatggataacactatcaaagctagacaggagtcagaatgtgtaccctgtattgtggtgactgggggaaggacagagacttaattccaaatttcaaaaaatttcagtgcagcaaaagcagtaacccccagttggtcctacctgaggggaaagcctgccctgtgaacggagaggaaaggggttctggaagaggtgggcagcactgggcaggttgatgtttcacttaagttcaacactgagccctagcaaggggtggatgtcacgctgggctcgcctccagccaggcctgcattcccaaatctattgccagaaaccatgtatggctcagctcacaaagtggtttagtgaggtataagaggaacattcactcttcttcctcctcttatcctgttgctcctcctcccctcctttcctcaccaagagagaaattctgacacttcctaagtctaccaagctttttagggtctacccttcctggatacaggacaggtgactatggggtaagagtaaactgctcagcaagtgaccagttgctgtcctgcttgaggtctctttgtgttctctattaactgcctctcaccaagtctgctaacctgtcttccttctgcctcttttctgctaacctgcttgctgacctgtacagatcaactctaccagcaacttgagcaaaatcgccgcctcactaatgaactaaagctggccctgaatgaggattaaacttaagagtgaaaaaacttgggctgaattctaggcgtggagcccatgtgcagaaaatctaagactgtcctaccttcaactaatagagttgaaaacagttgctttctgcagaaatgcaaatgcaaggaattggctgaaaggctggccttgcctgcttgtttctctatatggctggaataattacgttctctttaatcacaaaacagcttttatggtagaatacttatatcaattcagcactgctccttgaaatagcaggtcctcttgtttgaactgataaataatgaggagcccccccaaaaaatgttttctatttcctgacagccatgagtcctactttaagtatgtatatatatatatatatgtgtgtgtgtgtgtgtgtgtatatattcctatcagatactcatattcctaacttctaaatatctggtatagtgtttgaaatatgattaaatgtacctatgcttgggcaaaatagcttttgaaaacaggaactcatgccagaagcccctggttgtctgaaaggtatgctttactcagtctaatggtgc

SEQ ID NO: 79912 - DNA, 1049 bp, Homo sapiens
cttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaatttggtggtcctgtcatttgtatgttcttaatttgtgaacttttgaacgtgtgactgacctgccttcccccacaaataggttctcaaaacaatatcccacagtccaggggaaactgggtttcatgtgttaccttctcagaaacactaaaggcagcattattttggtctgttaaagttataaccaagcaggagagaccctttccaaatgttgttttcaatgttattggtgtatgcctgcacatacatgtagga

SEQ ID NO: 79913 - DNA, 1052 bp, Homo sapiens
caagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtgagtgttaatcccttctcttaacaaaatcatcattactgaaatgttaattttcaggaaatccaaaatgataccatccggagtgcattcattgaggttgatgattgtgatacggactagtctggtgcttgcgtttttgtctgtagtttctaacaaagcctagcatccaggcagcttgtttaaattttgcctcattggagactacccagtcatttagaggattctcagtatcaagatgttcatgcaaacttatggagaaatgttggaataatagttctctaaatacaacctggaccaaagtagacatgataaggtattgctgatattttagtatttagttagaatttaaattgctcaacttattttgtgcctttatttcttaaagaaatgagtgttcatcactaattttttgccaaaaatctgctctatacaaataattatctttgttttattttttgatttggtgcctattgaagctacttaatatctaaatttaccatagtttgatatacttatattcatttttcattttaaaagcttttagttgaatagatattttatagatatgactaataagagcaaataagatataattatggattttatcttaaaaataaagttccatgctgggcacagttggctcacgcctataatcccagcacttacagagggaaaagtgggaggatcgcttgagcccaggagtttaagactagtctgggcaacaaagc

SEQ ID NO: 79914 - DNA, 1049 bp, Homo sapiens
accaaatgataactttctccatatgcacagggcaaatatgtcatgtgtaatattaaccaatacatttttgcaggtattaaaggtttgatacactcagcatggacaagccataccaatagaaaaaaaccactttctatgctttaattcaaaaggtaattagactatcttacttagttatctgtgtgtcattaggacctgaatcatactgaaaattagtggttagtttatagtttctgagaatgtatgatcattacattgaaatacaatctctctcatgtatacatttttctatcatcatgtgtgaagccagtgactatgaaatttttcatgatcatttcttatttccttttagattttatgtttacaataaaaagaaacgtcttgtcaacacaccttacgtggataactcctataaatgggctggtggtggatttctgtctacagtgggtgaccttctgaaatttgggaatgcaatgctttatggttaccaagttgggctgtttaagaactcaaatgaaaatcttttacctggatacctcaaaccagaaacaatggttatgatgtggaccccagtccctaacacagagatgtcttgggataaagagggtaaatatgcaatggcgtggggtgttgtggaaaggaaacaaacgtatggttcgtgtagaaagcaacggcattatgcttcacatactggaggggcagtgggtgccagtagtgtcctgctggtccttcctgaagaactggatacagagactataaataacaaggttcccccaagaggaatcattgtttctatcatatgtaacatgcaatctgttggcctcaatagcaccgctttgaagattgcccttgaatttgataaagacagatcagactgataaccttaacaccataggtgcaaaatgagttgttctgaggtttttttgaaacattaaagttccaaaacatgacatttttaagaataaatttgaaatagagtataactgaatgcagagaattatgtacctctaattgcttaattttgtaatggtcttttattgtagaattgg

SEQ ID NO: 79915 - DNA, 1058 bp, Homo sapiens
tattgctaagtatacttgggagatttttgaaacaaagtatgtcatgtcatgattttggaatttagtgcccatatgctgacagatggtttaatgggtctatctgttctagagttttcctaataggtctgaaaatacctctaatcaaaattatttacttgagaaaagtattcagaatagttcctaaaaattaagagtatatcttctgacagcttgcttgaaacagtcttcactgttgaattcaggctcatggtcttaagtagacttcattatagcatttgagaaacaggagtgacacttatagtcataccagagtaaactcagatatgatagatgtattatagcaaatttctggtataaaaggataaataatctgtatatgagtattaatccaatattcttaaaacttcagtattttacttaaaagtactttttgtcattaaaattatagcaaaggtagaatgcacttgtttaatatactctcatgattcttttgcagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaatcccctctttttctttttttaaaatatatttgagtatgccatacatttatatatatggtgtatatgaatttggtttaaacattttaaaatttattctgattagtttgtgtctttttttttttttttgagagagagagtcctgctctgtcactcaagctggagtgcagtggtgcgatctcggctcactgcaacctccgcctcccaggtccaagcaattctcttgccttgtcctcccaagtagctgggattataggcacacaccaccatgcctggctaatttgtgtctcattttcaagagtagaaaccctaaatattttattttcattccttttccaaattgctatgaatgggatt

SEQ ID NO: 79916 - DNA, 2788 bp, Homo sapiens
cgagcctctttcataatctctctggcacgtattaatggttaataatactgtattttttaatacacaaaagaagagaatagtggcattgccccgtgtgcccacccccagagctaaccgagagcggccgggccagggggccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctgtgagttgtttacatcgggctccgggtttgttttgggcttctttaccgagagtcatatgggacggatgagtccggctgcctctcgggcctgtagtgtccgagagtggcgaggcggctcaggttgcgcagcgtcttcgcgcgtggcgggcatgtagtgacttgcccggtcaccgcggcgcggctggccctgcaggggcgtgggctgcaattcagaggcggtggctgggaggggaacagttctctgtgtagcttatgagcggtcttggtctttgaggatgcccctgaggttgtgatctttgggtcttttggctttcccagtgattggtgtttctcgccccctctgccttctttcggaagcgatttcctacttgttttccttttttaaaaactgtcctcgttgttgccttatatattaattccgtcaaggacggtcgctcagcaagaattcctgtcagatcagctgttgagccacaggagcaaaaatcacccaggcgctgacgttgtctggtctacttcagcagtttctactctaagcgagtccacagtcggggtcactttctttgcttagcacctcgacttcgcgcagttttcatcgaagacagttcattacgcagttgagtaaagaaggacaaagtttgccttaccatatgtttcctgatcgtgcgaaagcccttttctagggacttggagaacacaagtattatgaaaagtactgatgaaagttattaacaggtttcgaaaaataactttactatctgacgtgttgcttctgccgaggatgaccgttattcctgtttttgcatgtatatttcacgtatggttaaatgtgccagcgttgtggtttaaaactaatagtaataatatgcttctttgttcagttggctagagatttactacatccgtccttggaagaggaaaagaaaaaacataaaaagaaacgcctagtacaaagtccaaattcttactttatggatgtaaaatgtccaggtaaaatttgaaatcttaattcctttactaaagaaaatttctgtagggattgctagtgtggtgtgtatagttaagatacattagaaccctctgttgagtagaagtgggattacagaattggaaatgtcagggacattttcataataaatgtactgaaaccattgtagaaacatttcggggtaagtgaaaacaggcattcaaaggagatatgccatttgacttagcaagtctttaagctcttcagacgatgagttttctgtttcatgatacaaagaaaagtctgttgattcttcagtctaaagctgtgctgcccaatacaatggccattagctgaatgtggctactgagcacttgtggataatcaaaatgtggatactcaaaatagagatgttctttaattgtaaaatactcactggattttgacgatgtagcacagaaaaaaaatacattgattacatgttgaaatgatattttggaaatattaagtttaatgaaatatattattgattttacctgtttttaaaaaattttgtgtcgctgctagaaaagtttatgttacacatgtggcttgctgtttcatagcactgaagttactgatttttttacatattaccagaaatgtcgaacaggtgctgttttcctctgcttttcatttttaacattgcctttttttttttttaggttgctacaagatcaccacggttttcagccatgctcagacagtggttctttgtgtaggttgttcaacagtgttgtgccagcctacaggaggaaaggccagactcacagaaggtatatcatttggcattctccaacccagtgatgagattgatgattataaatgtctctatcttcactgaaaagtttaaagaaatcttaatgattaccaaaataacttatctttcattgtgtgctttcagtaaagaatggcctgttcaaatggatatatttatactcttgaccttgcagtgaactccattgacttatttttcttagtttagaacacatttattcacttagtttgcttaacttggaataaattaagtcagaatagaagcaaaagaataactacatgttataggacatgcagatttatttatttatttatttattattttttttttttattaggagtctcgctctgtcacccaggctggagtgcagtggcgccatctcagctcactgcaacttctgcctccccggttcaagtgattctcttgcctctgcctcccaagtagctgggaccacaggcgcgtgccac

SEQ ID NO: 79917 - DNA, 1038 bp, Homo sapiens
aagttttaatgtgaagtattggataatctattaaaagttgaattgtaaattcgtttcttatgcaatatttgtttatctggaatggatattgcagcatactctaatctccttatgcacacatacatacgaatacacaaaatccattacaaaaaaaagagtttgtgttgggagatgtcagtgactaacccttctgtaatttgtttattgcttatgaatttggatgtgatagttttttatggttttcaacaaggaatcgtttactttttctcttctaaatatctctgagtaaaatcttgatacagcatggaaaacaattctttattgagagtcaactgttccccttttggaatgactccaaccactttcttgtttcactgtctgttagcacctcacccataccaagatttagagagaggggattgggttgggaagagaaaaatgaaaacatttcccttcccctatctctttggctacttggttcagtctctttttgcttttgttagcaattggagtaaactattggataaagagttagaaatgtctctgtaaaatagtttgagaattaatagtgacctttgacttcgatttttctcttacattgtttagaactagataatttttaaaaaattggtgcctctctctgccatagccagtaatgaacacagaccagggtgttgtccacaaacaaatttgagttgttgcattccctattttgtctacatcattttgaaaatttccaaccttatagaaggatgaaaaatttgtgggaaaagtgaaataatttctttaacatgcacaaaattccattataattaagttgaaaaacatgcatatataaatatatataatatcatcagagttatgtctttattttggcccttcagcgttcaactttgggttttttttgtttgttttttgtttctttgtgggctttttttgagactttgtcatcagtctggaattagtggcctcctgtgcactaccacgcccagccaatttttgtattttttgtagaaacttggcttcacctgttgccca

SEQ ID NO: 79918 - DNA, 1035 bp, Homo sapiens
atcagcaaggtctttatgagctttattttgtgctgacgtcctgtctcatcctgtgacttagaatgccttagctatctgggaatgcagcccagtgggtttcagccttattttacccagctcctgtttaagatggagttgctctggttcacacgcctctgacatttgcatccactgttgtatgtatttcctgacctaatgacaatgaggaccaaactgagaacaccaaaactgtgaccactagatacagaaatcctgccccaggcttgcctgaggacatctttgaaataacactgtgcctgtaaagttatctgtgagtgaatagttctgtttttgtttttcgtgttagtaacttagggttactgttagggtgctgcaaacgtacttttggatcaggcagaaacggggtaaatgaagttaacattgtaaaatactaacttttcaattgcagaggttaatttacaagttgatgttcaattttgttttatttagttttggttgttttcctcaaccgttcatgtatggaaacattctggctctgtccacccaggaacccagaattcttcaccctctgaacccctggatttgtttttaaaataatctgtgcatacctgctgtttgttttgttcttaacttcattgtattatggggctttataaacagaaagatgagttaaaaatataacaaaacaaattgttcaccaaggctgcttttgccctttgtctgtgtgggaattcaccatgatcctcagctgagcagcttttaaaatccagtgagcaccctcttttcttttcttttttctcttttcctttcctttcctttcttttctttcttttctctttcctttcctttcttttcttccttttctctttccttttcttcctttcctttctcttcttccttttctctttccttttcttcctttcctttctctttcacagggtctcactttgtcacccacgctggagcgtagtcacccaggttggagacacaaacatggctcactgcagcttcgacctcctaggctcaagcaattct

SEQ ID NO: 79919 - DNA, 2593 bp, Homo sapiens
ggcctcagttttcttagccacacagacaggactgaactaaatgatctctaaagtacttctcaagtctataattctatgattctctttcatacttatttccctgcctccttatgttataagcaaccatttagcataagagtcaattcaggaaagcaaaatctgttagagagagtttctaaattcaaaatgaaaatgcctttgagtcattcccttgggaatgttttcttacagtttatatttcctactgtattgactagataaatattaataaggaaagtgggactactttaaaaccatcaaaaaatgagtgttgaggtatatttgagcaacatggaaatacctttggaatcttgccttctaaactcagatgttggattgtgtttccagctgggtgggctgcatgcctcctggtgggtcatggactgctcatgagtcaggatgactcagggtcatcattttgaacatgaattattatattatgtgctgccaaaaaatgatgttctcaaaaagacttttgaaatacaaaaagtcttttaaaaaaaaattgtgggtacatagtagatgtatatatttatgggttacatgagatattttgatacaggcatgcaatgagtaataataatcacatcagggtaaatggagtatccatcacctcaagcatttttatcctttgtgttacaaacagtccaattatacttgtagttattttaaaatgtataattaaattatttttgattatagtcacctattgtcctagcaaatactaggtcttattctaactattttttgtacccattaaccattaccactttcccctaccccccactacccttcccagcctaaccattcttctactctctatctccatgaattcaatcattttaatttttagctcccacaaataaattagaacatgcgaagtttgtctttctgtacctggcttatttcacttaatataatgacctccagttccatccatgttgatgcaaatgacaggatctcattctttttatggctgaatagtactccattgtgtatatgtaccacattttctttgtccattcatctgttgatggatgcttagattgcttccaaatcttggctattgtgaatagtgctgcaataaacatgggagtgcagttatttctttgacatactcatttccttccttttggagcaggattgctgggtcatatgatagctctatatttgattttgtgaggagacttcaaactgttctccatagtggctgtactaatttgcattcccacccacagtgtgcaagggttcccttttctccacatccctgccagtgtttgttattgcctatcttttggataaaagccgttttaaatggggtgagatgatatctcattgtagttttcatttgcatttctctgatgatcactgatgttgaacaccttttcatgtatctgtttgccatttgtatgtcttttgaaaaatgtctgcttaggtcttctgctcattttaaaatcagattataagattttttcctgtagagctgtttgagctccttatatattctgattattaatagcttgtcagatgggtagtttgcaaatattttttcccattctgtgtgttgtctcttcactttgctcattgtttcctttgctgtacagaagctttttaacttgatgtgatcctgtttgttcatttttgcattggttgactgtgcttgcagggtattactgtagaaatatttgcccaatccaatgtcctggagagtttccccaatgttttcttttagtagtttcatagtttgaagtcttaggtttaagtctttaatccattttgatttgatttttgtatatggcaagaggtgggggtctagtttcattcttcggcatacagatacccagttttcccagcaccatttattgaagagactgtcctttcccccaatgtatgtacttggcacctttgtcaaaatgagttcactgtagatatatagatttatctctgggttctctgttctgttccactggtatatgtgtctatttttatgctagtaccatgccattttggttaccatagctctgtagtataatttaaacaaagggctttttgacctgaaggataatgtccttcaaaaactatgttttttgagattgtatagtccttttaaattaaaaaaaaaaaaaagttgctcccttactgccaggatgacctctggttcttgctgctgttggtgtgatagccccctccttctttctagtctccagtcatctggggctaggggataagccaagtctttggagttgtgggctggaggactctcctagcagctgtggtcacagttcagcacagagatgttgtggcagctacttgggctgctcattgtcccctttttctttcttattttctagttcttagctgaacactacatgaaattgccttcagagaagtactacagtttctcattaaatgtaataacattcatgacaggatagtagtgcagctctttcatatagatatgagtatacagtttgtcctttcatatagctatgaatataaaattttattaatgagataggtttgagtattatatagaggatatataataggtata

SEQ ID NO: 79920 - DNA, 1004 bp, Homo sapiens
aagatgcttgtctccttcaagagtatgagctgggccgggtgcagtggctcacgcctgtaatgccagcacgttgggaggccgaggcgggtagatcacaaggtcaggagtttgagaccagcctggttaatatggtgaaaccccatctctattaaaaatacaaaaattagcctggcgtggtggtgggcttctgtagtcccagctacttgggaggctgaggcaggagaatcgcttgaacccaggaggcagaggttgcagtgagccaggattgtgccactggaccccagcctgggtgacagagcgagactccatctcaaaaacaaacaaacaaataaataaatacataaagaatatgagctgtttagtggcacagctggggccatagttcctctgagcctgtttcctcatctgcagaacttggatgctggtaacacccccagccagtagcccaccctaatgggctgtggtagacatcacgtgagtgcagtgtgaaagtattttgtaagatatatgtctatgttaaggtgtttattgctttttaacttatgatattcccttgggccttcatcttttattaggatttggtatatactagatttctagtatatttccacaaatgcctctttctctcctgcaattaaattgtcttagtagcacagggaatgaattagttctggctggaagtgggaaatttgagaatattgattttctcaagtatcaaggaaatttaacttcctttataggattgcttctataaatgaaatcagaaactcttatatttttcagaatgcattttaatggtatgccatcagctaaaaagcaaaaatatatgaaagtttatatagttttgacatgttgtttatgtttaaaagtctttgaaaacgttgtcaagatttatgtgttgaactccaggtccccatgaaatcatgggctccatagctgaacaagttcttgaggagatctattttattgtgctctactgagcagaatgtacacagtaataagtc

SEQ ID NO: 79921 - DNA, 2621 bp, Homo sapiens
tttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaa

SEQ ID NO: 79922 - DNA, 3038 bp, Homo sapiens
gaaattgttcccagttgatgtcttttggggagctggtggcatgaaatgcaaatgacctatacattaaagtgatgtctcagtgaataccatacatgcagtagaacattcagaagagaggagcagcaatcctgaggggctgggggagtgacagtggcaggacggatgggcgggtttgacagattgtggtgggaagaagaatgatcatgtttaaagctaacatagccagtgttttgggctagccacacatcattccagagaccaaaaccttactcatgaactagacctttatcgatatcagtgaacccccatgtttaaaatattagaatgtttagagataaaatagagataatagagataaaagaagaggagggcttctatcaatgctgtaaacagtctgataagcgactgtggttattcccctaaagtttacttcagcactaacactagtgcttccgctggagtttgcagttttccagctttatacaggattttcctttgactggaagagtcaaggatatagagactcaacagtgacatttattgtacaacatcaaggggaataggatactcatcaaactgggattattcttatcaaaacatggtcttctttgaataagaaaaatacatagttggttattatggacttaaaactgtgttaaatggatattctgataaaatatttgctgctctgtagagtgtggaaagtctgagaatattagctttactcatcttgagctttgaggatgttctctgtacgccgatggtttcatattaactaaaaaagctgggtattgtaaaatctcatttataaaaactcagatgagaagaaaattttctttgatggtgagactgttgtcttagttcaggaaattatttaataatcctttgttacctgtgaatgaaggaactttgtaattctgatttatcgtaaaacatgagcctttccagagtcagcttagacactgttgtcgcaaatagccatgctttgccttatgccaaggaggcccagagggagggcctagtcttcctctgttgctgtacatatattgaaatgcttttttttttttattttgcatttgttatctataatgagctttctgagccctgatattatgtgagacaaacaggagttattgatgttatacactcccttccattcaggattttctgcttggagggaaatatgttgaccttagagaattgtgaatattgttgcaattcttgaatatattaccatgtgaataatagagactgtgttgctctctagtataagctatatttatttttgattcatttgaattactagttataactggagaaattttgttacctctatcctggcttgcctgactggctgtataatagcagcagcctcttttagagcatcttaatgaaaacatggatgaaaggaattaatgatgatatctgcagactgcgtagaaaatggcttttgttcccagcgttaacattttcttctcaatcacatttcaatgtttgtggagagtggcagattcacaccagaaacactaggtgttcatatccatagcatggatgcagaataagcagttgggagagaagcttcttcctacctggtactcctcccattcacctcagcccagccccagacaggcgttagcattcagtgtgggccctcaggcagccctgaagcctggctgggtcatcagatgggggcagcctgtgacgggcaccagcggcctgattccagggaagagttcctggagggtgttggctgtttttgttagctcagtttttttctgggctccaccattcctaactccaggtagacaagatagatgtcacacacaacaattttaaagtattttgcttagtgcattttgtttatgattgcagtgtttgtttcttatttaataggctttttacttcattctattaaattttagtgtttagaagaggcgggtactgtcactgtgtaaaatatgtaatattttatatgttataccatgtcatatatacttgcaatatcagaccttgcattcaatatacaatgcaattgactctttgcagacctgcatttttcagtgaacaataaaaagattgtctggcactcctcatttcctgtgtttcctgttctgtggaatggtgtatccttcagtatgttactaccgtgttttgtctccttatgaaacttggatgtacattctgttgtttatgactgatcagttcagagacttttttcaaagagaaattctttatctgatttaaaactcctaaggcttatttcatatctgtgtgtttaggagtagtttggttcagagcatttccttgaggtatcttaaaccaagccgggggaatcctcaaagatcctggaagcttgctttgcaaaatctcctaattgtaaaatggtgaatttaaagaatgtttgtataatagtggctaaggattggagtccggtgaagaggagagtacaatttagcttttacctggtgattctgagtagcctatagagtccttttctctttctttcccttggtgaggagacagtgcagctaaagggttgagcttggcccttgccatcagacaggatacataggggattatgatacgatactcaaaaccatttgatgcttgttcactctggcttgaaatgaggctgttgcaggctatgttgatgacgttattggatgaaacgttctcaggtcccaagggctctttgcttctaacctgtaaaccagtggaagaggtgggcattcctcaggtatcagcccagattcctgtacaatttcattggcccttaaacactgaattttggttctaatttaattgttacttgtttggcatttagttggaatggagatttccctatgaccagcctcaacacatgagaaacctctaatggaaagaagtgcatattttactttcacctctttgaaaatgctgaatagaaggaacctctggacaggttgtggtcccagtctcaatagaagaattagatacattgtaaggtgaccataatagattatgagtcccaagcagatcctggctttaatgctcaatta

SEQ ID NO: 79923 - DNA, 1002 bp, Homo sapiens
agttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatcaggctgttctttttttttttttggaggcgaggttaaagcattactatttgcaaagcactctgtagctccctgttatggggataggtaactaatcagaataataatgtcactcgcatccacttcttagaacctggctccaaaggaaaataagctgatagactcaatcactttcctgaggatggaggcctatggcatgtgtggctgcaggtcgcgaagctgcttaatggtgctgggaagcctagaggaattaaataaagaccctggaggaggtgggatcggagctgcaccttgaacaaatagctcagatttgaacagatggatggaaaagagggaggtgttcccaaccaaggggacatgatacagggaacaggtcctatgtctctttactcctgagagtattaaacctagtaggtgggcagcccctcttggttgcctgttaccttattttgaattctttttgcaaaacatactatcacccgtccaaataatcttttgtctaaatccagacttcacattctgactggggcaaaaagaggcagtccagtaaaggttataaaataggtaccatcattgtttgccttatttagaaaagcatccaattttcactataatcaccctaagcctgagagaggtgaactgttcaagggtactttggctccagtgggtgacagtacctggcccagctttgga

SEQ ID NO: 79924 - DNA, 1034 bp, Homo sapiens
cgctcgctctcctctctaacaagagttatgtgttctttctgttctagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgt

SEQ ID NO: 79925 - DNA, 1095 bp, Homo sapiens
gtcgggagtttgagaccagcctgaccaacatggagaaaccccatctctactaaaaatacaaaattaaccaggcgtgacggtgcgtgcctgtaatcccagctactcaggaggctgaggcaggagaattgcttgaacccaggaggcagaggttgcagtgagccgagatcgcgccactgcactccagcctgggcaacaagagcaatactccaccttgaaaaaaaaaaaaaagaaaaagaaaaagtttcaatttctgggcatcgacctccttttcaatttcgctcatatcaaaacaaaatctgtagtgttttccattactcatctggttccattgtacttacttactgtgttttgttctttgtaggttccaagtggacttattttggtaagtagagattttaaatacttttttgttgaaaagaaaatagaaatggttgtatttaatgagaaaaacagaaacttcatgctctgtggaggtgattttgaagggtcggaagcacagttcttgtattgtagaaagagagtacaaaggcatctcctaagaacacttcaacttgggttgcatactgcactttctccaagcaggcgagcctgctccaggcacaggactgtgagtcatagtgtccaggcttcagattcctgcaaggatttctaccaaacctccaagatttggaggtaacttgccccacctccggactgcaagggtcctgggcaggagagagcctttctcccttgcaggacacatatcctattataaacaaagaagaaagggctcctctctgaaagtttggctgaggtcccagaacttaagctgtcagtatgtctagaattaacttcttgttgccgtgattgtaagctagcgatggatgaagaggtgttggtcagtgcttagtgaaagagggatgcttgtcttaaatgaagcgagaggagcaccagtgtgcttgttgcctgggctttctgtgggacggtctccaagagcatgttagccccatctggcaggcctgccagagaagcagctggaaatcagcttagctggagagttgcagtgaattagaaattggtcattggctggaatggatgtggcaggccagacacctg

SEQ ID NO: 79926 - DNA, 1007 bp, Homo sapiens
tacaggaccagtgacagaccaagggcatgccactgaaggaatccctagacgcacccttctggatgtgagacaggcggatctcacccacgcctgccagcagctcctcggagaactgtgttcctgggtcagccctggcccagaggagcgccggggacccgcagagtgctgctgaagtcaaggctacaactcacctaggatctggggcgccagccctccggtgggcagggcgttctcctcccccaccccctccccgcacgatgacatcaagtgtttggcgttgagttgctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggtaaagtttccgcctgcttctttcctaacactcctgagcgctcagccgcccctgggctgaaggctcttcaatgataaagtaaaatcattgctgcggggagcagggaaggtgtagtaccaaatagtagattctcaagaaaggatgctccgttttcctttgctgaggttgggtcgggaagcacgttgctttctagtggcgcttggcgcagatttggtgttaaaatgtttgcgtgtactcccgggcaccgccagctctgaagatgtggcttgggaacttgctaaccagggaggagatgcaaagccaagatttaaaacagcgttcccctgatccacgtttagaaagtagagacatgactgtggcattctgattggggtaagcacagagaaaggtttgctgtgcccctgtgcagaacccgcagacagtggtaggcgcttttctttggaggagaggatctttaccattaagtcttacctacaa

SEQ ID NO: 79927 - DNA, 1034 bp, Homo sapiens
tttcccttctccgcaggctcgggcacctcgaaaccccgagaggcgctgggagctcgggcggcggaggtcggggtctttcatccgtcagggatggtgaagtttgaaaacaggctgcgggctgagaagctcggaggctgagccaacagctgctttggaggggactgctcgagtttgtttttcagaccttttgggttgtccgaaaatgcgttgggattcccagttcctgtgttgtgaaacacttattagatttatataaggcttttgagtagcttaagcgttttaactcctgctggcccccttggaagccccagtgccctctcattgtctgctctaagcgacttcttaggatcgcaccggccacacggctttgcttacttcctggtagggccctggtgccaccgctagtctttgtttattagctttgagatggtcactggtatcttgggttatattaatagcgtacaattcgaattgtgcacttcagaaatctgaagttcatttgaagaaatatagaaaaacggcaatggtatgatttagctgtgacatgtctcattgtgggccggagctgggaagatagtttagagaatgccttagcacttttgacagcttactacttaaatagtgattatgttcttggaaacaacatcggtaggtccacaaagaaaaatgtactctgggataaggaatagaaataactgcggtttcctggcgcgctcagacgtctgatgctttgcttgcctttgtaaagtcaggtatctttttctgcatgaagcctttgaaaattaacggttaattggtttcacagagcagtattgcagttcttttgtgaggatgcagaaacttgtgtaaattagcttttacctgtaaatctgtcgggatgttgagtatagaacaacaaataaggtgtatggcactgctttacaaattggttggtggtggtacattagctataactgtagccattgctgtggtgctataattgtaacttaatttttttcccaaaagaaatttgaagaaaaaaaaaaagaccaaag

SEQ ID NO: 79928 - DNA, 1024 bp, Homo sapiens
ttaaaaagatgccctgaatgcaagtgttttgataactaaggaaagccaaggaccaagcatttgaacttgagggtttgggttaaacagccagttaaattagagatatttagtaggataggcatgctaatttttccctgattaattcttcaatgagttgagagtgcctctttaagttttcagtacacacttgccttcatattactctacccaagaaaagtaagtgtagatcaagtaaatgttctgcaattttgcaccaaaaactgcagataattccacccaaaatactggagataaacccttttttaagagatccattcagtaggatgaggtgttgattattggttgtcagtggtaataaatttgtaatggactgatcaggttgtgataaagagaagaaatcaaccttgatggagtgatgggttattttgtatcgtatttctccacaacctacatttaacactcgtttgcccagtggactaaattttctaaatacaatcagtcatttccttgtcattaggtcaaatgcttttactgctttttagtaacattctatgatgtctttattaagtgcctaatacttaatagagcaattagtaaatatttgcctgataaataaaggaactatcacttagatgtgtctggcagggtctttatgttgaaaataaacgcagagtgaactttccccagaatgctttcactagcccgcactcccagtattttagtcagtaaacgttggctggattgtgagcaaatgaccatctgcagtgttgttatcacaatgaatttgtgttcttttggcagtctgtatttatagatgggcaggtggacaatttagttgtaaatgtggatggggtagttaaaaatcagtggacaggtgatacttttttcacattaattctaaaaagtagtatttgagttttatatatccttctgaagaatttaaacttttttggtaatatttataaagcttaagtcaaatgtctttctagtctttctgcagtattcctccccaaccccgtccccc

SEQ ID NO: 79929 - DNA, 2439 bp, Homo sapiens
gattgagcctaacatttacttgttgtgaagaagttttgacacattgatgagaagttctttccctaataatatgcttaatagtgtatacagaacatccttcatggtctaagcagaagaaatgatggagttgggggaagaattcgaactctttggtgtggtttcctgttatttatcctcaaaataatttattctcattctttgcttgtacaccattagccttaggctcgtgtaacagcctcctttttcctcattgaaatgtatgtaatttccttctccactggaatataaaagattgattttggatccttcaagctagatttagaaatacttatgtttttatagtgtttgcagctcagtgagtagaccagtgagtaatttagtgtgtagctcagtgagtcatttaaattcctgttttaaaatttgagtccctcttccatcaggagctgattaacatgtacatttcccctaacctaacctgctcgttttttttctttttgagcttttctccccttcttgagcttgtttgtttgtttttaatatttttccttctttgaaaacaaaatgttagtctcctttgattaagctgcagtctctgacctacatacatacaggtttgtgttcaaccaaggcattgaaataaatagatttagtcggtagattatcattgtttgaagtggaaaaggtatgctgtttaacatattttgatattttatgtttattcattgcctctttagacaggagagcaattgcattctaggtgtgttaatagagctttcctggacagatggcttggaaggaagtactttgatgggttctcagtaggggctagtactttttggagggtgtgtttgtgattaagcttaccttgattgacagtttagaatgctgagaatagcattaacaacagtaacagcttgttcatcttacctagaattgtcttgtgccaagacccctcaagatgctctgagatttctgtgtagtggtttcttttgagaatgtaggtaagaataggtgtccttgagactgaaaagaaattcacctaaaattgttcattgtggttgtatcttaaaatctttggggtcgttgaatgaactttggcttagaaatttgtagagatcgtctttttaactgctgtgagtctgcagatgtgattatctatagtaattccagatgttttctcatctattagttttactgagtaggaagataactgagaacaacataaagtaacttcaaagcagtttgctagcatttaatcctgactaatttaattaattattcatccttgtagtttttcctattttattgattatgaaactgagacaaaggttacgagttgcccaagatgcttggggagtattaaagatagcccaaagcttaaactctaacactgttcagacttttagcttgctttttcttaaaaaaaaaaaaaaaagagtctttattttgttattcagtaacttaatgcttgacaatttaaaaaatacaaaatgtttggaacacatactttaaataattcctttgaagatttttgatatgaaaatatattttaagttccacatctcaaaaattacttattttaaaatttggtcttttgttacccccctcacccaatttaatattgaaagtgctggcaagttggaacaaggaattggtgatatagtttggaagaaacaactattttaaatgtcaaccttgttatactcagatctaatatttttataggccgaaattcatattgcattagttcagacataataaaccagcctcctcactatagctatggataaaatgcaattagcttttggttatttttaaaatgggtttcagttattgaagtctctccaccccccttattttttcattttgtttctgttagagaagattcttcttggaggtggtttgttgtagggtggaggaaggagagaattcttaaggtatagaattttgcatttgcttctggtagctcagagattatttgaaatctttgcttttagtcagtatactttgttgattccatttagttattctaagattttccaattgtatttcctgtaaaagttatagtctttagaccataaaaactaaaactagtaactgcagatctttttttttttttttttttttgagatggagtctcaccctgttccccaggctggagtgtgatggcacgatcttgtctcactgcaacctccgcctctcgggctcaagtaattctttgcctcagcctcctgagtggctgggattacagacgcacaccaccatacccggctaattttttgtatctttagtagagtcagggtttcactcaaattcctgacctcgtgatcctcctgccttggcctcccaaagtgctgggattacatgtgtgagcctccgtgcctagccagtaactgcagatcttaaaacagatttcccctcttcttcttcttcctcttc

SEQ ID NO: 79930 - DNA, 1036 bp, Homo sapiens
cagctatttagaaaaactgaaatagttaatggttttggagtttgcaggtgcctgttttctgaaatattgattatctatccctcgggcagagtatacgtatttgccaagtttgtatttcttttttctatttcttcaaaataagtcccgttgattttaaaagaataaagagtttcccagtaagtacaagtgtggtactttttccccctccactttgtactttagtgttaacctttattacataaccacagagaatgaggaagagaattgtacaatgcagatattaagcctattgttctccaaggaaagtctttgatgttaagaggtccctaaacctcttaattattttatttacttgtgagagggggtgcttccttaaatatatacgagtcttttcttatattgcatacacttgcaactattattttgaaataatagttgagtggtgtttacatttatgacctgattcatgtcttttgaagtgccaccactgtttcaccatggacttgcttactcaggttgttggcaacagcatggaattgcatcagatcttgctgtattaaataaatgaagatattagatgtcagaatttttaagtagttcatggcttttgtttttattttctatatgatcagcttcatagggaaagttatttttgaaacaatttgagctcctaataattttttgaagctatttgtgtctggtcttccaaaggcaaaaatggcccattttgactctgatttagtaatctcctttggctttagtggtttttatccttcctcccactatcctttcccctcgtttagaggtaggaggagcccagttccagtatttaaaatgaagatcaagagtggcataatagcttcattaggtgtttttcaccaaaataggtctgaataagtctgaatttgtggtagaaggaaccataacaaatttgtttagtgcattacagtttttgagaatatgttgtttcacacacattgtttctatatgttgtttccatttcatggtgaaagcataaggaatccatttaaaaata

SEQ ID NO: 79931 - DNA, 1130 bp, Homo sapiens
cttaagaatctttacctagaatttgggatttctatggaaatagtgcttttgaaaatttgaaggttttaaacttacttgttactgagttattgttaggaatgatgtttgtgctcaagaattaggttgtcctgagatagaggtggcacatctagatttgagttattaaaatattgatgtgatacacaaagatttagtccaaaggacagtggcagcttagttgaagataaatatcaagtctttactctcactacttctgttgtagagggagtagtatagtcattggatagctttgaatcctactgggtaaaaccttctgaagtttcttttgcatcctcacttttcctaaacaacaggtcagtcattccagtgagttgtttggtgggtgtggatgatgctgcatcactgatactgctccctctgttaagtggtggtctggttatctgttgctgcatgacaaacagccatacatcctagaagcctaaagcaaccatttcattttgcttataattttgtgggccaagaattcaggaagaacttgcctgggattgcatcaggtggagaacgtggactcacagagttaccagacgtgtgttaagaagacactttggaggaggatgttctggagtcttcttaactcacctgtctggtacctctgtgctccttggtgtctctctgtcccccagtggtgtcataatctccccagtctccctgcacatggtttgggcttctctcagcatgttggtctctgggtaattagacttcttacatggcggctggctctcccaagagcaagcatttcaagcaatagcaagagggagctgtggatttcataaggcctggagttgcaggttgacatagaatcacttctgccatattcagtgcgttggggcagtcacagagcctgcccagattcggagaatgaggacatagaccctgtctctccatgggaagaatgtcaaagaatttgtggccatctttaatctaccacaaggccattaagcaaaaaggagagggttgttacaagaaatgctgaactgactttaccagcaaatgtaagcctactttatataatgattcagaagagactgattgtcaggaataagaaagggatagaggcaaaagagagcccc

SEQ ID NO: 79932 - DNA, 1031 bp, Homo sapiens
tgcctgccttagcctcccaaagtgttgagattacaggcgtgagccactgcacccagccttacattttattaaatagcgtttcttgacctatacagttacatgttatcttgaaatatgtgctaaatgtgcccaccttctaagcaattgttgtttggattctgaatgagtagtagttaagcacagaaagaagaatgctaataaaatgattgctaacattcatttgttatgaactatggattatgtaatcacctaacaacccatgagacacaaagtactattacgtccattttacaaatgagaaaacaagtacagagaggttaaataattcatccaagctctcatggccaggatgtgataaagcctaattttgaatccaggcagtctagtttttgagcttatcctcttaatcattatttgactctaaaattcattttagtacagttttatgaacagaggactcaggtatatgcaaaagtgtaaagtacagggaaaaaatggagaaagaacgtgatcacattccaagttgaggttaatagtgccttgaatgtgcccagttttcctgggtagaggggctaggtttgaagttgatccttcccagttacggtaactctcctacttcctccaaggtaagtgtttttcctggtgcagttaaggtgcctcatgatgaaaatgtcatctaactctctgcatctgtttattttggtaccatttaaccaacatttgttttgactgagttttcaagtaggccttgccttccacacattggctgctttctaggaactgggaaatgttgcttcttaagggtcttcacgttggtggttagtgacagaattgtgcagtctctagacgaaggtgtagatggatttgggtgtacaccatgtgcatatggagccttatttcagtttcattgtgcctgctgtaatactaaatctgagttggaatgtgttacacaatttttatgaacataatcaacttttgattatctttgtccatgtagagaaatagcagtttttgtaagcttaaggtgattt

SEQ ID NO: 79933 - DNA, 1044 bp, Homo sapiens
ctcacttgtgggttttagaataaaatgctagggaatcaccccgtagcattacactgatggcctaaaagaaatctgtgatagttgtaaattgacgaagatgcagtttaaattaacattcctcccacacctcactgtgatgaagaaacagatttcctatttctgtgtggagtgtgtgcatgtgttgtttcctcgtgcccgttagtaattttacttcaatttattaattttccttgtacactaatttcttgtggttagactgaatgattgatttcagaggtaaaacattggtgcattaggtttaacatgtttgattataaatatcttgactaaagtcaaagccttttttgcagtgtgctctgtgccctagagaagttataacatactctgaggcttgcagttcttctttccctgctttccccttgccaatagtccctgccctgtcctatgtttgcaatcctttatgaagttatcactgaactcttctctttccccagctccagttgtagctgaatgtaatctttcctgaactcacagctcttggaatacttataatttcatgctgcatgttagttatttgtaaatgtccttggagactgcagataccatatctcagatctttgtatttttccctagtatgcagtgtctggtgcagagtaggtgacatacgtttgaaagactgaattttgttaactgtctttcagaaatggggaaggttacatcagatctataatactgtgtcccctgatcatcttgaaggactaaagagccacgtaacatttttcctgcagacaacttaaatcatgatataggtgaactacttcatttccctcccaagatggacacccttgtagagcagtgcccctccaccttgatgtaaacaggagcccagagaggaagcatgcattaaccaggcagaacaatataaatcaggttactgttcattaagagagaaagcagtgcgaaaaggaatgattctgatttgacacaaacccacttcttaaggagataagcacattaacttgaaaatgaaaggtaaattaagat

SEQ ID NO: 79934 - DNA, 3793 bp, Homo sapiens
catggtttgtttttatttgaggaaattattgaataactggaaacaagcaaccgaaaagaaagaaatggtgactacctatagctggagggagaattggggatttttttgaaaagagattttgttttcagctctttgttttttgtttttgtttttttacaaagtcatctgtctatactgttttcttagagagaaggaaaaatcataatgaagaatctgaatgcaagagattgcactgagtacagtttaaatgagacaattgaaaaatggcagtttcaaaatgtatatgtaggcttcatcaactttctttacagtcctattcttttctttttaaaatatttttcccttccttttaaaatagtaacattgagcagttttgctgttatttcaaagaactgcccgccgtggagttaaggaatgggaaaacagcaggaaggcggacataccacaccaggagccaaggggataacaatgtgtgagttataagagtatgtcctttctggctttgagttacaaaacaaattactttcactggtggtttccattgtactaagtgagctaacaggcacatgccttaaaaaaaatcttctaaaaattgtgtttaaatatctagttagcaatcttaataattgttggaattccggccgggtgtggtggctcacgcctgttatcccagcactttgggatgctgaggcgggtggatcacctgaggtcagtcaagaccagcctggtcaacatggtgaaaccccatctctactaaatatacaaaaattagccgggcatggtggcgggtacctgtaatcccagctactcgggaggctgaggcaggagaatcgcttgaacccaagaggcagaggttgcggtgagccgagatcgcgccactgccctccagcctaggtgacagggcgagactccatctcaaaaaaaaaaaaaaaaattgttgggattcctttatttaccgtaacaggagggataaatttagcattctacttattgactctgcagatttgggcattctagaattggcatctagatatgaagtgcagttctaggtgtagatgactatgaatctcattagtccatgtgagttgatttgtccgacagtgttaggtaaacctgtcttggatactgaaattaatttgtagtcaacagattagttgtgggggaataaagtcaatttttggttgatacggagagggggggaagaaaacggacaagtgctcattaagaaccaatcctgtatcctcatttggtgtagacctcccttatttgtggttcagaagatctttcattatgacaattgtagtgagcacatttttcataactttacagctctttttcagaaggactgtgactcgtactccttatatatttaatgttttctctgtctgcctcctccacttccacacactcccattctcactcattctgaaggggtgatcagacactttcctgccttggtggctgagggagagtaggactgaacatgtcagaataatgggcagtagggcgagagtcacagtgcagggaaactggaaagccaggcgtggagcagggctggaatgacgtcactacaagtggtgtttgaagggagtttccctcacagcagcatctaggatgagttgagcagcatctaggatgagttgaaagtgcctgcattcaaggaggctttgcactctacagtaatcaggtcagaggggacagcagtgaaacagtagaaaaaatacatgtgtatgagttaagagaagagttagtagtacttgatgcattcatgtcatgcagggttgagttgcaggctgtagaaattgcctttggctgatttaggcagcaaaggaatttactgcagggctattggtgagctaatcatactgggtgagtgaaaaatcaggtctggagtccgaggcagcagcaccgcagtcacagtcaccccacagaactgtcctgtaaggccaccactgcctctggtgcccagcgcagcagcagagttcctgttgccagcactgctggagatgggtgctggcggacacagccatgctgctgccctgcactccggatggtgctctttgccccccctgctaccagagaggatttggtgccatcccttcttctttgtgtcactaactcctgcttcggatgggcaaagcccaggctgtgtacctgtgctctgactgcaagggagcctgagaaggcgagtgtctggctgtttagcttcggaagtgggaggcaaactcttaaaagtagggattctccaacataggaagagggttcaagtactaggaagtcaaaaatatgatttgtattccagggacctatgtgattgtgagggttgagaaagaagatattgagattctctgagataccaatcaagtatccgaaaatatggtgcttatgttgacagctatggaagttgaagttgagttggatcagtttagccacaggtgtagaaaaccaaaattaagtgacttaaacatccatggtttgtttcctcacataaaagtcagaggctgtctgtctagggtggtttgacaaagccatcgggctcctcctggctttcttttccaccaacctccagaggccctatccatccacatagtcccccatggtgctggggctccccaactccgtcctcattcctagcaggaagaaggaaaggattattataggactactctttctttttaagacatttcccagaatttggacacactcagttttttattgggagagtttatatgcccaggaaaaaaatgagcgttctattcatatgcgagaagagtgtggatattgggtgataggagaggtgtacagagagcagtagatgctggagccggtcagtgcacatagaggtgaaagtgacaagaggacctcccgcagaaaattcctgctggaaactggagaagtttaaataaaaatagtcatgagaaaatctgacttttggagttgagagtcactggtggagagctgagtggtgaaggttagtgacacaggctggagtctgggggtgctagtgagtggcaagaaggacaaggcaggagggggagaaagaaagccgaatgcttgttttgcattttgaaaatgtacattcttaagtcatttggcctataactcacccagtgctgtatggtttgcttgcgtgttttaactcaaagtgtacaaacatggcggtgcatgggcacactcagagttaaccatatggttacaaattagctttgtcagaattactgctacttttatgggtttttgagatgctcttatgtatctttcagactttcttcagaaaagaccaaatcctttttaagtgttcatttcctatatattaggcattttagatgggtggacgctgtgttgaaattgtagcctctcactaatctgagggcactgtcctttcctcttttgcaggtctttggtagaagagtttagaaagacactctgtgctttatggcaaggcagccagactgcatttagcccagagtccttattttatgttgtttggaagattatgccaaactttaggtaagtattatatgaagatatttttaaacattaatattagtgtttatactgttcctgaaataattcctaatgaagtggttgtattctaaatattctaaatacttaagactggtttggtgtttttttctttttaagaagaagagctgaaattgaatacatctgactaaacacatgtgtttatttaaataatagactatagaaatgtctttaacaagaggtggggtattttgttgctataaacataaagcccttataaataacttatgcgcactaggaaaacata

SEQ ID NO: 79935 - DNA, 1161 bp, Homo sapiens
attttctaggccactttaagttaaacctactgcaatgatgacaaaacctactcgagcaattctatttgaaaagtttgattccttttctaggaaaaggcttccttcctttactgacaaaataaataggctgtaactttattattactttttaaagtactgtttgtaagacatattgtcttaaatttttttttaaaagatggcattggggaagaaggattgggagctgtaggacctagtggccatttcagctttaggtttaatatctgtgtcactaaaaaaggacatagcaaaaaaaaaaacaaaaccctgctgaaaatgaagggactctaactgaccctttcatgctgatgttcacatacaagtttgcctttaattaaaatggaaactgcttcattaagaattacatttagactcaatgtagttcttccttgtaatcacttcctctgggaaatggatactcatcaagattttagctgcctgacatgtttaatattaagtttcatatataccatgacttaatattaaaaatgagtttcatttattataaccacaactgtttaaatattgaatacttattggataggctcttatgattctagggtcctttagctggcactaatgatttcctatgtgctataaagatcacatctgccacttatttcttccataccaccgtcctcaccttcaccttcagtaggggtaggtgtgtgtgtgcacaagtcaacaaagacattgcacaagatacctttttctagttgtagcaaatattcttagatcctgaaatggcttttccaatgcactgaaggaaatctgaatttttaatatttgataatgtttggtttctgtccctaactcagtaataaaacttgcaatcctaatctttaaaatgtcatgaaaagggatagattaatcctgaaaactcatgaggcactaaaagaacattctgagtattacacagtgtgattccacagggtgcccaggcatcatgtaaaatcataaagacatataccctctctcacctcacacagcctatccatgatagtgcccagttcaatatcctttgtggatgaatatgccatgataaaatacaaaacagaatttttcatttaatactttttaatttggtgctagcaggaagaacaattctcccaggtcacaggt

SEQ ID NO: 79936 - DNA, 1027 bp, Homo sapiens
taatgctgccaaaatcaatttgtttagattgtcttcgcagttttaccgacttagaagaacttgatgagacagagttatatatgtgccataaatgcaaaaagaaacaaaagtccacaaaaaagttttggattcaaaaactacccaaggtgagtgttgaattttgagttatgaagcaatttcaatgggaaagtgcttgactgctaagaccatgtctataactttacactatgtgaactgttctgtatttttctctaggattttcagtaaaagctaaaccccttacagaatgaatgcataaggtatgcatggaagaatgattgatagggcagctaaaatgttatttactgaactgatagtagtatcaaactttgactgaaaggtaaattaggtgttcacaatctttgaccgcatctctgtcctccaggtgctatgcttacatttgaaaagatttcattggacagcatatttaagaaataaagttgatacatacgtagaatttccactgagaggcctagacatgaaatgctacttactagaggtaaggtggttacctttttagcatggtgaaaaaatggctcttcagtaagattgtcatcacatggagagggtagaggtcatcgagatactgatgtcattgaccactgctccttcttccttgttctgtagcctgagaacagtggcccggagagctgcctgtatgacctcgccgctgtggtggtgcaccatggttccgggtgagtacaacagccagcttctggtgggtgggaatacctggtggccagcccaatgacctgcagttttgtaccactcttgctagttcttcctaaaaaatggattcagataaagtaggtgaaatttccttcagttttggtgcggaagagtactcctcagatgatgttgtgaaggcttaagggaaggtaaataaaagtgaaatgaagaatggttcatttgaacccagtatttacgacccagtctttatttgtccacaaactccaaagttgcttattcgtttaccaactgaaattta

SEQ ID NO: 79937 - DNA, 1122 bp, Homo sapiens
ctgctctgtgggggcatccctgcagctggcttccagtctgcaccctcttggtggatgggtatgaaggacaggtgccctcttactacactctcatcctgtgccaggcgctgtgcgtagtgtattctctcaagcaatcctgccagtcagagcttctcctcactttacacacacaggcactggaggaggtgaggacaagaaggaacatcttcacccagagcctcgagggccacggggcagtagggcctcagctcattctatctggcccagtctctgtgtccacttgacttaaccatgtggccatgttaattccatcttgaaggcagggagaggtcatgggcagccccactcccccttatggcactctgatgtccccagtcacggctctgggtctctctccacagccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattggagcgtggctcttggtattgcttcctgcggagcttctgactaggggttaccatcgaggcagacattagcccaga

SEQ ID NO: 79938 - DNA, 1042 bp, Homo sapiens
ccaaagcttcttacctttatgagatgaagtgtccacacatgcatagtttgacagcacatgggcacatatgattaggaatatgagtgagtggggctggcatcagggaaggccccagtgggctgagattttgtggtagagggaaggcaggctcctaaattggacttgaactggaaccaggagtgtaagaatcccacagcagggaggcactctaacaagggttgagaggcagggagggtgggcctttttgactgactctcgtgcctggcggtctgagaaacaagtagagggtctggggagcggacgagcaggcatcaggaggcgcctagccccacagggcccttggtgggtgccaggttcacgcacactcattgaatgagcaacctctcccgggagcaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgatagggtaagtaagctattcttttttcctttgtaatgtctgccttattgcttcattgttgtttttgttgagacagggtctcactctgtggcccaggctggagtgcagtggcatgattttagcttactgcaacctccgcttcctagcttcaagcagttctcctgcctcagcctccgcagtagctgggactacaggtgcgtgccaccacgcctggctaatttttttgtatattttggtagagacggggattcaccatgttggccaggctggtcttgaactactgacctcaggtgatctggtcacgttggcctcccaaagtgctgggattacaggcgtgagccaacac

SEQ ID NO: 79939 - DNA, 1016 bp, Homo sapiens
gcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgaggtaaatcctggccagtctatgtttctactggtgttgacgtcctatatgcacagactagaatttttctgtgtaaaattgagatacagtcttccacttgctgtctggctgaacaatgccatatctatgccattgctgcccttagcagctcaaccgcagcagtttaaacagcttctaatagagcaggctcctgcacttagttgctccttcccccttaatttttttctgcctgttagagtgaagaaccaaggtggaaggggaggcctgaggtcacgagagttcaacaggcttggtttgtgaacagagagattttgtcccatttttaactacagctggttgagtcatcacattcctgctgatcaagtagcctgatcagtcctacctgttttgtgttccttgtttttatccttaaaaattgtgagtttgttattgctgtgccgtatttgtatgtaaaatactttttgctgtcatttctaccatgtaataaaaattctgttttcttctgttcctagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtgagatgaaacatctcgggaggtacacatgaatgcttgggtttctctccaaatgagagctgactgggtatgccaaaatctgctaatatgtatttactgtgttaattcctctgtatgtat

SEQ ID NO: 79940 - DNA, 1008 bp, Homo sapiens
agcctcagttgagttatatgtgtcattgccattccaccataataagctaaatgactgatcagaaaatataaaagcactgtgttgtgtggtgcataacatttccacatgtttttgttttgtttttttcagatcgcctgataggcttgccagaggggcgtgctcgcaatcacaatcgaccgcaacaaatccctgtcctggctggagtaatcatagaagatgtggcagttggagctgaacacacacttgctttggcatcaaatggagatgtgtatgcctgggggagcaattcagaagggcaggtaaatatttatattgcttgctgctttctcatattctagaaatctcacagtgttcctcagttggggaaagagataagctaggaaattcataatctactgcaatactccaagcacatcactttgctatgggactgattattttgtaagtctagttatgtctttctctctcgactgcggccaaagaagtattataccatggtttaaaacaattctggtagtacagcaaagtgattaaggggattggctgagtatttatgtgtgtgtcctcatacactgttaagtgcctggcatgtagtaagctgcagtatgtaaggatttgctactgtcaacattatcatcattactacagcaagatgtgagattaggtcctgggaacatcagttgatatgggaaaaagaatgaaacaataatatttttatattttataatatgatggcatacaaagtatctttaggtttttgcaggaagtcttgtcactcccattatttataggattaaactgagcctctgagatactgataagagactcaagaggttgatgtattcaccctcctctatttatgaaggagggagagaccttggtgtgagatgtctgagatgctatgacggtgacttttagctccacatgcagagccacttccccttcctccaaaaatcctctcttggtctggcttcccctagtgccagggacccttaagttcaaggtcta

SEQ ID NO: 79941 - DNA, 1045 bp, Homo sapiens
cttaaaaaatacagatactagtagctcctgtctggtatccttgagttgtatggctgaattgcaacatcactggtagctactgctcctaagtagtaattatctctgtcttgtatacatcaagagtgtcctttaacaaggaaatatttttggctttttctatatcattccttagatactttttgatatgaatgaatatttttgggtcatgtatacttttcctctatctttcatactgattatggtttagccacagacatttgaaggatttcactttgaagaaaaaagttatatatggacattaagaattatttcttgttgacttactttggttaacatttgtagtatgctctgaaaccattgtagatatttggaaacatagccaagtttttcactgaagtagagaaaaagggtcccagaaacgggggagtgtgttttaggtcttgtgatttgccttacggaatgctgttatttctttaggtggcctgtggattaaaccacactttggcagtgtcagcagatggttccatggtgtgggcttttggagatggagactatggaaaactaggcttaggaaattccactgcaaaatcttcacctcaggtcagtactgccttgagtctaggttttcagacaacataaatagttttcatctatgtcagtagttattattagttggaaataatttacctttagtacttttggtagttcataatgaagtttagaagcttctgttgtgcattcttgaatgcccacatgctaggtcttgattttaaataagctattaatccagctaaactggatttaaaattctgcaaggataagcttctgtctccaaaaatgggtttcacactgtaggacctctgatgtagggaagaaatagttagaaacatatctccaggatgtcatggaaggaactatgagtaatcctttgtaaccctctgcatgcagctgccatttctgcttattattaccactgaattaacacaggtacacgtctccttttaagaaaacaatacaaaggaaatctgagtccatgaagaaagaa

SEQ ID NO: 79942 - DNA, 1092 bp, Homo sapiens
ttaggtgactattcgcagttttgctaggttatggctacaaattcaatttaaaactaaagaaattaggccggttactgtggctcatgcctgtaaacccagcgctttgggaggccgaggtgggcggatcacttgaggtcaggagttcatgaccagcctggccagcatggtaaaaccctgtctctgttaaaaatacaaaaattagccagatatggtggcacatgcctgtaatcccagctactcaggaggctgaggcaagagaatcacttgaaccggggaggtggaggttgcagtgagccgagatcacaccactgcactccagcctggatgacagagtgagactccatctaaaaaaaaaaaaaaaactaatgaaattattcttattttcatagtaccaattcggtggtttttgattgagggtattcagtagcagctgcaagtaaagaggagagttttaacatccagtgactcctgttgggtttctgttctgttccaggctttgtggtgacccagctggtgacttcctgtggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcaggtcaggcaggaaatggataagtttgcctttcattgtaaatatactagttgttgaataggtttcttaaaattaggtaacagaaaatatagtaaaaatatattacacagtaattataagagatccattggttttggatgttcagattcattcttgagcttgtcagaagtttgaataggctttggtgttagtattggtcttgttagtattggttagaatggtctttttcgtgagccagctggttggcccagactagggtgctgcacgcccttggaaggaatattgtgtggtttaacttctgccacacagttcttaatacacagataaaaggaaaactttgcttttaacctatcatttatgttacaaaagctaagttaacatgcattttctggaaaatagtgttctaaaatcatattgtaa

SEQ ID NO: 79943 - DNA, 1393 bp, Homo sapiens
catttcataatctattatgaggaatcattaaagaaagtcatgatatatagctttcaaataaaaacttggtgtggtttttatcagacttaagaagttaacaaatttctaaatttttctttcaagtttaatgaactaacatcatgatgtgttaggcctgcccagtatgtatttctagcagtttagatactcctaattagtgattttctctttggggctaaaaacttcctaggatctttagccagattttatcgaccactccccttttctaataatcctggtacgatatagcgccaaacccttctcgaggcctctgctttctcttttgctcttctttacctcagctagtccagattgcatgactcattcttatgtacgagtttctgcttctttctagcccagtctttaatgtttccccatcaccccttcctttttctttcatccattttgttgttctaaactattttaaatggatgaatctcatacatctcttggttaaataagcagttttatagtcatcaaggagttacgggactgcatagttatatcaactcttccctttcagtaaaaggataaaacaattataaaagcattctatgtatacgtggaatcatttcaagtgcttgcatgttaaagcaatataataaagaataaaatatttaattctgtgtttttatactaggtcatttgtggtcagaattgtacctttgtcatccaggccaatggcacagtgttggcttgtggggaaggaagttatggcagattaggacaaggaaattcagatgaccttcatgtgctgacagttatttcagccttacaaggtaaaattgtccttaataaaaagatggttagaacctaaggcctaatgtaggtttggtcgtacaaacctttgcccttctcaaacctttgctagataaaatcatatcaggttttcacttacatttaaatccttatttaggcatgtgtgcagccttaatttccatattttaagctatattgcaggttacttatagcaatgctagaattcagtgaaatataaataacactttttgagacccactgaagattgtaaacaaatgcttaaaaattgcaaaagtgtaagtaggcagatgttaatagcagtagcaatcatgcatgtatttcattaaaattaaaaatcagtttatatggaaatctgcaaatgtgctaaagactttaaaggacatcttcatcagagttctttgtgacttggagagagaacacctttggagaaaccactgtacaagcccccggcttgctcattaactgaactcataatgactctgaagcctacaaagagagcaccgacggtttttttaggtaaaagcatacaagtaactatgagttcaaaacaagttcctagaagctcaggttcttt

SEQ ID NO: 79944 - DNA, 1044 bp, Homo sapiens
tgggtgtgatgttgttagaatattggcctcggttgtatttcttgtaaaagattgtatgtactacaaataagtttaaaaaataatgcagtggttctatcagatcttaattgattgcaattcggaaatatttttacttaatgcatattgacatgttttggttttatgtgatcaatttttttaagtggctgtcagagtggcttagtatgtgtttggcgcattcctcaagatactacacagaccaatgtgactagtgcagaaggatggtgggagcaggaatcaaattgccaggtaacattctggtgtttttgaagactgtctgaaactatggaaagtatatgacatcagagtcattctcccttggttactaaaaaagtcattactatatcccaaagggcaagatccattgggaaatataagtaattgtcatcctgaattagcttaattttttataaatcagagataccataattgcttggtaaaatgagatattctatacatattaagtggtgactgttactgtgatagtggatataattgatactacagatagacgagtcataagttgttagtacattaaaatagaaactccatgggagcacatccatccaaagaatctccaactgatgccagaatccttgctatgaagaatgatttatttatattaaacagaagttacaaatgtatatatttatagagagccctctaggcgagtaacataaattcatgaagctagggttagaaggtttggagagggtaaaaagcaaaaacagaaaaaaaaaacaaagaagcttacatgctttatataaaggcacacagctgattgtcagtttctagaattaagagcctgttgttaccagattgttttattttttctatagatgctaagaatccaatgtttaagtaaaatctcccaatattaaacattggcacctaacttaaaattgtttaaaacactgagtggccagtcagatcgcatctctgagctaccagtttgtacattctgttgccttccttttgctcatgatacccttggaagaaatacac

SEQ ID NO: 79945 - DNA, 1050 bp, Homo sapiens
gattgtgagaacagaacattttgatagaatatggaaacatactgaatagggaatattaaataagcaaaaaaagagatgtaattttctttctatgacttgggttctttcacttctcagtttcatggtagattttggtccaaaaggaaagaacctatggtgacttacaatcagcaaaggaatttaatttttgtctctatttttcaacaaccacctgaaaaagaatgaaagattataaagtaggtagcccttgtcacagataagcgacacttttaaaaagtatgttacatggaatccccactgtacgcctacattttgtctaaatgcattaaagagctatttggaaatttacttgcaatggttgcattatcattatttgtttcaaagtctctgtcttttaagtcagacaatgacaaataattatcttttccttactcttttgttttgatcatgttagtgtctgttacttgcattgcatggttcagtgaagacagaccatttgcagtgggatattttgatggaaaactgttactgggaacaaaggaaccacttgagaaaggaggcattgttctaattgatgcacataaggtaaatgcatctttaaaaaacgtaattttatgggatacaaatataattttgttacatgcatagattacacagtggagaagtcagagattttaagatatccatcacccaaatgacatacattgtacccatcaagtaatctctcataatccatcctcctcccagccctcaccttccaagtctcccttgtctatcattccacactctaggcccgtgtgtacacgtgagttcccttttcaccactttcttgccaacatctgttgttttttgtctttttaataataaccacttaaaagtgaaaaaaatgtaatatttgcctttctgtgtctgacttatttcacttaagataatgggcttcagttccaaccatgttgcttaaaatacctgatttcattctttttatggctgcatagtattccattgtttatatataccatgttttcgttatccagtcatccattgatggac

SEQ ID NO: 79946 - DNA, 1065 bp, Homo sapiens
aagaattaagtaaaaactagttaacattttttcccttttaggaggaaaaggattagtagatattcagcctcattgggtatctgccctggcttggccagaagagggtccggctacagcctggtcaggagagtctccagaattgttgttggtgggacggatggatggatctctgggactgattgaagttgttgatgtgtccaccatgcaccgtcgagaattggagcattgctatcgaaaggatggtaaatgactgcacttacgtctagctgacggagtctccaacttcctttctagacttagctttttggcatttgcttttaaaaataccaagtgaatattatcttggctttgttttcaaaattttccagtcatgttttaattttaattagttactgaattgaaagatatttatctcctagcccccaccacacatctctgtcaaaatgagatttaatagtattataacattagtaattcatcttttgtgtggcttaatatttatagcagattccaagtctcctttgaaagttaggactgtccaagagaaaaaaaggtcataatcattggtagagatgaaattgttttttttgtgtgtgttttgttttgttttgttttgagaaggagtctcgctctgtcaccaggctgaagtgcagtggcgcgatctcggctcactgcaacctctgactccctggttcaagctattctcctgcctcagcctcccaagtagctgggattacaggcactcgccaccacgcccagctaatttttgtatttttagtagagacagggtttcaccatgttggccaggatggtctcgatctcctcaccttgtgatccgcccaccttggcctcccaaagtcctgggattacaggcgtgagccaccgtgcctggccgagatgaaattgtcttttaaaaaatgagtaaaattgaagtaatggaggaaggggaagcagggaattcctggtctgacaagagagattaggaagtctgctttcttcttactgtggtgttcctttgaacgtgaatgcatctcacaagattttgttggttgtctgggggaagtg

SEQ ID NO: 79947 - DNA, 1034 bp, Homo sapiens
aagaagccagacacaaaagagtacatatattaattattcaattgatgtaaagttcaaaaacaggcaaaactaacttgtagctttagaagtcaggatagtggttacttctgagagcatcgtgactgagaaaagcccaaagcaggtttctgaggtactggcaatgttctgtttcttgatctggagggcggtgacatgggtttgttcagcttatgaaaatttatgctttgtgaacattcctgttttactttgtcagttcaattgtacttcaagtatatgccaatacttattaaaaggagagaacgtttagatgccagtttccagcttgatacctttggcaactcttaggacatgtatggctaatgatagtgcagcttacattttattatggttgttgatgctgtgaatgttatgtgggactgcaaatggtcccttaagaaatccattttctttatccatctgagatgtttttctttactggcagtggttccagttgtagcctggctgctggtcttgagtctctggggctaacagatatccgaacgctagttcgattaatgtgcttggcagcagcagggagagctggcctctccaccagcccttctgccatggctagcacctcagaacgatcacgaggtgggcatagcaaggctaacaagcctatctcttgcctggcctatttgagcacagcagtgggatgtctggcatcaaatgctcctagtgctgccaaactgcttgtacagttgtgtacacaggtaagctactttcagtacttttccccgttacattgattatttctgactgattcttgagccttttgaaatgaaatatttttgttccaaaattacatgtaaaaattaagtctgtttttccaattgcttcttcagaacttgatttctgctgcaacaggtgtaaatctaaccacagttgatgactcaattcagcgaaagtttctacccagctttctccgaggaattgctgaagagaacaagcttgtgacctccccaaactttgttgtaacacaggcccttgtggca

SEQ ID NO: 79948 - DNA, 1050 bp, Homo sapiens
gcagaagggatggaggggtttcagaaattcatgttcccaggaataatggcatagcaacatatccttccctggagtttgactgtgttaacctctgacttgttggcaagtaatggtcaggacccttgccttaaccctcaggaggcttctactcaattcttttcatttgtattttctaccatatttctggcattttaattaagatctttttcctgatgaaaaaaacagacttttgattaaacgagttccataaaaatattatctctttacatccttaatccctagagagtaggtttgttgcccttaattgtcaactattaaaatctttaaggctttatggaatagaatttggttaaaagagttgttttaggtaacccagaaatctccccagtagtttggtaaaataatcattgattttgtaagcatgtgtgtacctacataccagcagtttttattatgttagcctataacatgaaacatacttttttattttgtgctgctttattaatgacctcttaaaatgttctaatgacttaatttgcatcttggggtactaactgttttatataaaaatgcaatgttcttcatgtttggtgcaggtacaagggacaagctccagatctaattggcaagcaagacagtgtgtatgaaggtagtttgttttgagagcttctttattttacatgtttttttatatatcctctctgcttaacatctgttactaaaattcaccttcgtgtgtgtgtgtgtttgtatttgtgtacatgttaacttaaattttcccttaaaaactcaagggaatttaatagcaacaacgctggtttaaaagtcaaaggaaaagaacgtggtttcaaagaccaactttaccacagaatattaatttctattaggtgtatttttttttcaaagtagggaaaggatgtggtatattttgaatttccaccctaattgtggaaagtaaaaaataaatagagatgagcattgatttttctggagcactcattttcttgaaataactcattccctaatgattacagacagctaagaactctt

SEQ ID NO: 79949 - DNA, 1251 bp, Homo sapiens
atcacttgaggctaggagtttgagaccagcctgggccacatagcaagaccctgtctttacaaaaaaattaaaaaacggttagctgggtatggtggcatgtgcctgtagtcctagctactcagaggctgagacaggaggatgtcttgagcccaggggttcagggttacagtgagctgggattgtgccattgcactccagcttgagtgacagatccagatcctgtctctaaaaacagcaacaaaaacattataaagcatcgcatggattctcttacttaaacctatcaataacccagtgagatatgagtgctattattatccccttttgcaagagaggaaacacacgtgataggtataatttgatgttttatggtctgagatccaataagacaactgagataggttctcacctacatgtatggcagttaagaactggcgaaatattcagaattattttatgcatgcaaataaaatgccttttttgttttgttctgagcgggattataccgctctgtgcaggcccacaggaatcaaagtcggagagaaggaatatctttgcagcaagacccaggggcgttgtatgactttaatttagatgaggaattggaaattgatcttgatgatgaggcgatggaagctatgtttggacaagacctgaccagtgacaatgatattctgggaatgtggatcccagaggtactggattggcctacctgggtgtgtgtgactgcagcgggggctgctctgacttattttcctgccctcctgttcatatagcttactaacagcagccttgcctagagttgaaacactctaaaaagtcttttatctcatcctgaggtttggggatttaaagttatgaggttactttgatacctacaaactaataaggaaaagtctctcttgctttctctgtgggattttattgtttctctccccagacaagatgaatagagtcatactgtggtaatatttgattctgatgtcaaagataaattacaaaacaagcatcaggttccagtagacgttgacaggttatataacatggctgctgtgctcacattgctatctgaatgcatgttcttctccttcataggttccatttaatcaatgtaatgccttattctaggaaccagtgctcacctagatcttgtaaatacctccatttaggggcaaggtacatggtggatttgtatatacattggttagcattacatttttgtagtagggagaccaaaaagctcatagatgt

SEQ ID NO: 79950 - DNA, 1019 bp, Homo sapiens
gccagaagaaatttcataatttttgtgtaaaattgtactgaaaaaggaaacaagtttattttgaagtaaacatgctaataaaataattttatctcgtacaagtgatataaaatcgagtattcattttaatattggacattgatttaatgtatttgatagaattgaacttttttttttctgagacggagtctcgctctgtcgccaggctggagtgcagtggcgcgatatcggctcactgcagcaacctccgcctccccggttcaagcagttccctgcctcagcctcccaagtagctgggactataggcatgtgccaccatgcccggctcattttttgtatttttagtagagacagggtttcaccatgttggccaggacggtctcgaactccagacttcgtgatccacccaccttggtcttccaaagtgctgggattacaggcatgagccaccgttcctggcctagaattgaacttttaagtcttctctgtgtaatatttatattttcatctcttctatagtttttaatatctagtagaagatgcccctttaagtgtaaaaagattgctgtgataatgcctatcctaaaatgagatgtatagaatatcttacaaattctccctaaaatcttttttccttcatcacttcttatgactttaaatctttatttttcattttaactatggagccatatagtaaccaaggcttgtgtcctagatggcatgcaagctttttccaacaagctcagtgaatattttcataacgtatttcaaaatacctgtttttcctaggcaagaattctcaatcatttcaaattttaagtatttaatcttttaggatttagttaaggtcatatttgatctcatttaaatttgagcttcattaaacatcattttgttgttggaagaattcaaaatcagacaaagttattgctcaggtcacaggaaatgttatatgcataattgaactgttcaagggataaagatgtgtttcaaattttatcataaacatattttattct

SEQ ID NO: 79951 - DNA, 1066 bp, Homo sapiens
aaccattactttcaatccatgtgaataatttcatgactagctagtgagtttatattaatatttaaaagtaactgcaagttacctatctttaaaagccttctttgcactgtaactgtacataccaaattacccctcttatcttggtattatagttgaaggaaagctctgtgaaggcaggcatttttcatctattttgctaatggctgtattcccccaacctgctttgttgctggcattttgctgaaagaatcataaggttttattacatttatactgaaagtgctgcatgagataatcatttttaaaactaaggagtctttctccccaccctccattaaactataactaacctgtttagtcttccaggttgcatattcttctataagaagattgtgatgtatgtattatttcgtaaattggatttttatgctaaccactgttattttcttaaaggcaaatgttctctagttacccaactaccactgtacttcccacacgtcgggcacagactcctccaatatcttcgttaccaacctctccttctgatgaagtaggaaggaggcaaagtttaacttctcctgattcccagtcagcaaggccagctaaccgcacaggtgcgtgtgctgatatgcactatgatatccaaagttggcattccagatgtgtgggactttattatgtgggcattgtgttttgtcttcacagaaggtaaaacagtgattttaatgaaggggaactgccccattaaactgagctatgatcttcatgttgaagctgtggattgaattatggccatttcggagagaaataatgtgctgtacattagtcatatcagctcttcatttttcccaatatagccatttttagtgttgtaagtttccctttaagtactgctttagctgcaacccacacattttgaaatgctgtgttttcattttcatttaaagtactttctaatttgcctttgatgtcttctttgccctctggactatttggaagtatgttatttagttttcaaatatttgggggattttctagatatcgttttgttactgctttctaattt

SEQ ID NO: 79952 - DNA, 2070 bp, Homo sapiens
catgcaagtgtcgacctttcctctcattctttgccttgtttcagaaaggatttatgatgcctggttaagatgcatacagtaggctgggcttggtggctcacacttgtaatcccggcagtttgggaggcagaggcaggcagatcacctgaggtcaggagtttgagaccggcctggccaccatggcaaaaccttctttctactaaaaatacaaaaaagccagccgtagtggcgtgcgcctgtaatcccagctactcagggagctaaggcaggagaatctcttgaactcagtagtcagaggttgcagtgagctgagatcgcaccactgcactgcagcctgggtgacagaacaagactccgtctccaaaaaaaaaaaaaaaaagatgtatacagtatagcaaaataagtgaattaataaattaaaacaagaaaaatgagcctagaggaaaatagaaaggtaatatagaaccaagatttaggttagaacaacaaaactttataccagcaaaagctttttattacattttgtataattatatcattcttaaacttcaggaagttcttgccaatatcaggaaatatataattatattttggcttaaactatagaggcattatttgagactacaaagtaaacttttttatgaaatgaagtcctcactgaaataagttataagtaaccatttataaactagatttattatacaaattttctgaatagcttacatcaaactacatctgaccaacctcctgtttttataagtaaaggtacacagccacacccatttgtttagttgtatcagtggctgcttttgcactatgatggcagggttgagtggttgcagctgagactgtgtgccctgcagagtctaaaatatttcctgtctggccccttacagaaagtttgctaactcctggcatacattatatattagtgaatattcttatttgaaagcatctcattgcttctgcatttagtatcacatctccccattttctcataatagactcgtttttctctgtgtttgtaatgatttctctagtttgtgtaaattattctctgtattgtgtacatgatgcaccttattttgtctacattattttccgtaccttcctcccgtctttccctcacttgcttcttcctgtgtcattctgatctttattaaagcttcccaactttttggtcgcctagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacagaagggaaaagaaaaaatcatgaacacatgtccaaaaaccatgatgtagcccagtcagaaatcagagcagtccagctgtcctatctttacctcggtgctatgaagtcacttagtgcccttcttggctgtagtaaatatgctgagctgttgctgataccaaaagttctggctgaaaatggccacaactcagactgtgcaagttctccagttgttcatgaagacgtggagatgcgagcagccctgcagttcttgatgcgacacatggtgaagcgagcagtcatgcggtcacccataaagagagcattgggattagctgatctggaacgagcgcaagccatgatctataaattagtggttcatgggcttttggaagaccagtttgggggcaaaattaagcaaggtatgttatctgattttttttttttttgcttttgtgctgttgagattattttcataattgtcagaagtgatacattctgtaagtgatttgtaaaaaaaaaaaaattttttttttggtcaaagcaatttt

SEQ ID NO: 79953 - DNA, 1455 bp, Homo sapiens
tgtatcaattaatttattctatctagaaggcatttttgataaattttagaacctctgagaaacacaatactaatagcagttaaccttttttaacatttacagtgtgactggcaatgtactaataagcactttatgtgcataatctcatttaatctttaaaataactgtaggagacagatgctattattagtgtcaggttttaaatgaaaagctaagacttagaatgattaaataatttcccaagattatacagagttatgatttgaacccaagttttgctcctctttttacttctgtgtcttatttgcagtgtgtatccagattgtgactttatgattttacttttgcaccccttgaacaatgtaaaatgtccaggactcatcattctggagccttgaggatgagaatgagtatatccttaaggcttattttagactaaattgagtcagtcatatacggcttggtctctatattcatctttcaaattttcctaacatctctggaattcatgagttacaggaaatgtaaataacagggcagcttattccagtggaccataccactactaacttcagtgtgtctgtgacatttccttactctttgggggccagttggtataattcacatgtatgaagagacccaaatactagttcaacatgggattctacatgttagaatttatagtgactaagaagaactactaatagcatgtgttttccaccctctttacttttatataggtgaaaatttgtgatatgcagatgcgtggcacaccccgagacttacttccaggagaccctatttgtagtccagtagcagcagtgctggctgaggccactattcagctcatccgtatccttcaccgaacagaccgttggacttactgcattaacaaaaaaatgatggaaaggcttcacaaaattaagatatgtattaaagagtcaggtcagaagctaaagaaaagccgctcggttcagagccgagaggaaaatgaaatgagagaggagaaggagagcaaagaggaagagaaaggtaaacatactaggcatggcctcgctgacctctcagagctgcagctgaggactctttgcatagaggtgtggcccgtgctggctgtgataggaggagttgatgctggtcttagagttggaggtcggtgtgttcacaagcaaactgggcgccatgccacgctgctgggagtggtcaaagagggcagcacgtctgccaaggtccaatgggatgaagcagaaattactatcaggtatgatctgttgagttacacttttagcaaacaaatatttaatggtgaaataggccattgcctgtcgacagtgagtaattatgtattttaggtgagctgccagttaacttttaaaaatatttctcatgcagctagatgtttctactgtaatttcttaaaggagaatttcctaaacccatgttctttgaaatact

SEQ ID NO: 79954 - DNA, 1022 bp, Homo sapiens
ttaaaatctatatgtaaagaattaaagttttcattaatttctggactaaacatacttcctcagcttcattattaagttgtaagttagaattgcttattttaaatactatagatattcaaaggttattctaaatgccctgcaagataaagaatgttttaaaatctttctaaattgatgcgattattttcgtgttatttttatttatgctgaaaataacatgtttccataaatgcattagtattatttataaacatattttcagtattggttaatgcagttaatagtatataaatagattttttgagtattaatgaatatcccacttttattttagttttatattgtgaaggaaaacagaggtaatgaaggcacgtgtgttggagtttctcgctggccagtacatgactttaatcaccgcactacctcggatatgtggctctatagggcctacagtggtaacctctatcacaatggagaacagactctcacattgtccagctttactcaaggagatttcattacctgtgtgttagacatggaagccaggaccatttcttttgggaaaaatggagaggtaccgacacccattcacaagcattacatttttcttgtttctatttatagtcaactcggttattcaagtgccacgtattcagtttatagattatctgctcgtctctcctttctctctaatactttctggttcttaaaacatttattaacaacaaacaggaagatagtaaaaccccaataagatttttgaaacagatgaacacattatgatcacttattatatgtagaattttctcggttagcaaggttaattgagaatttgatctagtaacttttgttctgtctcataaaagctttcaattctaatgtggttagatattgtgaattaaaaaaatttctatttcctttttcttttcctcactgctgccacactgtaggaacccaaattagcttttgaagatgtggatgcagcagagttgtacccatgtgtgatgttctatagtagcaat

SEQ ID NO: 79955 - DNA, 1027 bp, Homo sapiens
aaattcaaacaatatgacacacaaggttttccatgatttgatttcttcttctctttctagacttgttttctgccagtttcatcttccagtcattacatgctgcttgtctttaaatcactgaactctgttgcatgtctgccttggcacatgctgtacacactgccttaaaatgcctctctcatttgaccagctgcttactgccttctcatcattcaggactcaacttagaagtcatctccttttgaacattaccttgtccttctcaagcatggttagacacacttttatgtttctactatacctattatgtaattttgattattctcccactgtaatactagcagtatgtatttgtcttctgtccattaatgaccttaagctctttatggggaagggaccatgctctatttatcattgtgttcctgttgccctgcacagtaactgattcatagtagatacataataaatatttgtaggataaaaccaaggagcctcagaatatatcttatctgagacatggattattccaaaatgctgacccagcttcttttctggtagaagcagggcgagttggaagaagaagatgagaatcttcctatccaagaagtatcctttgacccggagaaagctcagtgttgcctagtggagaatggacagattttaactcacggcagtggagggaaaggatatggattggcatctacaggagtaacttctgggtgctatcagtggaaggtacgtagaaaatctaatagtttttagcattttgtcttttagtccttttttttccaggttcttataataaatgtgtagaaagactgaaaaaaaatcgtgatatgtaaatgttctattattatgtaagataatataaatggaaaccaagtgaaggatatacaggaactctgtgctatttttgtaacccttataattctaaagttatctcaaaaatgttaaaaatggatgtttaaaatcatgctatagccctcccataaggagtcacacagaacacattttcttctagcaatga

SEQ ID NO: 79956 - DNA, 1054 bp, Homo sapiens
tgggttaatatttctaaaaactgatatttaacttataaccactaaaagtagctgttgaacactggtataatcaaacttcgcatgcgagttaatattacagttaacatgatacagcttttctaaaaatacttaaagttactttttacaaattttatccttttttcttcaataaaacagattgttgagcgcttattttcccttctctctgattgtatgtgggagacacccattgctcaggccaaacatgctattcagataaaggaaaaagaacaagaaataaaactacaggtaattggtttttcctaaaaggtatttcttaacagcataagtgaatattctgtcacttgtctctgaatgcctgttcctctgaggcaccttgctctatcatttattccatttcctctcttggcattctgtctccctttccactgattccctcccctcagcttataaccatgcttaactcatttcctctctcctaaatcacatttttatctgtgaagtcttctctgtcttctctcttgtcctgtagtactaagcttcttagaagagtaatctgcatgtttcagccactttcttctcattatctcttcaaccccaccatttatcttgtatcaaagtacgaaattaaatgacaaagataagtgtttgttgctaaatatagtgtatccttttttttccacttcttactttacctctggaaactctagccttttgttattttcaaaacgctttctcccggatctccgtatattctctgccaatcctgattccctttgaaagcaactcttttttggtgccacttttaccttgccttcatctcaaaatgttggtgttccacagagtttgatccttggcttttccagcagtctcatccatacctaaagcaggggaccaacatgctttgatttatggttttaaaagatcactctgcagtgccttccaaacttaaatgctagcctgggtgtctccccctcaaacccttcccccagcccctttttttgtcccatttctgattgaaagcaccaccattcacctagtttcccaaacgcaa

SEQ ID NO: 79957 - DNA, 1050 bp, Homo sapiens
agtcttattttatatacgaggaaacaaattcagtaagttaagtgactttcccaaggccacacagtaagataaaagagtctgtccttgaaaccatgtctcctacatccaaagctactacttttcctattgtactctaaccttttttattctgatgtgtgcttatagagtttttagaaaatcttcaaaaaaagtaataataataaaataaatgtttatcttagaatagattcatatgaaatgtcagaattttctaagtgttaaaaatactgtttttggcatacagagtttcatcatgtctgagttaagtgaagaactctaaaatatgtttttttcctcaagcttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggaggcaagggagagagtggccgattgcatcactatcaggtaggtgacaccttgcagtatatacagattttaactgtcattttacaaagccactttaataatgtgaaactttttggtgtttatgattcagtttaaaaatacaaagactttaaattttttaagatagctccttggttccatttcctaaataatgcagtagagattaggtgagctgtggtattattgtactattgtagattatttgctggctcggttttattaatccagttttattatccagtttggatgggaatagatccaagtaaggatagggattggagtttgggaggatgggtttcaagagcttacgttttagatttgatcgtttacctagtttgtgtgattcctttgataacttagaaaaaaatgttatctttatgtctttcatatttaggcaggaaaaactgctttgtgaggaaatagattatacagactcggccgggcgtggtggctcacacctataatcccagcactttgggaggctgaggtggtcgg

SEQ ID NO: 79958 - DNA, 1173 bp, Homo sapiens
gacaataggtcatcagagccttttttttttttttttttggagacggagtttcgctctcgttgcccaggctgtagtgcaatggtgagatcttgactcactggaacctctgcctcctgggttcaagtgattctcctgcctcagcctccagagtagcagagattataggcatgcgccaccatgcttggctaatttttttgtattattaggagagacaaagtttcaccatgttggccaggctggtctcgagcttctgacctcaggtgatccacttgcctcggcctcccaaagtgctgagattacaggtgtgaaccaccactcctggccctgagccttcatttttgacccatttgtctcagtttaaattagacacctgcttcaggttagaacctcacagaaataattgctgcaatcaagacccactgttgaatgctaaaatgagtgagcaaaacttgaaagagacataagatgtttgcatagccttaaagtatcttcccccaaatatttattaattattgtggttttaacatgtccacaattcttccatagttctccctgcaggaagtggagattaattcttctctccttgagagtgagctggacttagtggcttgcttctaacaaataggctataggaaggagataaaattgtaacttcacattgcagaaacctggcaggtattgccttaactaaatgattaagattggccgggcgcggtggctcactcctgtaatcccagcactttgggaggccaaggtgggtggatcacctgagatcaggagtttgaaaccagcctcaccagcgtggtgaaaccccatctctactaaaaatacaaaaattaactgggcgtggtggtggatgcctgtaatcccagctacttgggaggctgaggcgggagaatcacttgaacccaggaggcagaggttgcagtgagccgagatcgcgccattgcactccagcctgggcaacaagagtgaaactccatctcaaaaaaaaaaaaaaaaaaaaatcaagattaacatcacctgtattaagtcatgtcgatatagtgtaatgagaacactttatgtggtattcttcccccaaatccataattccactgtagtcatgagaaaaaaatcagacaacccaaaatttagggacatctacaaaatatatgaacagctcttccgaag

SEQ ID NO: 79959 - DNA, 1032 bp, Homo sapiens
atttttttccccttttagcttgcctacatattttatggtttataaagtatgtattgcagctctgccatgttcattttgaaaattccatttaaaaaccaaacttgtaaggacaagtaaacaatctcaaaaattttttgttggattttgtattttctttatatagtaggtgattctgaattagtattaagaattgggcttagtctcaattgttatgtagaagcttttaatgcccttttcagatataatatttcctgtattcagatagtacagagcaaaccaaagttatcagattgttatacttaaaaaaaaaattaaagttctttcctctcccatttccatattataaatttttgtgttttaagtctttttgatgtcaaactaaatattttgatggaaattatttatcctgatgcttccacatagtgtgtttcctgttcttaatattttatttatacaaagttacatttgggttaatttcatccgttagggctcagcagactacagctaggaggccaagactgacctggcatctatttttatcaggttttattggaacacagccacactcatttatttaagtggttgctttcatactacaacagcagagttgtgtagttgtcacagagaccttatggtctgcaaagcctaaaatatttactgtctggccctttacagaaaaagtttgccaacccctgctttaaattgcagaagatttaattttgggcttcgtcagccattccatagaatattttggtttatatgaagacagttcagtattggtagattcataattgaacctttatataggcaggcaattgaaatttccatcagtgatttgtgagttggttaataatgaatatgtaagactacctcccataaaattaaggaattaatgtcattatgtgacaaaccaatttttttgtgcctctgtttcctcatttgtgaaaattggactaaataatctttaaggtctctttttcttctgcagttctaatatcagttccttgcgcattttatattcattttgaaaag

SEQ ID NO: 79960 - DNA, 1056 bp, Homo sapiens
aatgtatatcatttggcgctagagagaaaatggctccagacttactgagtagcataagaaatccaatttatagtttatactatattagttaagtttataagtaatagttcattggttaaaattgttttctctcaaatctctatcatgcatatggaaatataatttgagattcagtctgtgttaaccaggtcagcatgtacaaaataatatctttggaataaaagaaagtagaatcttcatctttccaactaagaaaaaactgtaatttgaatgtgaattacttaggcatggatataacacatttaggagattatattttcaaagagattttacaaaaatattgtatatttagtgactgccctttgacacagtagggtttttttgttttgcttttaaatgatagtaaaataaatgactgtattttttttccttttttgtcagtatagaccagatgccttaagccataaaatcttcagttgggcagttgaacctgccaagtctgagaactgtttgggagccattcaaactgttgagtattctgattctgacttgagccatgaaggacaaacaaatgtccagccaagtgagaattctctttttttttctttcttttttttttttgagacagtgtcttgctctgtcacccaggctggagtacagtggtgcgatcacagctcactgcaccactgaggctcaacctccccaggctcaagtgaccctcccatctgagcctctcaagtagctgggagggactgcaggcacatgccactatgcctggctaattttatttatttattttatatatttttttattttgtagaaacggggtttcgccatgttgctcagtctggtcttgaactgggctcaagcagtccacccaccttggcctcccaaagtgctggaattacagaaatgagccaccgtgcctggccaagaattctatgtgcttgtttaccccttccaatattttgaggaggaaatgtaaaatgttttccctcatacagcatttgcatttactagtctcagtggtcttgaattactaaaagcctgatgaga

SEQ ID NO: 79961 - DNA, 1667 bp, Homo sapiens
ccaagtaggcagttgtctacatccccccaccagatacacaggtaacacacagaaatatacttccattcttcttgtaagccttcactgctttattaaactgtctgtagttcaccagttttgagatttgtctattgtaataggttttttaaaaagacatttaaaaatcttttcaaatactaccagaaggtttaggactgttatttttctgttagtacggagactatcagattttcttcttctaaacacctagcgaaggctagtggaagttttgaaaagaaagtgaagctagaggaaggagtagtaattttggaaaataaggcactacttcaaggctttaggcatccggaaggtgctaataagatcatactgtgtctggaagataaaagacaaagattccaatggaaaaaggtaacaaaaactactgctactctgcaatgttaattaatgtgagttttttagttagtgtttcagagttatatgtgcttgagcctccttatagctatgttcagtgggtttttagggacattttgttattagtttgacttgaatgatgaataagtaagacattgctgtaattacatgaatttctattctaatactctattaaatcttaatcttaaaatacttttcacaactaaattttatttatttactttttacttttaatagagtggcagacgaaatgttgatttggatttggcagcatctcacagaaagagaggtaagtgtaagtattaagaacatagtaaatatcttagtgagaccctgtctcaaaaaaaaaaaaagagcatagtaaataaattaagaagctgtttttatatctgatgtatttagatatgattgtctttgaaatgtaactgcaaaaaatttcagaatcattttatcagaagagttaaaacgaagactattttctttaaaatatgtacgctttaaaaatctgggaatgtttaggagttaataatcagttattttctcatttgtcatgtattttgactttttaaaagtcctatagaattctaaaaacagtacattccattatgatggaaaggggttatttacaaaattttccatgttttagctcacagagttgttacagtttaaatggtgttacagggagaacttcttaccccgtacacgtgtacacacacgttgaaataaaaagtttctattttttttccctcttggcctattaagataaagcatgtaagagatgctttatctcttacatgaagagatattatatctcttacataaaaaatattttaaaaatttcatgaggaacaaattagagtgtcattgagagttaaggtcttttgttaatgaatagtatagttaactcatggttgtgtgtacaaattgaggaaaaacccagcagttttagatagtgtaaatccaatgataactaaaaactctcttaagcatttttctctattaactggtactgctgcttttttttttttttttttttttggagacagggtcttgctttgttgtccaggctggagtgcagtggcaccatcatagctcactgcagccttggcctcctgtgctcaagggatcctcctactccagcctcccaagtagctgggactgcaggtgtgcaccaccatgctcagctagttttttattatttttgtagagataaggtctccctatttgcccaggct

SEQ ID NO: 79962 - DNA, 1148 bp, Homo sapiens
aaaacatgacctactcacttccctttattactttatgcactgaaatggtttgtttccaaagttacagtgttctgatgttaacatagacatgaaagaagaaatgcaaattgactaggatgaacttaaagtaaagtaaatactgatactgattcagcatgggctataaatttctgattaaatgaggaggcacaatttttcgtatatataaacaacagcagtgaaaaagcatgtgaagttacttgcattgctctgtagtttagtgacatgcaaattattttgagaaggtctttgtgctcagacaagagtcaggatttcctgtcaactgacattactcctccctgtgtgtgtatattatctctgtgctccaattccattcaattttatgttcactaacagtcctaaatcaaaaaacttttttttttgtacatgtgagacaggagtgaaagtcttactgcagagagccggctagtccacacaagcccaaattatagactgatcaaatcgaggagtgaatctgatttgtctcagcctgaatcagatgaagagggttacgcactggtaggtatacccagattcagtaaagaaagatttttgttttcaaggtatatgatatgtaaggctttggttagagtaagtaatatgtttgttttagacatataaaaattttttcaaaaataactttaagagaaataactatattgcatatatgtttaccacatatgtgttaatggtttcaatctcttgttctgacttctttttaaactctaaattcatatatctgactctttgatggacattccacccgaatgagttgggttaccccaatcttaacctatctacaagtgaactcgtctctctccaaacctgtttctcttttattccctattttagtaggtggtacattaactatccaagcaagaaacttgggatcatccttgactcttttttcttatctcctgatccctttattctccaccccttcccaatccagttaagtcttaaaaattttaccgttagtgtgtctccaatgtcctctcctctccctttccttctgccactgctctgttttaaactttctcttttgagtggacgtgtgcagaagccttcaaactggttgcctcacctcttgccttgtgcccaccttccac

SEQ ID NO: 79963 - DNA, 1157 bp, Homo sapiens
tctagatgactgctaggtagaaaccactgtgggaaatcaagttaacattgtccttagcagatttctaatttttggtttgttcaggggcaaagttaaagaaaaaaaattaaaaccaatactgttttaaatttagaattattaaacatttatgcagagtaatagtaacataaacaacttgaagaaaatggaatagaataaaaattctctgccttaattaccttttatgcttggtatcatgttcattacaacttactaagttgcagctctgtaggaatttatagctgaatagcaatatagatatgaataaatttacagcatgatattttaatcaaaataatgaggaaggaagagcatatatgtgtctatatattttgtgtacatacattatttctataagatttatctagtgtatcttttgggtttttgtagtaaagttcatgtgttattactgatatcaacaatattttccatgataaaaaattaaaggttttttaaagttttaaaaagattttggaaaaaatgtatttagtgtagtttctgataatttctttaagatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcagtgagtatacccttcttactttctagatacaaactgtggcatgctttttgataggggaactaacttgaaagagaaaggcaaagtttctccatagtttttctaaaaggactttatattctgctggtgatctcaatttgtattagctgacaggggctcctacaactgtgctagtactattctgatgcttttgggttacatattcagggctgagaagctctggaagcaggaatgtcagtacctgcttcactgagcctcatcatgaaatgaaactcatgagtcatcagatagggccattcaaaatatgtcctctggggcaacaagttgtccaccagcctcgaagacgtctgagcggtgaggaagagagcccctttctatgcctattaggagagccataatgttttccacgtgtggaacttctaaaattataaatt

SEQ ID NO: 79964 - DNA, 1555 bp, Homo sapiens
cgaaactgttcatgtggtcttcctttctcagtaaatgccaactacattttaaatacatttagaatcacctttgacttctctcatattctcacatcacagatctgatctatcaacaaattctgtcaattctgccttcaaaatgcatgtggactctccagccacttgtcattaccttcgctgctcttacctttttctgagtcatcatcatttctcacttgaattactgcaataattacttctgctattgctgtccctataagtcagttctccactcagcagagtgagctttcaaaaatacatctcagatcatgttgtatctctgttcaaagccttctaatgctgcttctcatttttccccgagtaaaacctggaggacttgtactggcctgcaaggccgttgggatctggtccccagccagctctctgatgtcttctacccattctgtgcatgcacggtttgccccagccacactggcctccttgaacccatcccagatcctctgcactagctttttctgaggggacccattttcacaagctttttcccccacttcatttagatctctgctcaaatgtaaccttatcagaaactttcccagaccaccttatataaaatagtaatcccacatatacagtactccctgttctccttaccctgctttattttccctcatagcacttacctgtcatattaatgttttcttttaaattttatctcccaccctgctcctcctaacaataatataagctctgttagatcagggatttagttttgttcactgctatatccacagcgcttggaacagtaagtgggatctaatgaggtgcatttgttaagtaacagtttagaaagatgataaaattcaggtgttggatgactaaagctataaaaattacctctgaactgttttctgagcccttttaaatgtcaatgcatcatttttattttcagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatgggtaaagtttgaaatcaattaatttctatgtttttctgcaagctgtgagagctagctctaaattggtttatgtgagaaaaaaatgtgccttggttattgcatatgttcaatacatgttgagtagttcttttcctagcagaaaaaaaaaaaggaaaagatttgagatttacttaacctcacatttaccaagtgtgatattggttctaagaaactttagttggctgcataaatattaataacaaattgaatgattcaaatcatatgaatgattattcctctc

SEQ ID NO: 79965 - DNA, 1006 bp, Homo sapiens
ttttgaacgcgttggttttttgttatacaagaccattgcacgtgtaggacatttagtttctctggcctctgcctgccaaaacgccagagttgtagggtatagctcagaggtaaagcatttgactgcaaaataccagaggtttttttggagtgtcacaattggtagagtgtcacatccttttggagaatgtaaaagggttgatactacctccaactgaaaaacattaaaggactttaccttggtagcatctacttaaaatggtttgaagtttatcatttcataatcattaaataaatgtggtaagattttatctgtagcaccaaaatttatgatgttaaaattggtaacgtgagtattttttttagataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaaggtaagataaagaagataaagggagtaaatttgtagttagctcataatgctcgcaaatatatatgcaatatatgtaagtgaaaattatagggatcacccttttttttaatagaaaaagatattttattaacatttttaaacaatttgtttttccctttgtggaaaatagtgtaactattttttatatacatgtattccacttaaacctactgtgtgaaaattgagatttatataatacatttataggtaatcattttactgaagtatagtagtctccccatatccgcgggtgatgtgttccaagactcccagtagattgcttgaaaccacaggtagtaccgtaccttatatacattacgttttttcctgtgtgtacatacttgcccatggtaaagtttaatttataaattaggcatagtaagacattaacaacaacagtaataaaatagaacaattacaataatatgc

SEQ ID NO: 79966 - DNA, 4166 bp, Homo sapiens
tgatataaactcaaaaatattaattttaaatggcagaaagtgagattttttaatctgctctttttttttttttttaaaacctgctctttctttacctttctcttcagcatttaccattttttcactttccttcttgaaattctttctttgggcttctgtgtagtcacagtccttttttctctcctcttcctctgactcttctttttcagtgggttcctataggctcctcttccttggacatgccctctaatgttgaggatcctccgaattttgccttctatcctctttgctcccccaatggtcttatctagtctcagtgtctttaacaaccatttacatattaatgactcctatatttccatctagctgagaacacctttcctgagtcctagagcctttctttaattgcctactgggtgtcttttcttggttatccaaaagacaaccaaaatttattgtttatctaaaaccagctgcccctgaagttcccccactgaaaaaagaaagaagggaacactgtgaaactgaaacctttcctcattagatacctccatttggctgttccacagcaactaaaatattttcaaactgagctcatttctgaatgaccttctctgccctgatatacaatgaaatagtgaaataaaattgatttaaaaccaatatggattataaaaacacatgatttaaggtgatcttgatttttaaaaaagcaaattttgtttaaaaaatatgaaagcattccctcactagcaggtaagcaccagggggacaggaagttttaaccactttcttcaaggctgtatccctttcacctagaactgtgcctggtatgtcaataaatatttcttgagtaaataaatatttcttgagtaaattataaaatgaagataaattaatgaatgagaaattcataatgaattttaaggaaaacagttttaatcctttgaatttgttggtacggagaatacatatgctttcctataaagtgtttgttggtggtactttctgaaagtgaataaacactgatactacatcagctaccaggtaggtgttcaacagagagttgttgaatgagtctactctagttccaagctaaaataatatttattaggttcctttttttaaagttcatttgaagcaattgtcccatgtttaatttcttgcccttcatagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggtaagtaaagacaataaaagagcaaataatgcctttgagaaaagttgttcctcttgcacacatcactgtgtttttccattggagtctatctatcctaaggctatcaaaggaatttcatcactgaaatcttaaaagcttttcaaatttaagtaagtcctcttattttattggaaagaatcctgggctggagcataaaaggaaaagcattggagttggaaagatgaccttgagggcctatcttattttaacattatacagttcagtgatcaagtgtcacttagtccaagtgtcaaatttacaaccatatcaggatgttgattaggctttatatggagttgttccaaatttattctttccttttttctttttttgagatggagtcttgctctgttgcccaggctggaatgcagtggcgcaatcttgcctcattgcaacctctgcctcccgggttcaagtgattctcctggctcaacctcctgagtagctgggattacaggcatgcaccaccacgtccagctaatttttgtatttttagtagagacggggtttcaccatgttggccaggctgttcttgaactcctgaccttgtgatccgcccacctcagcctcccaaaatgctgggattacagacgggagccaccgcccctggccagtttattcttttctaaagcgtctcagaacttgctaagattcagtctatcaggtgagtaaggtgtcattttattttttcatctatgtttataactgatatttttctataattttattttttcatgctatcctttcctagtttttactaccaaaattatactaatctcataacatgaacgcggaactttcttttattcctgttcactgaaataatttgtgtaagatacgagttatctcttcctgaggttttagaagaatttatctgtgaaactatctggccctggtgttttgtttgtagacagactctggcaattctcattctttagtgattagtattcccttccatcttatgtttcttcttaagtccattttggaaatatatatatttccaggaatgttattttgttggttttcaaatttattggcataaagttatttgtaatattcatggttttaaaaaatctctagtatatctatggttatatcctgtttattcctattttttgaatttgtgccatctttttttcttgagtaattttattaatcatttatccattttccttttagataacttatccattatcatttcaaataactgctttttggatttttcagtctctatttttatttcattggtatgtgttccttatagctgtcatttcgtgaagtcaagaacttttaaaaacaaatgtacaataaaaaagcatggatctgggcccggcatgatggctcatgcctataatcccagcactttgggaggctgaggccgccggatcacctgaggtcaggagttcaagaccagcctggccaacatggtgaaaccccatctctactaaaaatacaaaaattagccaggcaccgtggtgcacacctatactcccagctacttgggaggctgagacaggagaattgtttgaacctgggaggcagaggtttcagtgacccaagatcatgccactgcactccagcctgagtgacagaacgagactctgtctgctcccctccacccccgccccccagaaaaaaagaaagcatgggtctggatcttagtattaagacaattctgaattcaggccttaaaaagcattaaacaatcttgaatgtcattttaatggataaatttgtgtgttgattttggaggaataaactcagaatactccctaaagatagtgaattttggtctgggtaatgaaaagtaggaatataattgattggaataatgttgtcatatgttgttttaatgtttatcttaaaattagtaacttttccaaggaaaattttatttgatagcataacttctctggatattattttaaatcagtctggtaaagagaaaaaatacagaaagtattataatttgtgttttcatcataaaatattttgcatcagtatcttattgcagtacggtaggagactatgagaaatattttgaatcttaaaagtaccagataaagacacaataactaatgattttgtctttaggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattgggtaatgtgcttctctgcagcatttaaaatacatgcctgtttgtacctcagttggagatttctctattctgatttgctaaatagagaactgacaggcaccaattgcaacattagcagtgtagggaatctggggctatgacttggagccctaagaaaaatggttaaatcgtgcagcacaatatggtgaaaagagcccccagaggaaatagaaattgtaggtctggtcctactctgtcatatttatcactcattttgagcaagtcatctaactcaatgcttcatcacttattttccgaggcttggaggttatgaaactgcttcccagaatgtaaagcactgtaagagtacttaaccatgacttatcagtgcagcacccctgagatgtgagtggcagcctcttttcctcccagcctgtcttgctttcatgctgacattatattatgt

SEQ ID NO: 79967 - DNA, 1138 bp, Homo sapiens
gactcaagcggatccacctgccttggcctcccaaagtgctgtgattacaggtgtgagccactgcgcccagcctacagatgatttttaatgagtattttgcattagtttagatttcaagtgatttattttgaacattagaataagtaattgtcattggtaatgtcacactgtagaatcatgtgtcatattatttatctattggcatttcgtactcctctctacttacagtactaaaatcattatgcatagtatgccatgttagcttagagatttaggcattataatgaaggctgaaataaaaacctgtaagttgcattttcctaaatcccatttcctaaatgggattaattgggtagtttttataattatgtacttcctgaagatgattatttattaagctagtaagtggattagtatagtttttttctgggatccttttgtgttcttttctagtgcatattacgctagttacttgttcctattttattgttctttagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagtaagttgttctttcattgtagtaaaaaaagaataaaggggtagggatctctttagtcaaggtattttgacatttaaacacctatgatagaaatcaaactctagacccctctcccccaaggggaaaaacatgtcagggtttctgaaatattgtggggacaaaataacatgtaattgagaatttcaaagggatttattttagaattttaccagatttttctgatattgtagaataataaacagaataaaataggaacatttttagagagaagaataatgagcaagggattaaccttgccagttataatcttataatgaaacaatgtacttggaactgaatgagaataggttggtcagtaggatagaggacagtggaccctatagctttccctgtattagtatgccattaattctaaatct

SEQ ID NO: 79968 - DNA, 1046 bp, Homo sapiens
gggtctttctttcccattagactgtaggctcatgaaagcagagattttgtctgtcttattcatttctgcacccaaatcactttgcgcagagccttaccagggtgaatgctatagaatcaacactaaatatttgttaggtgatgattagctatttagtggcaaatcgaaaatatgtattcatagtcttcttaaagacatctgaaggaggacttgcatgctttcttttttatcatgccatcttttttagacttacatgatcctagtagtcagtgagttcgctttaagtgtgtttttattaaaaactaagaaccaggccaatcagtatacttttctcttttgatattaggtggtaattgaaactttatcagtgggagcaaccatgctgttacctccattacgagaacggatggaattacttcattctcttttacctcaaggacctgatagatgggaaagcttatctaaaggacaggtaggcctttgcttgctgtgtaagtaaaccagtagtatcctaaaaatttggactgagaaggaaataaaactaataaattgccatgtgttcttggagcataagtacttgatgggttaatgtgttgtgctggaagaattcccagttgtcttaacaaccttaggtgaagcaagtgataatttattaagttatttggggctaattattaaaataaggactaatttttccagtgtttcttatggtactaagccagacactctgtggtttatttgtagtatgctgagttgaaatcaagtgtatgtgctactgttggttccatgctgagaactttgtctgaaatcgtttgtataaagagtatagatgactattaggaaaaagtatttgataatatgagtatacttttctttccatttttatcttatataccttaaaatagtacattttgctcaaccaagtagaagttatcagattcagagatacagatttgaggaaaaaaaattggtacttatttgcagtgtaatatttactgatacttttctttctttttaaatctttttttggagacagagtcttgctc

SEQ ID NO: 79969 - DNA, 1799 bp, Homo sapiens
tttcaatttcatgagctattgattttttaaaaagtttatgaaaaattatatgcatatacattcttttttaaagtttatgaaaaattatacgcatatagtacctgtatattttgtcagcaaatttgaagttagaaatatagccattaaagggggagaaagacagaaaaataattgtctatgtttcttttaaagtgattttaaattgcttgattttaattgcttgaaattaagatataaaaggctatcagtggttgttaactttcttgtaataaaaatgctcgtttgttaacatcctcagctatcagaaacatagcttttcatatctgccaggttagtgatggaaacattagagctccttatcaactttagtagtgttaaaaagagtagaggttctttaaaacaagtaaattgtttaatgtgtttgtttttataggtaaacttggtcatggtgataccaacagagtgtataaacctaaagttattgaagctttacaaggaatgttcattcgcaaagtttgtgctgggagccagtcttcacttgctttgacatcaacagggcaggtaggactaagggatgagtataaaagacttagagtatttcagaggattaggtgactaaaaagtaatacttgtatttaaattttaaagttcaaataaatacatttttaggcaacatgctaaaatgaaatatcttcttctgtttgaagtagagtatctgagaaggaaccaggttttctaacctggcatatgtgacccagataaatcttagtggagcctctgttctttgtattaaactgactttctaaaatgttttagcatttagcttcccttaaaccttttctaaaacattatggatagtcggggaaagctgaactagatcttgatggagccagtgatatgaactaagaaggcaagagggtgatcaaaaaggagggtaaagagaacacttaggtatggaaaatattctgagagagttaggtgtttctgagaaacagtgtgaagtcaagcttaggatagtcagaattttatgagcctttataaaggctcataagctttgtacttttatagcttataagcttcgaacttttacatgcgtattttcactcttaccctatttgtttgttgaggatagggaggagccaggtataattatagactgacaatatttgtccctgtgtatccatcagttatggcagtaaaaaagtgagctggccacttattctgtcatgtataggaggccaccttgtgtcaggcagtggtataaaagtgttttatgactaattgacaaggcagaggagcagaaaagctgaaatcagcatataatttgattattcactgagaaactagaatgccttgtgttctaaaaatcttcaagctattcatcattacattagctagttgctgccttaagaatatctcttctacgtgtttctcactatggtttttgtagtaagaatccatgaattgaagttagaagatgcttatgtatttgatgtatacacacaggcaaataacagacaccccttgagcatcatgtgcttctttttttatgaaggagtaataatttctgctttgcatacaagtgatcacataagataatcattagaattgagagtttctatagattatccaatactattcaactattagttggtagtggtagtaataatagtaataataataataaatccattacattgaattccaagagaacttgtaaactgtttgctgtatagaatagttgtattatgagtaccttaagttatatgaaatcaaatatatatgcgtgaaaaaaataa

SEQ ID NO: 79970 - DNA, 1052 bp, Homo sapiens
aaacaagtcaacatgagcatgaaacaggacaacacaaggtaagtgctgtgaggggagcatgaaaagaatattctaatggttcaccgaagtgactctatgacccagtttaggagcaccttggaagattgagaagatgttagaaatgattgtgtttttcatattgcattgcattaaaaaaatctcaattctattttaaagttgtaacatttattatacttgtgaagtcaaggcctagagaaaaagagttaatgttgtttctttgttgttgtgtgtgttttatccaaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtatgtaaaaaattatttatcagtagctttggcttttttcttgagttttttaaaaatttatttttcagttatatatgcctagtgtagaatgactcaaatacagatgagcagaaattaaaaaatgaactgagcttttacaaatgttactttaaccattgttaacattttggaaatagacttctaaataaatacacatttatacaaatatttacatatatttctacttagatgtgtttttaaaaaccaaagtatacctacatgtgtatgttttatataagtttatatatgttttgacatatatatgttttactctaatagtttttttttttttgagatagggtcttgctttgttacccaggctagagtgcagtgatgcaaacctggctcactgcagcctcaacctcctgggctcaagcgatcctcctgcctcagccccccaagtagctgggactacaggcatgcaccaccatgcctgactaagttttgtattttttttagagacaggattttgctttattgcccaggctggcctcgaacttctgggctcaagtgatctgccagatttagtctcccaaagtgcttgtattacaggcatgaacctccgtgcccggcatgagtatctt

SEQ ID NO: 79971 - DNA, 1036 bp, Homo sapiens
ttcttgaatactttgtctttttaaattttttaatttctaaaaatgctttttgtctttcattactcttagggcattatctactgtatttatttacttttgggtttcttctagtttagtcttcagttccaaaatgatttttttctcttatttctaattcttgagttatgttacctcatttttgagggtttgtaattcagatttctgtttttcctttgtgtcttttttttttttttttttttggatggtgtctctgctgcccgggctggagtacagtggcatgatcttggctcactgcaactttataataacttcatatgggatttgacctcaatacttttctgttgcttatttctacgtaggattagttttcctgaactcttagaatgagttgggatttaagatggctttttaaactccatagactccctccctctgtttttttttgtgtgtaatgttaaaaaaaagtcgttttccagtttgttccccttcccaacttttgtcttggtattctctttcctttccatctttcctttctgttgtccctatccagttcaatttttttttctgcccccagtagtttttctcagtgtaggggctttgtcctggaaaggaatcctggctggccagtatcaagaggcatgagccaccacactggctgtgatagacctgtagatgagcaattctgactcccttggccccactatcctcctttatctccagcaaaattccagaccttttattagggactggcagctgtcctcagatactgtcctcatgttcactggaaaatatttgtctaacacacatattattctattgtttggatactatttaaagtatctgaccaagatgaccctatcctctcccatttcatgtgctagcaaactaatatgttgacttcttaaatttcttttatcgttttgcttgattcagcaaaaccaaaaaactaaaaggcagaaaacaaattgatagtcactgtagtcagttaatatctttattgtattgagttcatacaagtcaatttaaaaatctatta

SEQ ID NO: 79972 - DNA, 1092 bp, Homo sapiens
ttttttaacataaacttttttttttttttttgagacggagtctcgctttgtcacccaggctggagtgcagtggcgcgatctcggctcactgcaacctccgcctcccaggttcaagcgattctcctgcctcagcctcccaagcagctgggactagaggtatgtgccaccatgcctggctaatttttgtatttttagtagagatggggtttcataatgttggccaggctcgtcttgaactcctggcctcaagtgatctgcccactttggcctcccaaagtgttgggattacaggcgtgagccaccgcacccggctgcatttcaccagtttgaaatcattaattgtaatgtaagatgaaattttggaaacattttatgagtcctctgtatgtttttgactgttttctcttctccctttgcaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcc

SEQ ID NO: 79973 - DNA, 1036 bp, Homo sapiens
ttggctgtaatcttctccacctgttccttagccattagcaacaactgatgtgctttttatcaccgtggtttttactctagaatttcatgcagctagaaccatagttatgtagtctttgtgtctggcttatttcgcttagcataatgcttttgagattcatccatgttgaatctccaaataatgaataataatgcttattattcattttgcttgtaatgaataaccattgtgttgtttgaatcagtcgttcattcctttttattactgagtagtatgccattgtatgcatatattatgatgtacctattcattcatcagatgatggacagtcgagtttccagtttttggctattatgaataaagacgctataaatactgatgaccaggtctttatgtaatcatgtattctcatttttctgggcaaatacctaaggagtagaattgttgcatatgtgctaagtacagcgtgtgtttatgataaactgccaagcagtttcccatgtcacatttctaccagcagtgtatgagagttctacacactggtggtgacatcctcaccaatacctagtattatctgtgtctttaaattgagccatttattgaatttgtaatagtatcttgttgtggtttcaatttccatttccctactgactaatggtgttgaacatcctttcatgcgcttttttggctgtttatgtatctttggtgaagtgtccagatattttgctcattttaaaaattgagttttcttattgagttgtaagggttctttttatatattcttgatacacgtctcattggatatgttttacaaaatagtttctttcatcttggggcttgccttttcattttcttatttatgtatgtgttcatcatatctaagtcttttcattttcttaacagtgttgtttttttttttgagacagttttgctcttgttgcccaggctggagtgcaatggtacgatctcggctcactgcaacttccacctcctgggttcaagtgattctcctgcctcagcctcccaagtagctgga

SEQ ID NO: 79974 - DNA, 1101 bp, Homo sapiens
tagggtaacaagtgctgcccagcaacactggaaatttaggttcattcccagaaagagtgctgctccaggtgcttggaacacattaattgaaaatcaaagattctggcacttgatgagtttatattccattcgttttctttttaagaaattattatttggccgggcgtggtggctcacacctgttagttccagcactttgggaggctgaggtgggtggatcacctgaggtcaggagtttgagaccagcctggccaacatggtgaaaccccgtctctactaaaaaaacaaaaattaactgagcatggtggcgggtgcctgtaatcccagctactcgggaggctgaggcaggagaatcacttgaacccaggaggtggaggttgcagtgagctgagacccaccgctatactcagcctgggggacaagaacgagactccatctcaaaaaaaaaaaaattattatttttcttttttttcgtggttttctaatgaactgatgttcccaggaaaatagatgctgagtgctgattgtgaatggaaccagtaaaggcctgggatagtcttaaagtacaatcacctttgctgctataaaaacttcaaataatacttcattttactgattacaaaataagcccacaaaagtcacaggatggtaacatattgttcaccagtctcttctctctcattttatttgtttatttcaggcttacttacttatttattgtataaatttaatgtgtacacatgatgttttgatatacatagtgaaatgattgctgtatgtaagcaatttaagatacccatcatctcacatagttactttttttgtatgtgctaggaacatttaaaatctacttttagaaaatttctggtatataatatgctaatattaattatattgctcttgctaactttatttattttttgagacagagtcttgctctgtcacctaggctggggtgcaatggcatgatctgcgttcactgtaacctccaccttgggttcaggtgattctcatgccttagccattggagtagctgggtgtgtgctgccacacctggctaattttttgtatttttgaggagatggggttttgccaagttgg

SEQ ID NO: 79975 - DNA, 1062 bp, Homo sapiens
ttttctttaccactccctttagtttaatcttattcatccctaatgcattaagttcatttgttattgttactgttccattttgggttccctccaaccctagttgattttaattattattattttttggcatatgaaacattatagttactaaacactgcttctactaaacactactgtataaaaaggtgtactgggctgggtgcggtggctcatgcctgtaatcccagcactttgggaggccgaggagggcggatcacctgaggttgggagtttgagaccagcctggccaacatggagaaaccccatctctactaaaaatacaaaattagcttggtgtggtggcgcttgcctgtaatcccagctacccaagagtctgaggcaggagaatcacttgaacctgggaggcggaggttgcggtatgccaagatcacgccattgcactgcagcctgggcaacaagagcaaaactttgtcttaaaaaaaaaaaaggaaaaaagttgtactgaaaagtgtcactctctccttgtttttactatctcatttccatccctccatctttgtttctacctcttgcccatgccctgtgggtacatagtctctttagtttctggtttgtcccttcctttatttctgttacacaaatgaaaatatatgtgggtgttctcttatattccttttcttctgatacagttacttattgccatacaattcacataccatacaactcacccttttaaagtgtacaattcagtggtttctagtatattcacaagatggtgcaaccatcacaactatctaattccggaacactttcatcacccccaaaagaaactgtgtatccattagcagtcacttcccaggtccgcttcccagtctactttctgtctgtgtgtgtttgcctattctggatgttttgtgttaatggatcatataatatgtggcgttttgtgcctggcttctttcacttagcataattttgtcaaggttcatccatgttgtagcatgtatcagtacttcattccttttgataactgaatgttattccgttatgtgaatatactac

SEQ ID NO: 79976 - DNA, 1077 bp, Homo sapiens
ccaaatcacatgacaaggttgtatggcagaatgagatatctagggaggttggaaatctggagccttttaaaaataggatagattgtcatctggggttgttgttattggaatggattaaatggcctattaaggcctcttgtaattctaaacttttatgaattttgcgttccctaaggttcttatcattttgcttcttaaatttccagtcatgctgtttgcatgtgacacatccattcatttgctggtcatgtattccatttccaatgcaggcaccctgatgttgcatggaagagaaagcaaatgtaaatgcgtcacttaatctgcttattaatataaacatctcttgaaaatctcaatttaaagaaattttggagaatgtgttggtgattggactggattgggttagtagagggtgcaaataataaatagtaataacaattccaacgttccaagcatgttttcccccaaaaaagtcatactgaatactccctaatatttgaaatagaaaaaaaagggggctgggtatattgaaggagctgaccttttaaaatttttaaaattcagattttcagatcttaaaatgatgataatgatgacatcgtggcttggagagtgagaaggttgtgttaggataaaaagaaacttgtgaaacaaaacttgaatgttatagttggataactatataatagcaagtaacaaacttactataatctgttgaagctatttttaaaaattgtaaatagaacttttggccagattacagtagctcacgcctgtaatctcagcccttggggaggccgaggtgggaggatggcttgagcccaggagtttaagatcagtctgggcaacatggtgaaaccttgtctctatggtaaatacaaaaatttgctggacgtggtggtgcatacctgcaattcctgctattagggaggctgagatgggaggatcaattgagcctgggagattgaggctgcagtgagctgtgattgcaccactctactccagcctgggagacacagtgagactctatctcaaaagcaaaataaaacaaaacaaacaacaacaaaggtctacaca

SEQ ID NO: 79977 - DNA, 1145 bp, Homo sapiens
ccgtgccctggtggaggcccacgataccatccaggacgatgtggaggccctggtctccatcttcaatgagaaggaagcttggtaccgagaggagaatgagagcgcccggcatgacctgtcccagctcaggtatgagttccgcaaggtggagtcattgaagaagctgctgcgagaagacatccaggccacgggatgtagcctcggaagcatggccaggaaactggaccatctgcaagcccagtttgagattctgaggcaggagctctccgcagacctgcagtggattcaggagctggtgggcagcttccagctggagagtgggagctctgagggcctgggctccacattctaccaggacaccagtgaatccctgtcagagctgctcagcagatcatgcactgaggaatttctggcaggctggaagctctaatcgccagaatccagtcagtgatgcatcccaagaggtttgcagaagcatgttctcatccaccctgctgcggcctccagctagaattatcctgcaggggtgtgtgtctgtagtatagccttccagcccctccacagaatccagaattgctgaggtgccagttaattcttcattctgcacctcccctcaccaatctggttttctgggagggctctggcagggcagccaagctgttaaaacaattagagagtgagtacccctcagggtccccttctgcagagggaggatggctggccctggggaaatgcttgagaattgatttgtgatgaaggatttgttcatatctcactttctgcctacataccttatggactgtagatcttgggtaatatttgagttaattaggaataactaagtcagcatggtgctttcctgctacagaagcagggatttacaatgcatagagaaaataatattgcctttcgtttgcattgatttttcacttaccaagcactcatgtctgacaaatgacctcacttggtccttaaaagaactcagtgagataggaaggtgggtggcattattattattattatttacatgtaactgatgagaaaattgactcagagagggaaaatgatatagtcaatcagtacagatgaaacagaaacccaggatgcccatctctaagatgaggtatatgggagaaagtagtaag

SEQ ID NO: 79978 - DNA, 1004 bp, Homo sapiens
tgcctcctttaaacaaagaggtcttatgtttgcagactgaaaaggggatcctaccctttcctcccctgtcatctgtaaggcccttggtgatgctgcagctctgtggcctgtccctcaagtacacccttgattggatgacagcagtgcactgctctgttggttagggatgtctatgcaggtgtttcttctcattttcttacttttaaaacacaggaaattttaaaaggaaaagtttcactcaactatttgttatcctcatgcacttttgcatctgtgttctctaatacaaaaattgaatcaaaccatacatatcatttgtgcatgttcacttattattttataaacatgtcccttatgatgttcatacttgctattttaatgtttatataattgtctattgcatccagaacatctgattgccaaagctgttccttagtggagaatgcttagcttgtttccagctttttcttgtctatgaaactatgttctttcatttgaagtctctctagaggccaaattcccagaatacaatgcacctggactcagataatctgactttaagttctagatctgtggcaaattggctctgtgactgtaactctgtgagtctcaacttcctgatctctataatggggagagcactgactgtgcagggtgttgagatactgtctgaggccaatatatgaaaagtgcttcataaagaacctgcatatagggtagagttgatatcacctggtgaaagcatgtgagtatttttatggttcttttttaaaaaaacagatataatttatatacaattcacccatttatagtgtcctaaagccattagtacattcgcatatagtgtattaaagccattaaatggctttaatgtattcagagttgtgtgaccatcatcatcatcaattttagaacatttcattaccaaaaaacccccttacccattagcagtcactctctgcttctcccaaacccactagccctaggcaaccactaatcttcct

SEQ ID NO: 79979 - DNA, 1030 bp, Homo sapiens
tgctgggaaagtgaaaacgattgacatatgttaagaatctactgttggggcaggcatggtggctgacgcttgtaatcccaacactttgggaggacgaggtgggaggattgcttgagcccaggagtttgagaccagtcagggcaacatatgtgaaactctgtctctacaaaacatgaagaattagccaagtgtggtggcacacgcctgtagtcccagctacttgggaggatgagatgggaggattgcttgagcatgggaagttgaagctgcagtgagctgtgattgcaccactacactcctgcctgggcgacagagcaagaccctgtctcaaaaaaaaaaaaaagaaaatctgccctcctgtgagtatctgtgctgagtacttcctgccctttcagaacaattggacttggatcacattcccatttcccaggtgaggacaatgaggctcagagaagttaaataaagtattcatggtcacacactttaaacaaggcagtcaggattccatcctagctctgtcagattacaaagctcatactgtttctattatactatgcaaattccgtgtgtgtgtgtgtgtgtgtgtgtgtgtgtgtgtgtatgtgtgtattttgagacagggtcttgctctgttgcccaggctggaatgcaatggcgcaaccacagctcactgcagcttcaagctccccggctccagcatcctcccgcctcagcttcctgagtagctagggctataggcatgtgccctagactttgataattttaaaattttttgtagagacgggtgtcttactgtattgcccaggctgatcttgacctcctggcctcaagcgctcttttcgcctcagcctaattctataatttaataaaaatcaatccaggagattcttcagaggtcatctattctagtaaaggcccagggctcagggtggttgagggcgagtaggggtaggggatcaaagagtttgtcagtaaaaggggctggaaggggaggaagggagacagggcagatatatccattctctgcata

SEQ ID NO: 79980 - DNA, 1657 bp, Homo sapiens
gacgagaaagccaaaaagccctccccatgccatacctgactacctcactggcttcccatgacatcccttttcacagcaactgaaacctacttcctgtccgatcaggaagtaagaaagacgttggctgtcagcggatcccgcggagaaataattgtaaagagtctccgtgctggagaactcaagatctcctttcccctaccccttcaggattcatctttaacttatcacggatactgagtgagtcagtcgcggttaacagaccgttacatccacttctaccaggcggacactacaagtcccagaatacaattcgctgccttccgaagaaaatagctcacgcatcccagcatgcaatgtgctgacgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaagtttatggtaattaattttacccagcacagcatttggcgttataggtgcaggccggagctgaggggtgcggggatgatggcctcacctgagggctgggaggggagacctttttttttgtttgtttgtttgtttgtttttggccagatcttgtccggggcgtagcaggcgctttcttcggggtcctaagtcacgtggggggtgtgggtctttctgggaactgggctcttcgtaaacctggggcaagccgaacccagaggtcttaaaagcttcattctccacgtgtggcctacgtcttagtaaccattccaagacttgtggggagaccacaagtctagggtgcctggttaggaagcaaagctggcctgattgcactactagagcctcgttctctagctcctggacacgcactcttgctaccgctgagggcgcttgtgggtgacagtcgagttggggactggcccaaggtcacagccactctatccggcaaagtcagtaagcagaggtccccgaaagaagagaacgagattggcttcttgtagcaaggccttgtgtacacacacataacgcacacacacacatacacactcttccatgttgcatattaaatattttctgtttaacccttggggccatctttattgtacaaatgaggaaacaaaggttaaagaactacctggaggtcacactgccagtaaggaacagagccaaaaagcaaaggctgtgcctactggttctaaccgtaatgcactttccaccacttcacaattgccttacaactttttgtttgtttgtttttttaattatgttgtattgtttttgaaaaccgaaaagactggatataatattgagagatctaaccatagaatacaaatataattcaagtaaggattataggccagtagaaggaagccagggttaggaaatactctgggagcta

SEQ ID NO: 79981 - DNA, 1041 bp, Homo sapiens
tggccgggtgccgccccgcccccagcgcctaagccccgcccctaggtctccgcccctcggatcccacggggtcccttgcggccctcccactcctcgcaccgttggatcgctttgctcacggcgctatctctcgataaagttgttgttgcggcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcgtgagtttgcacccctcggggtagcaggcgggagggcaccccgaaagggaagagaggctaagcgagaatcggggaggttgggcagagtgggcccggtgagaccttgcctcggtgtcagcagtccgggccccggggaccctggatgtgctcgaagcggtagagcttggcttcccggcccccaggcgggaagagtaaagaatgagggttgtggtgccttcgtcggctagctccctaacagccgagaaccgccgacgccgtcctttgaccctgcagtgtggtgacactccacggatccacggggttattttgcaggtcgtgtcctgccaaggcagattcagtaggacggaataagcgaatgggatgcagacctttcccccgtcttactgcttctaagatgaatagcgttatgtggactagcctggggtggtgacccgcccaccagttctttctttagcccagcatttaccgataataaccaaaggccctttctggatcttagtttacaaaagttatgttgattcttctgatctctaggaaaatcaggccagaggctggtggacagaaggcactgccagataaatcactacatagatcagaaagctttctcctttttaaagggatgtgttcaagtgcccacgtacctcactgggagcaaatctgaaatgtgatgaggaaatggtgtttcccgtaatgttaccggtaggaggcc

SEQ ID NO: 79982 - DNA, 1099 bp, Homo sapiens
ttcagcgtcctttccatgccctaggagagtactggggagactgaacagcaatcagattgtttctgaatatttggcatgcttgactactaggttatccctgaaagtagccttgatctgaatcaataattttcttgtcctcggatatttgttcactgaagaaaattcgaacacagcacgatttcagtgtcttaagacttttaagtctggttttgtacaaagtgtgctaatccaagggaacttttgacttttaacaagagtatgcttggtacttaagcagttcatgcctgggtaggcagacaatctcaatttgaggtcacctggccacgtaacaccccagtctactttttttctgtataaaatatcaaaagctgaaaatgttgctgattctttttaacatggttctttgatttttctgtatggacatgttagttgtggattcctcagactgcctttgaaaacaatttacagttcaaataatttgtctggcaagttttggcatgccatctgatggatactaattcttctgaacctaaaataggggcagcagataacttgccatccctgccttcttggtcttgtagctgccacgtgccgtgggtacccagacattgagtggtgctggtctcctcaagatgttcaacaaagccacagatgccgtcagcaaaatgaccatcaagatgaatgaatcagacattgtgagtagccctgtgcctcttacctccacctacacctcaggcttatgggtcagaacccctaaggagtcctgaaatttctgagattagaaacttttttataagatttttcagtccctttttgagaaacaactgctaaagaaagactgtactgcacccataaaagtaatctcattaaagttctgggcttttgtgtttcagtggtttgaggagaagctccaggaggtagagtgtgaggagcagcgcttacggaaactgcatgctgttgtagaaactctagtcaaccataggaaaggtaacaagctctgaaatgcacttggagctaggggaaattgttgtctctagtgaactggagatgcgagggcatgctgttccaatcctctcagccatccaagttgaaattctca

SEQ ID NO: 79983 - DNA, 1047 bp, Homo sapiens
cctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtcacatgactcagaatgttggtggtttttgcttaggctggggagcagttgggaatcaggtctggaatactcctaaccaagaagttgcccaggtatagtaagtttttctctaccgttcacaagttttgtgctgctgcttccctctggaaatggggtttctttctctccgcctacctcagctacctgttctgagggtctcaatctgtttcgtattcccacttctttagggaaggagttttaaaaacatctcttaaaataagaggagcaaaatctattaaaacctattctcctgcaaaggaggcagagactttctctctctcttttttttttttttttggtgtccctatcattaagcaagagcctttctcttttattcttcctgcttccctaagctgctcagggttctctgagtcttgccctctgatggcaagtcttatatataactaaacctatttttgtcacccatcaaaacacatcctcagtagactgtgtgaaggtgtgaaggtctgataatgacttgatgctttgtctccatagacatgaaagccatgccctctgcctctagatagggtgatccaagagctcctgaaccttaggaggttcaaagaagctctactgtctgtgcccaggaggtagcctgccagcaagagccctcaggagttgcacacacagccaaagggtgt

SEQ ID NO: 79984 - DNA, 2146 bp, Homo sapiens
gcagcccctcttttctgcccctccccacacatctctggctgctttctcctctgcagctatgcctgtgtcttttgtgctcataggaaaacaggctggtcagccacagcagtcctccttttctggagagttccgaccctgttgactcccctgcatcctgcacggcacttccctccaccaaagtccctccgtggcaggcctgggccatagctaaggggagctgataacatgcgccttatttaaaagccacaaaactatcttctcaaagtaatccttctgtgagctgttcaccacatcagcctggcctgatgccccacttggcctcagtcagcatggcttggctctgaggccagaagataggaaggacgctgcttttatgtccttgtagtccactccagcctagcctggcacagaggacaggttaagccccctcagtcctggccccgaatgtctgcttggtttggcgcaatccagcgcccctgacctgctctgtcttttttcccaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggtgagttgtggaagcaagggctactactgggcaatcctcaccggggattcaacacagaccccagggcaggagctccatgtgtccatccctttcccaaaaggacccaacccacagatgcagcccagtgctcctgtccagaataaaccctgtacctccatgcctccaaggttctaaattcttccagccccctcagagcccagccaggaaggctgcacaactgccagagcctccctcccctccttcactcagtgacgtgctggtcccacccctgaggtatacagagtgcagctgaacgcaatgtccctgagaagccacatgccctggtcaccctcttcctcctcctcacccttggcccaacctgggtcttacttcaaaggaacaaaattcctgtaccccctcgtcaaatctgcattctccctgctctggccaggagtctgttagaattttggtgcctccagttttgtgtgctgttgatcacttgtgggtcttagccctcctgagccatacgctggggcctttctcctgagcggtggacctcctgatccaccatgccctcctgcttccacctttcttttccaggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttaatatataatgtgtgggcctggttcttgagcctgcagcacctcccctaggcctacatcccaacatgcctgcaactctcctgtggcaatgggtgcctgccccttccctgggatcctgcctgaaattttgacccaggagctacccaggaaaagtcaggcaggagcttttgccccctgcttctaaactttgccagctactgggcctccacatttgctccccttgccaccaccctccagtctatgttaagggatgtatctgtactttttcatagcctacctctaaattgattttttttttttttttttttttttggtagagacaggtctcactatgttgcgctggctggtctcaaacttccagacccaagcatcctcctgccttggcctcctaaagtattgggattacaggcatgagcctctgcacccagctgacttcttcctttattatttatttattttgagacggagtttcactcttgttgcccaggctggagtgcagtggcgcgatctcggctcaccacaacttccgcctcctggcttcaagagattctcctgcc

SEQ ID NO: 79985 - DNA, 1793 bp, Homo sapiens
cagctaccgcaggccagtggaacagcgctccgggcggggcgggccgcggagcatgccggggcttgtggtcttctcggagcccgggcccgtgctctgcgaggccgccttccgccggtggccttcctgtgggcgggagagggcggccgggagcccaatgagggagcaataacgtggcaaccacccacgagcccgcgtcggtgcccgccccgcagggggacctactatccggcgccgagccggaggggggaaacggcgcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtccggtggagtccgcggcatttacggtgccggagctcgggcccgggcggccttggcttggccttggctcagcccctcctccctcggcttctgtctgtggcctcgtggcgtctgggccgtcctgcccattcagtccagggaacgacccggacccaccccgacacccccagcccctgccctgacccagggagttagttggatccccggatacccatctggggccgacactggcagtctcagagcaggctttttgcaaacacccctcagtgctggggagatggtgaaagatcacgcctgccggattccgaatcctttctctccttaagccaaattttagccacttccaattacaaagcacagtatgtatacttcaaacttaagtggtgaacttaggctccgctccttatgggttttctaatgttaatttttagaatctgggtccattagctgtttagagcaaatattgttatcctgtagtccaaggagggtatagataagcatgttttccaagaaaagggtctggagctttcattagattctcataggatttttaccgtcaccaaaatcagattcagaaccacttctctaaaaatatggctctattctctctcccatcctcaggttagcttcttgtaccttccctcccctagcaacgcccctttaaagaagctaagttggaaatggtctctttcctcaggtgtattttgacctacgaattggagatgaagatgtaggccgggtgatctttggtctcttcggaaagactgttccaaaaacagtggataattttgtggccttagctacaggagaggtaagtggctggagcaggggtagtcaactcacatgaagtgaaattggcactggggatggcagcaaactgacctgcagagttcagccgatctgtagcgtggacctcactgagcaccgactgcctgttgccctgggaacacagtattgccctttcttaagagtaatggggccctgaccaggcacagtggctcacacttaaaatcccagcacttttggaggccaaagtaggaggattgcttgagcccaggagttcaaggccaacctgagcaacatagcaagaccctgtctctacccccgcaaatttttttttttttttgagacggagtttcactcttgtcgcctgggctggagtgcagtggtgcggcctcagctcactgcaacctccgcctcccgggtttaagtgattctcctgcctcagcctcctgagtagctgggattacaggcatgcgccaccacgct

SEQ ID NO: 79986 - DNA, 1083 bp, Homo sapiens
ctactctttaattactttttcacaggcaggtagcagtggaagaatcatgagagaaaagtttcacattgagagcattttatccatcaacctgatttcttttgaaagtgggagtgggagaaaggctgctgtgatgccattttagccttagctcctcatgtgcaggaggctacttgggttttttgagtgtttctttgtttttgagacagggtggagtgcagtttcacgatcacagtacactgcagccttgaccttctgggctcaggtgattcccccacctcagcctctggggtagctgcgactacagatgcgcaccaccacgccctgctaatttttgtattttttgtagagacaggtttcaccatgttgcccaggctcaaactcctggactcaagtcatctgcctgccacagcctctcaaagtgctgggattacaggtatgagctactgtgcccagctggaggctactttgaaaacatgatttagtaaacatttttctctggctatggcagcctgagaccagtgagtgaagaaagaggcttaacaaaataggagaaaaaaaaaaaaaagggatgagagatggatctggaagatcatctttgtcagtataacaatgtttaaaacttcctcctgattggggttgtctgaattgaggtgcaaggatgggaaataagagaactgtcttgaagctctacaacctgtgtaaggccgctgtaatgaacaacaaagttaatgccagtggccttgcataacttcagtctcaggtcagcgcctcatgaagactacattgcataatttatgtaaatggagccctgcctataatctgtgctgtgacgacctggaatttctacgaagttaatcgttgaaaattagttttaaagacgttttaacgccataggtccaaattttggaagtttgtgttttggtttgttttggtgtgtaagactcccagtaccaaagtatctatgttgtagattgggacaacactaagtgtgtgaagacctaaaatagccctgtggggacatctagtaactattcctgacctccggaaaaaggcattgtatcctcaggccgtggcataaattat

SEQ ID NO: 79987 - DNA, 2773 bp, Homo sapiens
taggattgatgcagttgtttttcctgaaagctaactcagcatctattcataaaaacccttaatagtatacattaggagttttcccaagctctacagtccctcagacattgcatcctaaacagatttgaggcacacaggccaagactccaccaaggcataaatggtcccccctactcccttttgaccagggtatcacttgtgtctctgcagtaagagttggtcaagttgctctacgcaccttggtgctttccagagatctcactccagactgcccccaagggtggatagagtatcctgacagccagtgtgcactcatgactgccttaattaacattcttctgctattatggagcctgtccagcaataaacagggtctaggaaggtacaagattagcttccagttaaaatcccattttatattggaatgcatgagctacagatgacagcagagatcctgaggtttctagacatgttgattgtctcttttttctaaatgaactccaagtacttagaaaacagtccctgtccatcagccagaaaaggtgaccatcacccctaaagtaatttccaaacttagttcagtgggaagatatgctggtagtgcatattcagtgttgattttcagtgctagtaaccacttttaatgccagaaatatgtaacaatgataatgtaacgtcaaagtggttactaaagattatagccttaacttttttatgtaaaagataaaatccattcctcctcccagtgagcaagcatggcttgcatttctcaaaaatgagaacttccatggcagccaagaaaacgtcttctcagaggaactttcgtttgatgcatctcccaagcccacatgcctcctgtgttccagccacctcttccatttcacatttaaaccagctctccattcccattgagttgccctaacaacattgtctccagtgtcagaaccatattaaggttcgtttctcagattgggagcctgcaacaccatacagccaacattgcctttgccacgccactgccaccatccccaccattgccctatggtgggcagatgaattccagaaaccctcagggagccaggataattaggcaacccatctgaattggccacgtaagtgacaggcacttatctctcgggttcttgcttttgcagactccagggaagtcctgtctagaggtcgatggcagagactcctagtctttcccatgaggggttgataggaatcaaattgggattcctttggctttgggttttgtttttttgttgttgtttttggttttcagtttgttttttggtgtatggggggtgattttgtttctgaataagaaaaagaagaggcaaccatggcccttatgtgggtttatcctttttgagcaatgttttagccacaagtaaggaatcttgaaagtcttttgtccagcaagcagtcttaaaaatgtttttcctaactccttttgcaggtgactaagtacaaaaaaatagttttctcattgtattcaaaatagtgagtaggttccctggataatacacagtggtagttgacatattttctcaaaacacaaccagaaaacccacttccggtatttgtaaatcacctttcaagggaaaaagtgaacacgtattccttgtatttctagtttgattaccaaacctgatgttacaaagaaacctccgttctgtagacagaatttcttttatttttcttcttttactcctcacaatcactttcccagtgccatcaccatctataaggtctcagagcagaggattattcatggtaataagtgggggtgtggtgcagccattccagtaacacccacaagaggacagctgttctgaatgtccccacccacccctctttcagtacaggtgagacattttcagttcatgagctccagaccaaatcccaggccagcccttgcaccaaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttactttttttttttttagatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaac

SEQ ID NO: 79988 - DNA, 3161 bp, Homo sapiens
ccagtaatgcctatttcagccctgcctagcctgcaccatcttgataattaggtaggatgactgcagattgaaatcaagcagctatttcctttggcttttctggcagacactgcccactgcctccagtgcgtgcactgtagatggtgggtggtccctatgggtgggtgctagggggaaaattccacccctgcagtaagcagaagcaggcagaagtctgctggaagctgcaggcctcccgcactgacttgcaatgttccttgtgctccaggtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaagggcagagggaaatggtgggaatgcctggagcatcctggcactctatactctactgagtgcctctcttcagcccctcaccctgcttccacacacacacacacaaaagcaaaggcactgaccagcttggctgcagggcaagc

SEQ ID NO: 79989 - DNA, 1851 bp, Homo sapiens
accctgactggggatctagatccataaggtggggatggggcaggcctgtacccaggaattaatctattccttctttcaaacccatcttatcgctgtctcctcctgccataacagtatcccacagtatccaaaattatctatttttagctgagtaaattttctcccaaattaatacaaccagatatggagagggacagaagtaaaagggcaagattactgtatcagtttttatgtagcagttgtgtttactcacagccgcaaggatagtgagttgttgctggataatctcacattctgcaatgtggtctctaacctggaaattggctgctttgggaaaatctgactttttgattcagctggctcttccctctgtagagtagcaacctcaaaaaagggggagctccttcagggagaggtggatgttttgttgttgttgttttgagagttgttttgtttttgtttattgtctttttctttattcctatgtgagagtttagtaggccaaggactgactcagctaattgatatattggagcctgtcttttccactcctggaaaaggttcctggaatgtatttttaggaataacatggagtttatggaaggagaagccctcaagaatccatgtgtggtgaggaacattcttgctacaagacatagccccttcccctgctctcttgcctgtgaccttccaggtactcctgaacttgttggtctgttgcagtctggaattttaactctcccacattgtccgcacgcataaagtcatgctctatatggaggtaacagcctgctagtttcatgactgccatgtttctatttgtcttcagtgactgggttgggcactggtttctgaaccctaactatctaagccagattgcctacaggggcttcctcagggacaggaatgtattaaagaaaacaactgggttttgtggaggtcagatttatagtcttaggggatcaaagaatacctttggctatttgttttgcaaacatgtgtctgtgtaatccgacattgtggtggtctattttttcctgtgaggtgtcagtcacatgatccttactgcagatacttgagggcctgctatatgcttatccaaccctgtgcttggaactctagtggggtggggggtggggttacaaaatttgccccaaagagcttgggtaccatctagctgaagagatcagacatacacatgaaaggataaggagttctgcaggacattgagattactgcccttgagaggctgaggggccaagaggtcaccatggacaggatggtcaaagaagtccttgtaaacactgtaggacttgagttaagtattagaagaaaggaagaatgtacacatatggcagagaaaaggaacatagcaagggaatagctgaagagagagggccaggacatagtaagaatgccatatggaaaaggtagtgggtcagaggcctggggtaagagcactagatggctttgagagtagggagatttggatcgattttgactccagcatgttgagaacttcttgtcatctaaacagtcaaagaatcaactgaaaggaaacctaagccatgaggtgtccaccacctgccttcattctcttctgagaggaacacatctgaaagtcaatcagtggacttggtctagagtctgacccagtttaatagatcctgttgctagtagtcaccacagacaccaaagagttgaagaacagattgtggggcctgctttcttgtaggtagaatcattaaaagcctttgccactgctgaagctttaactacaataactagcaaagataaatccagggctctaaatttgaaatattccaactcctttgaaccataactcacact

SEQ ID NO: 79990 - DNA, 1793 bp, Homo sapiens
tcaagggagccaagtgattttacctttagaagtcagccatgcagttatttttaacttaacaaagtaatgtgtgtgtttttgcaatatgaaagaatctgtgtttagaacaaattttcctcatggaaattcacagatattaactctaaaccttggttaagtcatttgttagtgtttccatctgtaaaaaaacctatttcataagatttttgtaaggattagatttacacacacaatgtagcagagtgtcagacacggagtaggcactcagtatgtaagttattatcatcattatatgattacatcattgatattagtgttctcgcatgatatgggcctgggaaccttccctaaattgatcccttaacccaggaaaacaaacattccagacactgcctgtttagcgaccctgtctggcgctggcaagagatttctgttgccatggtgcctgtcacacacttctgtctttctgtttcaggtggttagctcaaccaatggagagctgaatgttgatgatcccacgggagcccactccaatgcaccaatcacagctcatgccgaggtggaggtagtggaggaagctaagtacgtacatctttcaagggggctcttaagtcatgggttgaaaaatcttttctgtctcttcctctctgtgtgctgctcgtctcagactggatttctcatgcttgtaaccacagctttcttccttaactgttttaatttttgcatggtaccttaaggctgctactgcccttctttagctgtgatttcggggaagacagtcacatttttctagttcacatgaaaaagacatagtgaaccgaaagaatcatgttatcagggctacagtggatagtagccatgagcttcttggggctgtggagcttcttgctctatatgggatatagagaaaaatctgctgttaaaccatgggccatgctgaatagcattcgatttctgattgtgggctagcaactggatgtacaatcatggaacaaggagttcagggccattttgttcactctcaaatgattctggcttcagagagactaagtcaggcaagaaaaatattatagtctgcatctgtgaatgagagtgtgggaaaagaatggaagtcatactcatctcaggagggtaaggaggttgccccacacccttttctgcttctcttgcatgtgtatgtcttgccccacccataccaccagccccttggtgcgctgcatggtctgtgtttaaactcttaaaatctggggtggaaggtgagataactgccaattctgctgcaaaagcagcatttctaccacttttttccccatcccaaatttagatccagatttagacttcaagaagataccaggtagggagagatagagacaccatgagtcagtaactgctgctatccctgatatggaggacctttcttgtgagccctttgagaaccttcaggatatcccagggtcttgttttctgaagcagacaacgtatttatagtgatattgtacctaagtagtctcatgagcccccaggtagcttaatacaagccagaacactcttatacctctaaatgtaagttagtgagatgccactgagacctgcattcttccaccttccagatgtactttgtattgttgtctttcctgcctattcccctggtctcctgcccatcttttttatttatttattttttgagacagggtctctctctgttgccaaagctggagtgcagtggcacgatcatggctaactgcagcctctattccccaagctcaagtgatcctcctgcctcagtctcccaa

SEQ ID NO: 79991 - DNA, 1925 bp, Homo sapiens
gtgaaacgctgtgagcaggccccatgacccagagtcaccaggtaattctcagtggtgatgcttactaatgtttcattcgtgtgagtagaagccaagacattttatttaacgtcttgtctagttcctgaattgtccactagaaacttactatgtttcctgtaacctttgtgctcacagaatgagtttaccagtattatcactggtatgcagccagaatatgtccacaagaagcaaatgaagcactgaggaaattaacaggatagcattagagtgaggagctgtggttttccaatccatataccctccttcctcaactttttggttttgctggtttttcttcaactttttgtattgaaaatttcaactctacagagaaatcgggagggaaatgcaataaactcttgtatatctttaaccttgctgaacgaattattaagattttgccatatttgctttaaatctatgagtgaaagtgtgtgtgtgtgtttgcttgctaaaccatatgaaagtaagttgcagacatcattatatcttatcccaaagtacttcagcctgtatcttctaagaacgaagacattctaagaaagttaatttcataatatctaatatatagttcatgtcacattccacctaattccagttgtccccagaattaatattgtagtgtccaggatttaatcaaggttcatgcctcacattaaccaatgcaatatgcctcatcagtcttttacaatgtcttagtctcttttaatccgttttaatctttaagtctccctgtgtttaaacaaataaaagtcttctataaagattcagctggaggccgggcacagtggctcgtgcctgtaatcccagcacttcgggaagccaaggcaggtggacaacctgaggtcaggagttcgagactagcctggccaacatggtgaaaccccatctctactaaaaacaaaacaaaacaaacaaacagccaggtgtggtggcacatacctgtaatctcagctactcaggagactgaggcaggagaaccgcttgaacctgggaggtagaggttgcagtgagccgagatcatgccactgcactccagcctgggcaacagagcaagactctctctctcaaaaaaaaaaaaaaaaaaaaaaaaaacgggttactaatgagaacaataattatttcttgtttagaaataatagcggatatagcttgctagtaagtagtattcaccctatctgtcccaaaggctacgtgtactatatatttcctcccaccctcctctttatgactattcaggaaatttttgtggattaactgctggtgaggacccctgagctagaggcagataagaataaacagttacggagagagaataacagtaagatgaccacttattgagctgttaccatgtctcatgccactgggctaagcactttctgtgggttgtctgcacagtaaacaccattaggtaagcagcattgttctcccattttagagattaggaagcttaggcatagactgaggatcttgcccaaagacccacagcaaataactggtggagctggggttcaaacttagggctgattagggcaatttctacactatgctgcttcccttatttatgctaggtattatactagacagtctcatacattttcttgtataattctctcatcaacctataagaaacaatctcaaatagatggaagtacttatccaagggcatatgatatccaaattgtttatcctattttgtgttctctcccatgtttcagccaaggtctttaacaagcagagtgttttgtccagcagtgaggccccttttcccacttcccagcacccacataaacaggaataatgtgctggaaatgaaaccaggtggcagaagcagctacacatgcaagagaagcctgattgggtccacattaaccagatgacag

SEQ ID NO: 79992 - DNA, 1064 bp, Homo sapiens
tcattgactaagaaacatctatatgatttctgatactgatttctggttaacctagtcctaccaccttgatgcattcatgataaaccataaaaataacatcaaggtaggattgtgttagtgtcaagtctgtgaattgtaaagacctgaaacttacaagtattttttgaatagaggactaaaggactgcatatgttgctcattccatgatatgtgccttaacgcataagctgagaatgttaatttgtataagtcatctgtttctgagtgggtacccaggaagttgggctgtttccttttttctccctggaatcaatgtgatcttaagaaaattatttctgatttcatttgggctattctgaatctcttttttctgtttagtactagaacatctggtatctcttaacttgtcttacatgtgaatgtttttaataatcttagcctcaatattgttctcatactggtaagtgacaccatcagttgggacacacagtgaactcagagctgtcaaacataaattcttataaaggtgcagacaggtttgtacatgtagaaatgcatcttggtagccttgatcatctaggatatgctgttacaaggagtgattcatggaaagatcttaatcacagcttgaaagacagttttggccctatagaaaaccacataggatcatataggttaaaatgatggattgaggctgggcgtggtagctcctgtaatcacagcactttgggaggccaaagcaggtggatcacttgaagtcaggagttcaagactagcctggccaacatggtgaaaccccatctgtactataaatacaaaaaaaaaaaaattagccaggcccggtggcgcatacctgtaatcctagctactcaggaggctgaggtgggaggattgcctgaatctgggaggcagaagttgcagtgagccgagatcatgccactgcatactctagcctgggtgacagaatgaggctccatcccccccaaaaaaaaccatgatggattggacaagactgagcaacaaagggagagctcatctctacagaaagttaaaaaattagctag

SEQ ID NO: 79993 - DNA, 1049 bp, Homo sapiens
attacttctaatattacaagaataggtttattctcagatctccagcagtcagaataaatgagactaagtgctctgaggatatagacaatgtcagtaagtttataaaatatggccggcacggtggctcacgcctgtaattccagcactttgggaggccgaggcgggtggatcacctgaggtcgggagttcaagaccagcctgaccaacctggagaaaccctgtctctaccaaaaatacaaaattagccaggcatggtggcacatgcctgtaatcccagctacttgggaggctgaggcaggagaatcgcttgaacctgagaggcggaggttgtggtgagcggagatcgcgccattgcactttagcctgggcaacaagagtgaaactctatctcaaccaaaaaaataaaaataagtttatgattatgttgtacaccagtcttattttggaaaatgaaacatttgaacctcttttggcagaaataattgtagtaggggaatattttgggtagctttgattctctctaacataactagcagcataaaatcaaacccctcatttataaggtaatagagcaagtccatacagctgccttctcatagaatatgtttattctctgaggaagagcagagaaaatatgaacaggatcctttataatactcttgtccatatgacttcgtattccattaataaaaaggagtaaattggccaggcgtggtggctcacgcctgtaatcccagcactttgggaggctgaggcaggcggatcacgaggtcaggagatcgagaccatcctggctaacacggtgaaaccctgtctctactgaaaatacaaaaaaaattagccgggcatggtgctgcgcgcctgtagtcccaactactcaggaggctgaggcagaagagtggcgtgaacctgggaggcggagcttgcagtgagccgagaatgcgccactgcactccagcctgggcgacagagcgagactccgtctcaaaaaaaaaaaaaaaaaaaaagtaaattgtagctggtgtacaaagctctgatttttacgagaa

SEQ ID NO: 79994 - DNA, 2023 bp, Homo sapiens
ttcaacatattaatatggaaagaaacttaatcagtagtttggggtactcctacaccccctcttccagaaaggcaggatggttcattttgctgtaggctttctagactattgtcctaaaacgtaagacttccacccattccctttgagattttatttcttcactcttaaattcctctcctgtcatatacatcttctcattgatttttatagctttcaaatagagtttcatgtcaaacttggtcatcatacagccacacaatgcattagtgtattattaattgcttgaaactctctcgttgtccataaatcattttagtggtagttgtagatctaaaatttctcctatttacttcagaacactattgcttaagtctgagtgcagcaagctaggtaaagcctgacaagaattccctaggagcccactgttgatccagggttcagaagccctctggctatagctctgagcataccagacttgggctgcttttgagttactgacatacaccaaacctgttagccatggctgtaccatagacaacttttttccctctggaagcacattgttgaaagacatttttcagttattgttttttttctgttcaaagtctcaatatatgtgtagtagaattacttatctgtttcccccacctggattagcagtacttttagagctgatctaagagagaatgctgaatcatattgaattatggtggccatgggatattactaagcttctgcaattttgaaaatattggccacataatattgttattttcttatcctagccactcatccattatatttgatggtgtttatctgagacaactaaatattttcacaagtaaaattttccagaacacagcagatgtttgtatatatctaaatatataatttctactacatttcttatttgttagtgttagaaaaaaaatcaagaccaacaaatactgcgaatttgagtgaaacaaccattgtgtccaaaaacatattgaatctcccatgtttaggccctcttttaaagtaactttctctctttactctctacaggctgacacattaaaagagagatatcaaaaaattggtgacaccaaaaggaatactcccattgaagctctctgtgagaactttccaggtgggatgctaaaaagacattccagtgtgactgagctttgaaactaggtagagtccatgactgggtatctctagataggggtgctgtttaggtaattaacatttccttttgtgatacagaccaaagtaggttttatcacttttattttgtcagtaaagaaaacatcagtgtcaaattgtctgtataaataacccctttgtggcccaatgcttccccacaactgctatggaaagcattcagctaatgagcagggcctttcatctctttcctaacagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattgtaagtatccttttttttttttttttttaacctcattacctcctttctccaaccagcactgcctcatgcctttacttgccagtctttctgcttgaatctttggtaaaaatattcctttgatcgtagactgtatatttactagccttgtctgggtgttgccataggttgctcttactagttcagaagtaggaagtattttttcctagtaatataggaagataataacttgtgtgtcctaagataacagaatttaagcccagtttttaggagaagtttcatttgaatgattcagaagtttgtttgtttgtttgtttgttttcccaggctggagtgcaatggcgccaatctcggctcactgcaacctccgcctcctgagttcaagcgattctcctgcctcagcctcccaagtagctaggattgtaggcacacaccaccacgcccggctaatttttatatttttagcagag

SEQ ID NO: 79995 - DNA, 1012 bp, Homo sapiens
ataatgaattggacaagtgtggagtgttcaaagtcgtatgaaaataaagcatgctctggttttcactcttatttttttcctgaaaggccctaaaggcttaagttatcagattattttagaattttagagctggaaaatgacttttcaaattctccccagattgaacactttattttcagatgaggaaactgagacccaaagtaggtgacttgaccatgcttaatttcactggattaaattagtggaaaggataaaccaagatctagatacctaaatcgttgagctgatttaggtacccttattttgggtaccttatttaggtacccttcctgatttaggaacccttatttttcctattgtcccatattctatagttctttttcatagttctcaggatttgaaaagttactttattacttattccagtgagttttaaaaatatattaatctcataatttattttgctgtgaaatcttttttctgtaggcctgatcaatattgaaaatgtggagagttttcgccctctagtgctcaactgtttaaaattcaaacatttgtccagtgaatttttaataaccaaggggcttcttgttacaggaagtggatataaaaatggagaggcaatgagtaggtgtgatacagtatgagaaactgcagagtcgtttctctatctgccctgctttgtgggaggcctccactcaactctccttgttcttttctctttttcatttgtgcatccttaggttgtgtcaacaaactgtttttgtataactgctttttttttcaattatgaatattttattgcaaacttcagacaagccatgtagacaaaggattctgatggtcatgctgttttcattctttttaagattgtttcaattgttgtataccaactcagttttatgttatttatctctgtcagggtacctctccttcccattagtaaccatctttttacaacctccatcaaatcattatttaaaaagttgccttttctttcttcatctaccct

SEQ ID NO: 79996 - DNA, 1103 bp, Homo sapiens
gtggcatttgtctcaaaggtcaccaacagtttgatatcctacctgggaatacttcttttgtctcaaatgcttaattttctgacgtagcatataaacaactgatttcatttgtcatttgcaaattgtgacattatgaggtaaaattgagctatcattttagcagacctgtactatcccactttttttcctagtcttgatatttgttgtgtacgtatttatagcaaaatatttttttgtttacaagtcagtgaagtgactcagggcggtgaaaggagatgaattttactgttatttcaataattaaaaccttggtctggctaaagaaactgttttgatgtattttcctgatatacttctttacagtctttctatcatttgtttctctttcagctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaaggtgtgtttttttctgttccatgaaaggggcgagtcattagaacagtttattatttctgtaacattatatccccattgtgcattacaacttgtggtttttattgtttcacaaggttgagtgatttttatacatgagaagttgagatggtaagttaatgacttttcaaagaatcctatagactatgcataggttcttaattctttacactgtttccaaatgtttagtttctgagcagtgtgagtacttgaattattgtaaaaagaggatagcattttaatgagtttagtaatgaatttggtatttacttatgtatgaccctatatatgatagtcctgaagaggacatcaggctgggtcagcggtggggaagagtgcctcactaaaaatggagtagacttctgttcactgcacatagttctgcacagaagtcttcaaggaagagcttctgtcttattcagtgaaaatatacttggtttacc

SEQ ID NO: 79997 - DNA, 1061 bp, Homo sapiens
aaaagaaaagaaaagaaaaagaaaaaaagaaggggagaggcatccctgtaatcttagcacttgggaggtcaaagcaggaggatcagttgagcccagaaattcaagaccagcctggacaacatagtgggagctcatctctggaaaaaatttaagaaactagcccgatgtggtgtcatgtgcctgtgctcccagctgtttgggaggctgaggcaggaggattgcttggtcccaggaggtcgaggctgcagtgagccatggtcataccactgccctccagcctgggtgacacagtgagacactgtctcaaaagaaaaaaggagagggagaatggatattgggcatgcaaacaacaggcgctgccacaacctgctttgaagaatataatatttatattaggaaaataacattttagtggcattaaatccttatataggacataaatttaaaagatccccaaactgcatttaccatgtgtctgattaataaaagcagtaaatctctaggacagagtgttctgctttggatgtctcagcaggagtcattggaaacaactagttgggttttatatatttttaaaaagctgaaaaatgacttcttcaaaacaaccgggaaaaaaagactctttggggcctggtgtggtggctcacgcctgtaatcccagcacttcgggaggctgaggcgggcggatcacctgaggtcaggagtttgaggccagcctggccaacatgggggaacgctgtctctactaaaaatacaaaaattagctgggcgtggtggtgtgcacctgtaatcccagctactcaggaggctgaggcaggagaatggcttgaactcgggaggcggaggttgcagtgagtcgagatggcgccagtgcactccagcctgggctacagagtgaaactccatgtaaaaaaaaaaaaaaaaaaaaacacttcaaattaaatccttttctcttttggagatagggagaatcaagacaacaacaaaaacaattgaacagatatttattgaactagcaggagtaacatatgttagaggatacaagctaggaataaacatat

SEQ ID NO: 79998 - DNA, 1004 bp, Homo sapiens
cttaaaagtgttctctagtacacctgctttttttactttttctgttttattattctgataagttggaataatctttgattatttgggacttctaagagaacaaagcacttcctaaaacactttaaaaatttgctacattactacatatttgttaggctttctgttagggacagttctttcatcttgatttcttctgccaggttataccaatcaacctgtatagataagcttacataacatattgttgacatgattgatcgttacatttcatttcctttttaaaaacttttattctgctttgtatggccactatttaaagctaaaaatggaactcttacaatctagtatggtgtgactcagtaccgcatttctctttcaaataagtctcaaagccattttagaggataacagttttgtctacaggctttcattcttgcttttgggcttctgttctccaaaggaagatatgaaggcagtaattgagctctttggattgtaatggtcaatttgccttaagcactacactcctataaggtagctgtctgctgtttgtttaggattttaggcaggcatatgttttccagaatatggtaaatattctggcaaatgcacagccctctatggaaatgtaatcagcatctggcacagaaatgcaaggaagctctgctgctgctgtttctgttgtactttgtttggatcttcattgtggactcttttttcttagatttcttagatttctaaaaacctttaaaaaaatcgtacacaaagtaaacaaaatagtgtaatgagcccctcctttatccatcacccacatttctagggttctttttaacagaggttttctaacagttgggtttaaaaaaaaatctcctgtgctgctaatattgctgccttctgtagtctgtagactgagttttgcaatgccttctacttatagtgcttccagaaaagcaccttgaagcccaattggctgagcaggctatggccatgtgctaaggagttgg

SEQ ID NO: 79999 - DNA, 1017 bp, Homo sapiens
tatgccatccaaagttgacacgaaataccatgacaaaatatatagaattctatttgccagttagttcgaagaatgaaggtttgtgtttattgtgccaagagctaaaatctctttgaaattctggcatttcttcttgaattgccttgtggcttaatagttgggaaatattaatatgcatgcatgtgtgtgtgtgtgtgtgtgtgtgtgtgtgtgtgtgtgtgtaagagagatttgttttctcttttaggaaaattctcaggtatagcttaaatttctaaattttcaagctgttctagccttgctagatctcattatctctgtagcttttcgcttataaatcaagtttcatttatgtgaacagcattgggaatataacctttctcatgaccctgtaagctaatattttgctttgcttttcccagaataaatgtcactaaaacatatacattctgctttcctcttaggtaaaaatctctacaccaatgaatatgtagcaatcaaactggtgagtagaatctgtttgtggtaattaatgttttggtgctcccattgcttatatctttttataggaaatagttttaagcattcattcgcaaaactgctaatggtttggggttttttttgtgtatgatcccacatttttcttcatttatagtgttaacagtgatgaatcactgtatactatataacactatatagttaaatgatactaactttagtgttagcaatgatgactcaaaaattagttgattaaaaaaagctggaagaactagtaactctgtgaacttaatctttcacagaggtatcttaaaaagataaaatcattcaaaaattttactgtttttttctctaacttaactgatttattttttgtacttagaagaaaatcataactgatcatctaatcatggccttaaaaatctgtcaagcatggaaaacataccatatggtcatattagaagcaaagaagtcaattggtatattagtactaaccttgtgaataattaaactagtcat

SEQ ID NO: 80000 - DNA, 1732 bp, Homo sapiens
tcccagcactttgggaggccaaggcaggcagatgacttgagcttaggatttcaataccaacatgagcaacgtggcaaaacctcgtctctacaaaaaatacaaaaattagctgggtgtggtggtatgcacctgtagtcctagctacttgggaggctgagatgggaggatggcttgagcctgggagcctgatgctaccatgagccaagatcacatcactgcactccagcctgggcgacagagtgagaccgtgtctcaaacaaacaaaaaaccagattgtatggaaactacattggcagagaaggttaataaaggcttcaaagaggaggtatgatttgatgataggacaggatttctgctggtagacataaggaagaagagcttgtgcaggatacacaatcactagatactgtgcaagtgcccagcatatcacagcagcatttagttatacatgactgggtcataggatgtgaagtgaaagaaaagtaatagaatgaagcttttaggtaagttgggacgaaattgtgaagtgtttgcatatattaaagcatttggactttatcctgtaggcaatggggtcgaatcatcaggagttttacaacagagtgacataatctagtttatattccagaaagagaattcgggttgtattgtaagattagatcaaataggaaagaagttgacatcttgtagattttgctctaattgtaatacttatcatgttgtactttattcttccatttctctctcccaagataggtgtaagggtattactttgctttttagtcctcatattctaattcctttcactgtgtgtggtatgtaatgggtactcaagaaaggctgaattgtccaggtcagaagtagcagggcctttggtcttagctctgaaaatggaagtgagatggagagaggacagggtaaattagaaattttagacatagactttaggcaggatttagtcactaattatttgatgggaagaagtcaaagatgactaaatgtgccagcttgaagagaccttataaatgaggaagatgtaaacccatttatgccggaagctgcaaatttttttgtgaaaaatcagaccttggtgatgacctcgagcagtgtatataaataactcccaccagcctagcgttccaataatggaacactaggcataaatgagttaattgagatagtaaatataggactagggagagtggttgggaaggcaggtaagatagagtttgtgaatatttgaggactgggtgacacatatgcagaaatgcatatctgagacttagaaagttaggcttgagatagggattaagaaatcacaccaaactagagatggggtttcaccatgttagccaggatggtcttgatctcctgaccttgtgatctacccacctcggcctcccaaagtgctgggattataggcatgagccaccgcgcctggccaccccccgaccctctttttttttttttttttttttttgagacgaagtttcactcttgttgtccaggctggagtgcaatggcacgatcttggctcactgcaacctccgcctcctgagttcaagcgattctcctgcctcagtctcccaagtagctgggattacaggcacctgccacaacgcccagctaattttttgtattttttgtagagacggggtttcaccatgttggccaggctggtcttgaactcctgacctcaggtgatctgcctgccttggcctcccaaagtgct

SEQ ID NO: 80001 - DNA, 1231 bp, Homo sapiens
tttagcactgctctgtatttctgttagccagtgatgaaaaacaattgtctttctttttggtcatagatacattactagaagaaagcattctatattaaaggcttgtgtgtttctgtagcttctatggtttgcagcctactgagcttatgatactatgtgaataactaatccagatggttaaactattggaggatagaaaaccaaaacccatttcagaagctatgcattttgctcacctttggataggattcattctaattggtagtgactttctgaatttgtttcaaaatttaatttttaactacatgttttcttgatttttacctaggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaagcacttggttatgtcagtgacttctactaacaacaatacctatgataagctttggtgtgtttcaagacaagccgtttatagttttacaagaaatttttcttaaggagaacctgttgttaagaaataatttgtgaaggggcactatagtcattatcaattatttgttatccaaggctcatctctctttatgtgtgtgcgatgggcttttaagttttctaccagttctgagattttctgatgaacatagagttgcatacagatatcagtaaaatgcagactctgatttaggatgtctgaggtggagccccaaattctgcatatttttacaaattccaggtgatgcagatgctgttggtcttttaagaaggacataaggccttggtttaattcagactctgcccctgaaaagaaaagagtaaatccttactcagtaatacccaggcttagtctgcaaggatatacagtacatcctgtttggagaaattttccaaaag

SEQ ID NO: 80002 - DNA, 1043 bp, Homo sapiens
agctatagagtgagaagataaggggataatggcgttttgaaggaaggaggggagtaaatataactttaaagattttaattggatgggtgaaattgtttatatgttttaagtatagtcagtaattggccaggcacagtggttcatacctgtaatcccagcactttgggaggccgaggcgggtggatcacctgaggtcaggagtttgagaccagcctgaccaacatggagaaaccccatgtctactaaaaatacaaaattagctgggcgtggtggcacatgcctgtaatcgcagctactagggaggctgaggcaggagaatcgcttgtacccaggaggcagaggttgcagtgagccgagattgcgccattgcactccagtctgggcaacaaaagtgaaactctgtctcaaagaaaaaaaaaaaagtatagtcagtaattaaataattttttgagactggacaaaagttaaataaaagtaagctagtaattatattcaatgtcatagcagattttaaaccacagcttttcaggttgccagtaaataccacacaaaagcaagaggaggctggttgtgctagcttacacttgtaatcctagcactttgcgaggccaaggcaggaggatcacttgaggccaggagttcaagaccagcctgggcaacatactaagactccattttttaaaaagaaaaaaggaaaaattagcccagcatagtggcgtgagcctgtagtcctaggtactcagggggctgagacatgaggattgcttgagcccaggaggttgaagctacagtgagatgattgtgccactgcactccagcctgggcaacagagcgaggaaaaaaaaaaacaacccaaaaacaaaacgaggaatgtaaaagtgcagtgcattttacaatgttatgattaaagtgaactctatcttaaattttataataactgactttattttacttacttatttagtttttgagataggatctcctctgtcacccaggctggaatgtagtgctcactccaggctctgcctcctggacttaagtga

SEQ ID NO: 80003 - DNA, 1019 bp, Homo sapiens
attgcagttagtgaagaaattatggatttataagaagtaaattttccaggaggtttaagtggacttaaattaagtatttcttataattgaaatgtgtatatttctttcaggtaccaggtgtcactggatttctatgagcaaatttgttatgtttcacgttccagatagaaatcagccaatttaaaaatagtggtgaagttattatagcctatatttaatgagcacacatttggctgcattaaaatgaatcttaatgtattttttgcacagcggagataatctgttaatatttaatgccataaagcaacaatggaattctgctttcatgtggtgtatttataaaactagagtagagtgttatgtaaaaactaaaagtacagattaatttaatatgcatctggtgaattcagggcttgaaggatgcacatctgttgagaaaacaaatcatagaactattcagagtttcagcatctttaaatatgtgcgctttgattctgttttaactgttttgaaacagtctttaatggatttagaaaaggccatttgctctaaggaagcaactgtgaagccacttacaatgctattattcattttattattttttaaagcatttttatacattactatttttctttccaatttatttattggggaaggaaggggctaaatgactcaccataacaaaatgagtttgttgcagaaccatgtttaaaaagaaaggaatgtaatttgctgaattcaatagattagaaatattttaaggctttgtcaaaataatacgccaaaaaatattttaaggctctgaattctaatttgaactcacaatcagtgaagaaataatcagtttctactgtgtattcatcaccatactagagctgtggtaatatagaaattgaagatatagtctatatcttcagcttctatattaccgcagctctagtatggtgatatagattatatcttcaatttcgagttgaaagaaacaagacttaaaatgaaaggtagagaataacacagat

SEQ ID NO: 80004 - DNA, 1343 bp, Homo sapiens
tgcctcatcctcccaaagtgctgggattatgagtgtaagtcactgtgtctggccaatttggggtttttcctaattagttaatgtaatcacatggttcaaaagagtatatatagtcaaaggacaacttgctatatgttttctctgctaaagtggattggttaatttttttactttttgttaccacaaagttcttgctgaaggattatattgtttatcaatccatttaataacatgttgaaataatatgctatataaatagattctttttttaataaaaattacaacgtagtctaaaggagaaacactgattctgcaaattaacaggcaaataaattgttaaaaattttgttgcattaatacttgaaatttgtaggtgtttgttaattaatgaagtttaattttctttcatttctagtcattagaccagatctactgcactgttaattaatgttcctgatttatataggtttgtaactatttttttcaaacagttgatacttggatggctattgatgttctctcttcttttcacagagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcggtggctcacgcctgtaatcccagc

SEQ ID NO: 80005 - DNA, 1077 bp, Homo sapiens
cacgtgccgccacacccagctaatttttgtatttttagtagagacgggggtttcaccatgttgtccaggttggtctcgaactcctgaccttgtgatccaccctcctcagcctcccaaagtgctgggattacaggcgtgagccactggacccggcaagagtatttgaatagctctgcttgtggacaaaatataaaaatatttttcagttgtaaaaattctgttactactgttattgctaagataaccatcacactgagtttattggtggaatacagctttattgtgtcacattttctaattctttaagttgtatatcttaaataaagattatttaatacctttgagaatttgatgttaaagaaggaattaagttgtttaaggaatagagattgtattattagcacttatctagttccatctgtttatattttacagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaagtaagtttttatattctggaatataaagaaaatatttatctcacgcctgtaatcccagcactttgggaggccgaggcgggaggatcacttgaggccaggagttcaaaaccagcctgtccaacatggtggaaccctgtctctactaaaaatacaaaattagctcggcgtgctggtgcacacctgttgtcctagctatttgggaggctcaaacaaaagaattgcttggtgcagcaaaccaccatgcacacatatacctatataacaaacttgcatgtaatgcacatgtatctcattttcacgccactgccctccagtctgggggacagagtgagactctgtctcaaataaaaaattaattaattaattaataaagaaaatatcttgaaaataaaggacaaataggatattgagtcaagtttctcttcaagctcataagaaaatgcaaaaaaagtttttaaaaacttcttctaatttcttat

SEQ ID NO: 80006 - DNA, 1048 bp, Homo sapiens
cctgagtagctgggactacaggcgtgtgttaccacacctggctaatttttgtatttttttctagagatagggtctcactctgttgtccagggtgctctcaaactccttggttcaaacggtccacctgtctcggcctctcaaagtgctgggattatgcatgtgagccactaagcctgattttagaatatcagattttaatttaacttcttagtcccagccacttgtttgacttctttttcattgactgcactcttggaaatgatgatttaaatttaattctggtttgacaggaaaagataattaaaaatcttcctgatgatatcttgactctaaatattaagcatcaccttagtttattagctatattagttcaccaggaatcctcttatcaatctgtgtgtgtgtgtatttttttttttctatctttaaagaaattttagatgggcagaaatcaggcgaccatctaaagcggggtaggaagaaagggagaaacagacaggaagttcctgcatttactgaacctgacacgactgcagaggttaaaacaccttttgatttggccaaggtgagtgcttatagattgaagctttttctgactattggagaagaggaagtgactaatacatttcagagagcaaagtgtacaaattggtctagaatggcaatttttcaacaaatgcatgaattttaggtagaaaaagttacatatactcctttctatatggtagattttttgtttggcaacctgattagtattataaagacatctttgcttttttttttttttttccccaagacagagtcttgctctgtttccagtctggagtgcagtggtgcgatctctgctcattgcaacctccgcttcctgggttcaagtgattctcctgcatcagtctcccgaatagctgggactacaggcatgcgccaccatacccagctaattttcttttttttttttttgagacagagtctcgctctgtcgcccaggctggaatgcagtggtgtaatctcagctcaccacaacctctgcctcctgggttcaagcgat

SEQ ID NO: 80007 - DNA, 1046 bp, Homo sapiens
tgcttaaagatgtcatataaacagatttaactgctacatttaccctccactagctatagtaatgggctgaaagctactagcagaaaagacaaggtaattatcagctagtttttctagagtataacctttcctcagaaccttgattataactaatttgtatttcttcctttcactgccttctttcttggttcttggatagtatataagttgttactgaacagaacggagcattttctcccttgactttttacattgtcattaattatttgatgttattttgatgtctttgtacgataggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtaaattatttcttttctattttattttactgtgctttgtgttaatacgcagagccagtcagatctcaagtaatttctctttttttgtttttttttggttgagacggagtctcactttgtcgcccaggctggagtgcagtggcacgatctcggctcgctgcaggctctgcctcccgggttcatgccattctcctgcctcagcctcccgagcagctggaactacaggtgcctgccaccacgcccagctaatttttttgtatttttattagagacgggattttacagtgttagccaggatggtctcgatctcctgaccttgtgatccgcccacctcggcctctcaaagttctgggattacaggcgtcagccaccgtgcctggctttctctttttcttagtaaatttcttccctaaaatatccagtgaactcgagtgtcagggatatgattagttagaaacccaaggttaggccaggcacagtggcacacgcctgtagtcccaacactttgggaagccaaggtgggttttgggaggctg

SEQ ID NO: 80008 - DNA, 1071 bp, Homo sapiens
gatgggattatttttcatttgttgttgttgttgttgttgttctgagacagagtctctcttgcccaggctggagtgcagtggcacaatcttggctcattgcaacctccacctcctgggttcaaatgattctcctgcctctgcctcatgagtagctgggattataggcacctgccaccacgcccagctaatttttgtagttttagtagagatggggtttcaccatgttagccagactggcctagaactcctgacctcaagtgatccacccgccttggcctctcaaagtgctgggattacaggcgtgagccacgatgcccggcctgggatatatttttctaagaaaaatgttcccaatatgatttcctcattattagcattcgcatcattttgtctacctaccccagattcttgccttataagatagaactgtatgtttgtttttctgtgtagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaaggtaagaataaaaatgaatctgggcagtggaagatcttagagtgacataaatttaatttagaaatatgaattggaattagttttcctcaatctagtgatgatttataatactcttcaataaatagaactttgaacaacatattcatgttactgacttggtagcagtatattttaaaattaatttcaaaacatttaaattgacaaatatagtagtagtttttgtactgaatagcttaaacaaactgagcataaaaaggctaagaaagtcataacaaagatagaagactaattttttcatctttggaaggaaatctattgaaaaatcttctcttggctttgctttggaatatactactaagcaaccttaataatttgatcctatttgaaacatagttttgatgcctatttacttattaagataccagcataactga

SEQ ID NO: 80009 - DNA, 1156 bp, Homo sapiens
gtagagacagggtttcaccatgttggccaggctggtcttgaactcctgacctcaagtgatctgcctgccttggcctccaaaagtgctggggttataggtgtgagctactgagcccggcctaaaagcacacttctattcctattgatatggactggcttgttttaaagacattcattcttatggttttaaccacattttgatgttttttttttcttgtcacctgtaactgccttactttgcttccaaaactcatcactgccaaactccaatctgatccaatggcgtatagtagaatcgatttgtattaggatgaatttgtggggtccttgaactttgatggtatgagggcaaaggaaaaattttctagcttaacatgtggatagtggactaagccagccactcactagatttttttgctaaaatgcaaacagttgtgccaagtaaatttcactgttttccttatgtctacaaatagataatggaaaaagttattaatgtttgttcagaattgaaaacagattcctgagttccaagatcacaaagaaggaaatttattcaatatttttgttattcctgattcagatgtggaatttcctaatgactatccgtcaggttgtcttctgggctgtgtggacctaattgactgcttgtcccagaagcaatttaaggagcaggtgagtaaagaatactttttttttttagagacagggtttcgccatgttggccaggctggtcttgaaagcactttaagaggctgggcctcttaaaagtgctgggattataggcatgagccaccacacccagcctggtgcatataaatatctgtataaaaagctgtttccaggccgggcgctggtggctcaggcctgtaatcccaacactttgggaggccgaggcaggtggatcacaaggtcaggagatcaagaccatcctggctaacacagtgaaaccccatctctactaaaaatacaaaaaattagccgggtgtggtggcacgtgcctgtagtcccagctgctccaaaggctgaggcaggagaatagcttgaacccgggagatggaggttgcattgagctgaggtcctgccactgcactccagcctgggcaaccgagtgagattccttctgggggaaaaaaaaaagctattgccacaatgca

SEQ ID NO: 80010 - DNA, 1749 bp, Homo sapiens
ttcaggccttactggaggtgttgtctgtctttagactatttccaactctgtgtcctaggaatatttgagtgaagcctcagctaaactgagtccaaagctttttgctcttgggctcttggcatttatttctgaatgctgtcaggtgacagtgaaggcagaagcctcagattaaatttgtcctgattagatttagtggcttcagagttgggcccttgccacaaggaatctcatgtgagtcttctgattgtgaccatcattcaaagagtgctttggattcccccccaactacccgtcccagcttcttggtagaaaaaaatttccttgtgatagaagtctagaaagttggacagattagtgcttattttgtgaggatatggaggcataattttggctcctggtagcaattatgttgcaattagcatatagcaactaaatgactggaacacgataatttgttgaggggtttactgattgctctgtcaagtggaagtgccactccttatttattttatttatttgactcagaacactattgcctgagcttagccatggaggctaagtatagcaatgatatgtgttctccagaagttcccactctgcttcctctttgtagttacttcttttccaggtaccttagtacttgtactgcccttttctcctactctgaaggtagctaagcaattgttatttccctcatggaaaactggtcatggatgggaatactgccaggcagatgggattagcctgagatgaggcagccttatattgtgtgggaagttttcttttcagtctcttaattctctcttctacttgatttttcaaaatcagtttcctttaaagaaaacaaacaaaaaccccacaaaatgcaaaatatcgtaatgtattaaatatgccttcatgatacctctgttataaaagttgtctgtgacagacaaaatgaagataggtgatgttgattggcaggttctgggtccactaagtgtcagtgaaggactcttttcgctagggaacaggtaattcaccaaagcacctgcctagctgggcatgtggaattggcagcagctgtgtagctgaagagggattactgagcaggtggttgaagaatcacatgccacagtgacaagaaaatacttggtcttccgtgggttagattcagtttgtatgtgtgaaattgcactttgtttcacatttcttaatgcttgttgatttgttagtaagatggtaatagaatagagaaagagattcttctgtaactgtggttttttagatcactcagtagcatgccctagacatggccctacacggctctattgtatttatgggagttctggctttatgctttgtgcatgggagggaaatagtggtaattcagtgtttctagtacttgtttattaaagggaaatgggaaggagaaaatttcttgctttcagtatggtgaaaaagatttagcctactgggtggatacctaataggttttatgcaaatgatgtaattgactttttgtggaagtctacctgacatgccttactcaagtgattttgcatgtgtttttatattatgtttttatattatgaatatatttccccacatgaagtttgcatctcttcggttgtttatttgtttgtttgtttgtttttcttttttgagacggagtttcgctcctgtggcccaggctggagtgtaatggtgcgatctcggctcactgcaacctctgcctcccaggttcaagcaattgcttgcgtcagcctc

SEQ ID NO: 80011 - DNA, 1009 bp, Homo sapiens
gccaacctggacaacatagaccccatctctacaaaaaatttgaaaacctgccatggtggcacactcctgtagttccagctacatgggaagtggatcacttgagcttgggaggttgaggctgccgtgaactgtgatcatgccactttactccagcctgggcagcagtgagaccctgtctcaaaaataataaaaaaaataaagaccaagaatataccttgtaaatttcagctacaaattctgaaattcggtgtaaagctcagcatttatctgttttggaacagatgcttctagagcagagttctaaagaatggtatcaaaaatgaaactataagaaaagacatggaattgtaaagcttatgacatatatatctgaagggtaaggaagggaagaaatttgtttctacttggcatatgctttcagatgtacttcccgttcataatttgaaacccgcctatgcttttctccttgaagcattgctgttcttccagttgctttggcttaaaacttttgactcatatttggttcttttttttttttttttttttttttggagacagagtcttgctctgtcgcccaggctggagtccagtggtgtggtctcggctcactgcaacctctgcctcctgggttcaagcgattctcctgcctcagcctcccaagtagctgggattacagatgcccaccaccatgcttggctaatttttgtatttttagtagagacaggatttcaccatgttggccaggctggtctcgaactgctgacctcgtgatctgcctacctcggcctcccaaagtgctgggattacaggcatgagccaccgcgcctggcctcatatttggttctttttttcgtcctcaccacctcatctgaatcattcaccaaattacgtatctaagcattcactaattggatagcctgacatttagcctcactagttagcctttttctttttttttgagacagagtcttgctctgtcacccagactggagtgcagtggtgcgatatc

SEQ ID NO: 80012 - DNA, 1461 bp, Homo sapiens
tggattacaggcatgagccaccgcgcccagcccgcatgttgtctttaactgtaattatttgtgaatatattttcttcatccctcattttaagctcgtgagatacctgtgtctcctctgttccgtaaactcttagcccagtgcttctttgaatataactttatgcttaattaatgcttgatgaattgaattagaacttgattcttgaaaaaagaaattgtgatttttttagacttctttttatgcaaaagtaacgtaacttccattcaacacattttatcccaaattgaataaactagggaaaaggcagacggtgaatgccttgagaaattgttcagattcaaggacaagcatttgttgcctttactgcatatgactgtactgtggttccatacatccgagctgatagaaaacttgcagcaagggtctagtggtgatgcatggcaggtggaggtgagataaatttagtcacaggaaccaaattggttctgctagggcaatataggcattgttgggccatctgggtgtggttgacttctgggaggtctttttagtttttctttctcacttcattccataaatatttattggatgccctgttctagttgtttaagatcaatgaacaaaatagaccaaaaaaaaaaaatcaacctcatggatattatctttgaataggagatagaaataaacataataatatataaaattagaaaggtaatatatgatatggggaaaagtacagcaggataaggagaattgggagtggaaaagagggttaggtaggagaggtgggaggggttgcaaccctaaataagatggttaaagtagagatctttgagaaatgttgtgttactgggttgttaggcacttccctgagattagtggattctcttctgcccagcagagagaaaggcaatgtctacagttgttccagagtccagctgacactgaggagaaatagctactccttatgttcttttctcctgtctgctcctcttgctggcatcactggaagttaactggggtgaaaattgcagtcagtcttgtctggaagacagcaggggtggaactagagaccttctaacccagttccctgaggggtgggatttacccttctgctgactgagccttggttgcctggagtgatgggtgaggtaggcctctgacttttttccttcctcaaagggagaagcccagtatcataaccttctctcttcttagtgaggcctcagcaactttatttcaggtagctctttaaaaataagctttcaaagagtgtgtgctatgcgcctggcctaaagcgtgaattttcaggtttttggtgctttgacttcctctcaacacattagctgtgttttggaagtctcagtacctaatttcagcagcctaaagatgaagttttcttatgtctagatgctctcttgtttgaattgcacattgtaaatttatttgtttattccctt

SEQ ID NO: 80013 - DNA, 1757 bp, Homo sapiens
atcctcttgcctcaacctccagaatagccaggactgtaagcacacatcatcacacctggctatttcagcttctcacagatgaaataactgaggcccaaatagctgtagtgacttcccaatgttattacacatctagggagagtaaatagtagaattgagtttttctgcctgcttacttggttttgtgtttttttttcccccattgcactgtgctgcttccttgttaatcaaatattaacaagtttgatcagagggtgctgtttcagtttctttccttttttttttttttgtcctggtgacattgcctccaaagaccatcttgatgataaataagttctatgtggaagagtttagtgacattcatcttatttgacattttaataaatgtttcacataagtgaaatattgagattttcctatgacattaaactcttccaggtagttaggtccccaaattgttgagattatgcttcaggaatatcttgactgaggtgaaaagtaaatgagcttcagtgtggataagaattgcatttaaaaagagggagaaagtctaaactactttcttaggatgtgtaatttttagctaacaattgcagcccccagtagaaattaagaatcttggccgggcacagtggctcacgcctgtaatcccagcactttgggaggcagaggtgggcggatcacgaggtcaggagttccgggccagcctggccaacatggtgaaaccccgtctctactaaaaatacaaaaattagctgggcgtggtggcgcgtgcctgtaatcccagctgttcgggaggctgaggcaggagaatcgtttgaacctgggaggtggaggttgcagtgagccaagattgcgccattgcactccagcctgggcaacagggtgagactctgtctcaaaaaaaaaaaaaaaaaaagctggatgcggtggcttatgcctgtaatcccagcactttgggaggccgaggcgggcggatcatgaggtcatgagatcgagaccatcctggccaacatggtgaaaccccatctctactaaaaatacaaaaattagctgggcatggtggcgcttgcctgtagtcccagctattcaggaggctgaggcaggagaaccgcttgaacccgggaggcggaggttgcagtgagccgagattgcgccactgcactccagcttgggcgacagcgagactccgtctcaaaaaaaaagtgaaagaaactaggaatcttggtaagatattcctcgcaaaattaacttagtgtactgccacggaaatgctgggcatcattaggaagagaatcagtaccaaataaacaaagataaaaataaacttccatctgtgtaaaaccaaggtttgtttatatttgtgatactgtgtattctgttgaccccgaagaagtatttatcaaagctgatgaccaaagaaggtgaaggctttaatgaatacatgcaaagaaaaaaaaaattcagcttttaaagacaaagggaatataatgtcaagtgatgaaaagaacatatagacttgatcaccagttcttaggatcctgtattagatatggaacactcaggttagaagtgattttagcttaatgattgggctactcttataaatagtaaataaataaaatatgtttaacggcggtagaaatttaaaaatggaagataaagtgtttgcatgttttttaaattacactttttattttgagataattatagagtcttacgcagttgtaagaataatgcagtggggttgggtgcag

SEQ ID NO: 80014 - DNA, 1221 bp, Homo sapiens
agagtttttaaagcttttgctagatcatgttctgcgtctctgataatgtaagaaaaagcaaggagaaatgggggtataagtaaagttgtgctagagcttgcatctgtgatatgccaggacctgtattgattgaggaagggttgccagctgacagtggtagtagaaataggtctcttaggagtgggaaattaactctagaggactcctagttaagacttaccatggaatctctgggcaattggaaatactgtactttcccctagggagatggagtgggaattgatttttccttaggtccaatgtaacttggttagaaatacaattgaacctgtttgtcatgtctgttgtgatatgatagccccataggaagggtctgtttttgtgtgggagtttatttcaggcgtctcttgcctgtattgtttcttttaacagctttttaaattttctttttccagcaatgatgttgtccactgggcatgtactgaccaatgtggcaggtctgagaacatagctgaagctgaaaataggaaagctgggggcaaggaagagccttgaatcttgaggtgggacgttgactctaagatgtccttgagcagtggagcctccggagggaaaggagtggatgcaaacccggttgagacatacgacagtggggatgaatgggacattggagtagggaatctcatcattgacctggacgccgatctggaaaaggaccagcagaaactggaaatgtcaggctcaaaggaggtggggataccggctcccaatgctgtggccacactaccagacaacatcaagtttgtgaccccagtgccaggtcctcaagggaaggaaggcaaatcaaaatccaaaaggagtaagagtggcaaagacactagcaaacccactccagggacttccctgttcactccaagtgagggggcagctagcaagaaagaggtgcaggggcgctcaggagatggtgccaatgctggaggcctggttgctgctattgctcccaagggctcagagaaggcggctaaggcatcccgcagtgtagccggttccaaaaaggagaaggagaacagctcatctaagagcaagaaggagagaagcgaaggagtggggacttgttcagaaaaggatcctggggtcctccagccagttcccttgggaggacggggtggtcagtatgatggaagtgcaggggtggatacaggagctgtggagccacttggg

SEQ ID NO: 80015 - DNA, 1293 bp, Homo sapiens
gtctgtaggggaatcctctaatttggaagaaaaccacattatcattaccagctgctctgaccttgtaattggtcattacccacacactaatgagcctcccacagagtacacatagtatttggcagttagtccagggcagttctgactggcagtcagtgggcagccatatctggccacctcttaccttttcagacttgactttctttagcaggcgacactcattctccccttcctctggctccggtttagttcccaaaggattgagcgctgccccaggctcaatagctatactcccaagtggctccacagctcctgtatccacccctgcacttccatcatactgaccaccccgtcctcccaagggaactggctggaggaccccaggatccttttctgaacaagtccccactccttcgcttctctccttcttgctcttagatgagctgttctccttctcctttttggaaccggctacactgcgggatgccttagccgccttctctgagcccttgggagcaatagcagcaaccaggcctccagcattggcaccatctcctgagcgcccctgcacctctttcttgctagctgccccctcacttggagtgaacagggaagtccctggagtgggtttgctagtgtctttgccactcttactccttttggattttgatttgccttccttcccttgaggacctggcactggggtcacaaacttgatgttgtctggtagtgtggccacagcattgggagccggtatccccacctcctttgagcctgacatttccagtttctgctggtccttttccagatcggcgtccaggtcaatgatgagattccctactccaatgtcccattcatccccactgtcgtatgtctcaaccgggtttgcatccactcctttccctccggaggctccactgctcaaggacatcttagagtcaacgtcccacctcaagattcaaggctcttccttgcccccagctttcctattttcagcttcagctatgttctcagacctgccacattggtcagtacatgcccagtggacaacatcattgctggaaaaagaaaatttaaaaagctgttaaaagaaacaatacaggcaagagacgcctgaaataaactcccacacaaaaacagacccttcctatggggctatcatatcacaacagacatgacaaacaggttcaattgtatttctaaccaagttacattggacctaaggaaaaatcaattcccactccatctccctaggggaaagtacagtatttccaattgcccagagattccatg

SEQ ID NO: 80016 - DNA, 2274 bp, Homo sapiens
ctttatttgtttcccagcttgactggcatttcatcatcagactcataatagttgataaacaatacgcctttggtgataatgtagattgagtacggttcttgatgggataaatggtgctgttgggtctctggtagaacaaagggctaaatttcatggcatatctacgaagtgttctattgccggctaccaaagagcgaaggggcacattttgagggcaagaggtactcattgtactttgaggtacttagatcttatgagttattgttgtggttatgacagtttggcctaggaagagattggccattaaaggtgtagcttcatgccaggtatctcccacaactattaggaatcaaagtctcctcgtggtttaatagctgccaacagtgtaatgataccttgccttctgcttgacttggaaggacaggtgcctgcagccccaggaggggttagaactgagtccctcctctgggaagatgatcttagttcatgctttaggaaatggaacttgcagggctggaggagaatgggtgtgagtctagggtcagctcaggcagcattaaacttcagcagcttattcctgcaaaacagtggccttgtggtgagctgttcattggctcttgattttctgctctgtgctctgctcatcctgtgctttcagctgatcccagcagatgcagtataaattgatttctctgtaattagatcagctgcagcagggaatacctatttccatatgtaagtgttaataaataaaggctggatgtgtatgtttgggtggtggtgccctcttagtgcctgtattccagtggtagctcatgctttctttgctgtcggtattttggtctttgcctctggcacatctgtagctcttagcaacatctgggcttctccagtagcaggtctgtgagtttcttccactaataatacagtggctcattcccttttaccagtggcagctgccagagaggctgcctgtgtttaggtggcagatgctatagtccacttcagcagagtcaggttccagctggttactagcttggctcatcctgtgctggctgtgatttgctattttctctcgggtacagatggataatactgttttaaagaggcttaggagtactagcagttgttgcttctgttccaggcccattagactgttccctacatctggcttcaagaaactcttgccatatatccatattcataatcattattcttcctgtgctaaaaagtacttctgaggatgaccttcattctcctatctaaattttagagtacttatgttgcaaccttctaagcccagtgatagtctgtggatgaaaggattaatattgcttagctttatgttggatttaagtgtaaatgtccatgattgtctctaacagagaagcaaatggaacccattttctcacatagaggtgcagggactgattgggtggctgcccttcagattataattgggctgaaagatgcagtatgttcagctaagaatacatcctggtgccagggagttttgtcccttaataatgttgctttgccatataagctttgcctcccagggagactctgagaatggggcagcagaatgagaaagaaaagggaaagagactgtgcttcagtttttgaaagatagagaaaattgctggcaattacttttagaagcagaaaatttgctatacagtttcatgtaaccataagcaagaacctgctttctcaattccttcccctgttccctcaacccttttggacagtctggtcctgagggtgcctttccatattacctttggctattgaaataaataattatttaaataaatgtttggaagttgctaggagattaaaacatgctgtgcagggagagaacatttctggactgggaggagcagaagaggcaagttaaaggaaaggaagttaggaaccatgcagaggagcggtttttgagaaacaacaatctccggtttggggcataataggtgctcagtgagtatttgatgattagtactataatttataagcaaagtctttgaaaacttctttaaaattttctctctgagaaatgggcttgcctgtggtttgggacgtttctatgtagggataacaaacagaaccaaaatagcaaaacagatgttttgatataatctaagaattgcatcctctcaactgggaactgtcatgaagaggaagaactcataaaatttgggaagtttcttgactgaattctgtggtgcagagtagcagtgttgactactagccaatgaggaagatttgaatatt

SEQ ID NO: 80017 - DNA, 1055 bp, Homo sapiens
ttgggtatacactggtaaataaaacagagatggtctctgctttttgaggagcttacagtttaccgtctacagcagagttcctaaaagtgtgtcccataaaaccatgtacatcaccagagtatcaaaaatgcacattcttggaccctaccctagatatgccgaataagtttttggggtaagggcccagaaatctgtacttccagaagtctctccagataattgctatatacatcaaagtttgagaattttcctttcaaggtaagtattcggggccacttctcatttaaaacaccagccttctaaacttgaatttcacatcaactcttatgtataatttagtggctaaaagcgtaaactctagccaggcctcctggcttgagcctgggaggttgaggctgcagtagtgagctgtgatcgcactagtgcactccagcctgggcaacagagtgagactccgtctcaaaaaaataataataataaattttttaaaaagtgtgaactctggagccagactacctggctttgtttcctacctttgcacttatttactgagtgatcttgaccaagtttcttaattgttcttcctcagttttcttatctgcaaaatgagagaaatagcacctacataagtttgtatttatttatttatttatgagagggagtctcactctgccgcccaggctggagtgcagtggtgcagtctctgctcattgcaacctctgccttaacctccagagtagctgggattacaggcatgcaccaccatgcctggctaatttttgtatttttagtagagacagggtttcgttgtgttggccaggctggtgtcgagctcctgggctcaagtgatccacccgccttggcctcccaaagtgctgggattacaggcatgagccgtcacacccagcctttaagtttgtctttaggccgggcgcggtggctcacgcctataatcccagcactttgggaggccaaggcgggtggatcacctgaggtcgggagttcgagaccagcctgaccaacatggagaaaccctgtctctactaaaaatacaa

SEQ ID NO: 80018 - DNA, 1064 bp, Homo sapiens
aatcgagcttcttttctggccatatccctggcatggggttgggtatgttggatagatgttactgtggttttgccggaatatgcaatctcacggacactggagtagtgctaagtgtttttgtttctacacaagactgcatggaaaaaatctaagtcttagcccttaatcttcctcccccagtgtgaacttgtatttttgccatttgggtataagagcttttaccagcagagctcatccagggaggcagcagggcttgggatgtggcagtaacatacacagctgagatcctgccactgctggctgtctgagccctctctctgtggttttcactcttcaagccatgcttgagtaacccgcctccagagctgctgacagggctgtgttcagaggccttggaaattacactgttcatttccttatcatcccctgacctgcagtgcagagccttctggtgcaggaacaaggcagaaaaaatccagacggctcccagccagcatgtgtcaagagctacaaagaaggaaattggacttgctcacttaaaaaccatggggttaggctttgattttcagttcctgtggagagttatttgtgtgtatgagcatgttgtatctctgtgtatatgtatagaatgagtctgtgcgtggcaaagctgtggaggaggaccatttgaaatagagagcagagggaagatggcttttctcttcacttaatttcccagttgtgccattggggtgggcctggaaccattagcatcaggaaggtgccagaccatattaatattttaaaatatatttctctcggtacagtttagtcatggttcagagcacccacagaagaacctttcctggctgaccgaggagacatttttaacaaatcctattccctaaagtcattcatcctagatgacattgacatagtcaatatttaagctgcctaagaaagtgtagactttgggtcagtcctgggtaagagcaatagctcttttgagatgaaggatagtgtgataaaagagagacctttgtgatagctaaggtgaactaaggaggaatttggagcattttgag

SEQ ID NO: 80019 - DNA, 2077 bp, Homo sapiens
ttttcctttccttgttttattttttcctccctgtccttcccttagtgttaacatttcaaggtacaggaaatgattggatactgattgttttataactctcttaggacagcctattaatattctgctgccaagacgacagtcaggaggaatttaggtagaatcaaggctcataacctttatgaaaataccctaagcagggaaccttcaatttattttgaagtgtttgagttttactaaaagcccatcattgccagtgtggttttttaaaatggacagccatagtggctaaggagaccagtaagacctggagttggcagcagagtgagccttctgaggaaaaaaggaagaggaatattggtgtgggaaagaggtgcagctgtgccactggatccctgtcccttcattattctttactggccctggcagctgtcaaagtttgcttaatagagttgtgggctggagattgtttcttaatccctgtataggagtaccaagctccagctgtgttatctaggctctggggccctagcacttggccaactaatgctgaggcatctggtgactcgagacaaaagcctattatgtcagagagaagattgggcaaagcacaagcattgttatctctaatgcccccggggcaaactctgtacttggcaagtgagaatgccttgaccttgtgagtttacagcaacctgtccactcggttttctgtttctttgagattattttctactaacgaggtttcagcattctggcattgaaatctataagtgctttattgtaaagaatttggaaaattcagaaaagtaaaaggaagaacataaaaattgtacttcattctaccagattcttaagagaagaatttctttaatgttgtggaactggctgagattattggttcaggactggcttgggcatgatctatacctcatgaatctcaactctgtccctttaagcatctttaattttcccattagagatctgaactggtttggccctgcttggctagattttattacaattgatgtgatctcaccctggagtatgaaactcatcttctttgtttagctttttataacttatctcaaaccaattttttatcttcatttgtgattgtcttcagaagtctgggtgtttgttttttttaaactgatggtggtgagtatgtagggagagagtagttttgcaatttttaaagacttaatgttgacctgctttcttctctttggaaagaggtgtctgtgatgtcagttaacataatttgctttcgttgatgagcttgctcaagacataagcttatgagatttctagttgtataaaaagaaaagggctgtctttcatgttttcttttccttgctggagtagcattttagttaaggaagttgcacaaaaagaaacccatcttttttctgtgtaattttctatatggatttctatgttgaccagtctagaccttttgtctattcgatgtttacatagatgtttagatttaacttttaatacattgtggttaaaaaaaaaaaaaaaggaaattttggtgcaatagagaaaagtattttggatttatttattgttccttttaaatgttaaaatgaggcaggaatacagtacttgcagcctattgtctaagagtactctttgacatttataatatcaggtataagcatttccaaaagagatcttccttaacataccatacccttaatgatcttttgacaggacagaaatggggagagatgttagcagggtatattttaatttatattctccaaaagtatacatcctatactatgatgaattattatagattttattttcatgtaatatggactcccttgcataactggagagaaacagcttccaattaaagtaattatgctagcagctctgagactactctttggaactgttgtcagcactttggtttgaagaaatcagaccaggattgactgcctaatagtaggcttttaccaagagcctgacataagaatttcaggaaatctaggaaaatctttgaaaatctgctatattataggccgggcacagtggctcaaatctgtaatcccagcacttcggg

SEQ ID NO: 80020 - DNA, 1118 bp, Homo sapiens
tctcttacatcgaaggttctggctactagaattcttttatcacagagaagtacgtagcatggccaactccctcatctctctcaagtcttcactcaaatgtcaacctatttgaaatttgcaaccacctctgtaccctccttttatcctatcccattattttttctcgaagcactaatctttttaatttactatgtgtatactttattatgcttattgtttattatctatctgctagaatgtaaactctaccaaggcagagattttgttttcttttgttttgctttgtgaatctttgtttctcaagcacctataatagtacctggcccaataaatatttattaaacatatgaatgaaatgtgcagtatggtaaatactaatctcatttttagctgatgtgagcctcagttgactgatttatgaaatgctggttttgttctctgtcttttttgttagaggcattcctcagatatctggtagtacttggttgtctgctcacgttttaaacatctttaagatggagcgctgaaagttatatttgaagctgtgagtgcatttgcaggacatctttatggtgagcttcacagcgagatgactgttaagttgggaaaccccagatgtcaagatcgttaggtgtttccttataggcttaccagatttcttagaaaaataacaagccccttccaatcctcctggagagtaaagatttctttgagctaggtgaaaaagaggactggggcttcagccttcagcattcagtatgtttaaatccacatttaatctccttattttaggtacggtactcatgtcctccactattcctggagcaccctggtccagagatcctctatttgagctttctctatttgagaaactagcctctctagtttttttgggtcgggggtggtatgtgagtgagaaaaggaattaaataaataattgctgcttttttttttttgagacagagtctgctctgtcaccaaggctggagtgcagtggcgcaatcttggctgactgcaacctctacctcccacgtttaagcgatcttcctgcctcagcctcctgagtagctggggccacaagtgtttgccaccacgcctggctaatgtttgtattttta

SEQ ID NO: 80021 - DNA, 2046 bp, Homo sapiens
gtgcagtggcgtgatcccggctcactgcaagctctgcctcccaggttcacatcattctcctgcctcagcttcccgagtagctgggaccacaggcgcacgccaccacacctggctaaatttttgtatttttagtagagatggggtttcactgtgctagccaggatggtctggatctcctgacctcgtgatccacccacctcggcctcccaaagtgctgggattacaggcatgagccaccacgcctggcccagtttttcatgtttcttgatgcaaatggtaatttttaaaatttcatttttcatttgtttgctgctagtgtatagaaatgcagttgatttctgtgtatgaccttatatcaatgtcaattagcccttatttctagcagttgttttattttagatttcctaggctttttggagatagtcatggtgttaatattggacttactcaactttagacagtgagaataagatccacatgatctagatgtttggattttttggttttctggatatttgagagccttatctttgtaggtctctgcatgcatgttaggatgacataattgaagtaaaccatgaatataaagtggatgaatacagttgcaataataattctatgtagaattgacatggcagatgggaaacaaggctgctttgccctctgggcttttgaaaaattggaaagtaggccctgtgctctaaagaatgataaaatctggctctggctcataagaagtacttcctaaaaccaggttactcaggaggatgatggaattacctctagccatttgtaaagccacttaccacttttttttttttggacaggtattttgttagtgagtccccaccagtgtaccaggcactgttttagtgcttgggatacatcagtgaacaaaacagtaaaacaaataaacaaacaaaaaaactccctgtttaaattacattctagtggggggaatacataataaatattaagcatgaaaatactgattttttattagtggtgagaagggctctggagaaaaatgaggcaaagcaggaggacgggggtgtagagaaatatattgattttaatacccttgtagattactttttgattaacactggaaagtcatcataaaccaaatagcaggaaaaagtactaattcataattaattattcaatgatgaccctttgatgaggattatctcaagtttacatatgtattccccagtgattcttttctccaactgaattgtctaatttgcaaggaattttttagaagaaatggttccaagcaagctatgctgcgatccctcaaccacaaaagatctaattttcatagaaaaatatttgaattttttcaacagttacaaacacaaagtaggaaacaaaggtcctagccttaccaagttgcataatttctcattttaccatctcacttaggaatggtcaatattatgtttgagaacagtaaagcaaaggaaataaaaaaggtgccacttttgaataattttactcgtgtacactctaacaaaatgtgagatgccaaagaaacaacactacaccagatggctattaaatcaaatgcttttctttacaagtcgatgaatcaatagactctagtgaatgtgctcagttaatagaactgcttaggctgggctaggtggctcatgtctgtaatcctaacactttgggagcctctggtaggcagattgctggagcctaggaattcaagaccagcctggacaacatggcaaaacccatctctacaaaagacaaacaaaaacaaaaattacttgggcatagtagtatgtgcctatattcccagctacttgggaggctaaagtaggacttgagctcaggaggttgaggctgcagtgagctgtgatcttgtcactgcactttagcctgggcaacagaacaagatcctgtctttaaaaaaaagaaagaaagaataataaactgcttacagcccttgaagagaaattcttagagagttatttgttctgcatatatgtcaaaacaacctacttgagatgaaatattcaaaattataaatga

SEQ ID NO: 80022 - DNA, 1042 bp, Homo sapiens
ctcactgaaaactccacctcccaggttcaagtgattctcctgcctcagcctcccgagtagctgggactacaggtgcatgccaccacacctggctaatttttttgtatttttagtagagatggggtttcaccatgttggcctggatggtcttgatctcttgacctcgtgatctgcccgcctcggcctcccaaagtgctgggactacaggtgtgagccaccacacccagcgtctctctggttttttaatttgtttttttttttccccccgcagaagatcctttggttttctactagatgttattccatctagatagtgtttatttattgttcatagtcatctcttacccagggaattccttattttgtattcctgaaatcgaaatattctttcatactcattatttagatgctaagagaaaacttggggaccgctcttcccaacaagattgtctcaaattttgtgcccatctgtgtgcattcacgcacatgagcatgtgtgtggaggagaagaggaaaagaacagagatggaaaagattttgaagtgggatgcttggcaagaggagtaaatagatgataattatgaagaagaaattggcaggatttcttaactgactagattatgggaacaaggagtagagaaacaggtcaaagttggctgaagtccatagaatgtatattttaatttaagtgctaaatttcctccatacatttttcatgaactttgaaaaatttgttggctttatacgaacctgtgaacttcagtgagaaaaacagcatctttatatttttgagcatagtctcaatgtcattaattcttctgcttaaaaatcctcaaatgacttgccaaattaggataaaatctaaattctgttaccaaggccccaaatttctacgtatctgactgcaactgcctacttaaactgatcttaccattattcccattcatataccacccacataggctttatatctgctcttacttaagagtttttatacttcctggtccctcatcctggttgttcctccccagtactcagctta

SEQ ID NO: 80023 - DNA, 1050 bp, Homo sapiens
catgttccaacctgaaataagggtggtcttgagaagctaaaaaaggagaagaactcaactgatttttttaattgatggtttagtagccaacttctgacctgttcttagcctgaaaagacctactgatatcaggctaatcatagttctgagataaaggtcagtggatgaagccctttttggaggatccctagggcacatttaataacaacagaaacttcagcagcagcagcagcagcattttatcagactatgttccaggcagcaataccaaatgcttcttatatatttcctttaattattgcagtagctctatgcaatacacactagcataatttttattttactaacaagaaaattgtggcttaaagaagttaaataacttgcctaaagttgcacagccagtagtggaggctctatttaaagccaagatggctatcttcaaagtccatttgtcgtaatcattatctcctatttatcttcatcccctttacttctatttgaatagtatttctttccttatctcatctgttcttaaccaaggccctcctttacttcttcctaaagtagtccacatctgtggagcttctcaggaatatacttttttgtgagatttttctataagattaaaattataaattaaatggctaaaaatttttacatactgtaaacagacccagacagttaaagagattatagagatttggcaggaaaaactcgatgcttttggaaagctcttgatagtattcacagataagcgatagtgaaaattgagactaatggatactggtaaaaaattagatgtggtatggttgatcatacttgttgtgattaaagctaaaacattattcaagtttgctagaaagttgaagagctgaatttgggctggatggagaaggtaagaaaaaaacacactgcacatggtcctcatttatgaacttaaatctttcctggctgccaactacttgctgattagaaatctgaactcccaacctgtatactaggaaatctagccttttattgtcctggtttaagaaggatttaaattgtgct

SEQ ID NO: 80024 - DNA, 1278 bp, Homo sapiens
tgggattacaggcatgcaccaccatgcccggctaatttttttgtatttttagcagagatggggtttcaccatattgtccaggctagtctcaaactcctgaccttgtgatctggccaactcagcctcccaaagtgctgagattacaggcgtgagccaccgtgctctatgccaagctctttcttgccttaggagtttgcatatgctgttccctctgcctatagtgcttatcccttggctcttcacatggatggctccttctcatcttttgggcctcagtttaaatccagccttagagatgccatctctgattacccaaggtagctcccttctcattgttctcttatcacatgacctatttgtctcctaatagcagtttctaatttatatctaatttgtatttacttaccagtccctttcgtttaccacctatactcagtgtgtatagcataggagccatacataagaagtactcaataattatttgttaaatggttgggttctgttatcctaggcttgaaaaacattaaaaagcactatttgtaccctttcaccaaccctgccccaagtaccttaattgcccttacacctctactgactgaaaatacggcacaaatcctgaagagaaagggaaactaaaagctgtacttaactgctatgctgatagttgtcttaggcagttttgaattaatattttattatctctgttcttcagcttgttgtgccttgttttttctcttctctgtgacttctcacctacccacttgactctgaccagattcctgacacttaaagggtatatccaagaaatgagatggccctgagcacaggggaggaaggatggaatgacaagggccaccagaaacctctttcaggactctaatcactctaaggtcacagtttagagtctagaatgagagggactttgagtgcctctttttcttgctcagtgccctcagcttgagtgcttagctggcagacgggcacttttcctcctcagttactgtcaaagcaacatgaaggtcaggcagagagagacaaatgagagcagctcagggaaaggaggttaccacggtaacaagcaggagggactgctatttggaaacagacctaatctttctcctccttctccctccttctcagcacaggaagatgggtattgtttagctgacctgcatccttggggtgggaaccataatccctttctgacagttcccaatgacactggagtgatctgctttgcattttaatttgataagcagcagcggcagttttctctga

SEQ ID NO: 80025 - DNA, 1027 bp, Homo sapiens
tgggactgaggcccagactctctaaccacatatactctgacaaggatttggattcttcagaaaaagaatatgcaaaaatcaaattgccaccagatgttaccaaaagatctgaaataccccattaagtctctttacacttccttccattttttcaggttcataaattttcaaaacagaatagattccgttctcaggggcaagtggaacatgcaagaagtctggatgccttgggcaacagcaacctacagtgagccaactgcttagtggatgcctgaaaacaagaccatctaaacatttcctataaaatctgtaccaagtgacagatacatgaagcggtgtgggtggctgggcaatgaggcaatcagtgggaagagtgaactggctgtacctataggtgttaaaaaaggcaagagctgcatatgcaatgagccaacattaagtgaatttaagagtgactattctccatcctcttgactccctcagctgcccttttattaatttttctcttcaggcctgacctcaaatttaatttataatctaactctcccatataaaatatggagagtacagatacagtttgaattacctggccaatacctatcacatgactgcatatcataagtaccaggatcaacactgttgaatactatgaagggaagaatctctagaagctgggaaattttgctaagtctgctaaaatcctctgtgtgggtatctcccgcagactgtggacacttgagactctaataaccacttggtaatatttacaacaataagtccctggtggctcccctgcagaagcaggttgagaagggaggggaaagccacatatcacacttaccatcttctgtttcctgccacacgatgccttcaaggttgacgctagttccaggttcacaggggcccaagcactcaggctctgtggccagagccacatcacatgtgttgaccccaactgatcgggtacgaaccatgatctgctcacagggagatgagatgtcattgttgaccactggcaccaaaaggt

SEQ ID NO: 80026 - DNA, 1073 bp, Homo sapiens
gagttgagaagctgtaacagagaccatgtggcctgcaaggcccaaaatatttgttatctggtcttttgttgaaaaagtttagccaggcatggtggtgggcgcctgtaatcccagctactcgggagtctgaggcaggagaatcgcttgaacccgggaggtagaggttgcagtgagccgagatagtgccactgcgctccagcctgggcaacagagtgagactccatctcaggaaaaaaaaaattattaaaaaaaaaaatgtttaccaatctcatgcctcgtatagccaccgtgcctggccaagggtctgaatgtttaattttatttaatttaaatttaaatagccatatgttaactagtggcttatggtattgacagcacaggggctagatctttaaaatatatatacacagacatgcatatatatatgtgtgtgtgtgtgtctgtgtgtatatactctgagatggaaagaagagtaattgtgtgggagtatgaagagggtgggtaagtagctgacatctaaacagacccatggtgacttctgtgtactctggcccctgttacccaggagaacattcggccctacttcaaactctgtggttgagccctttgctttggtctgtgggctgcagttttctcattatcagagtaataggctatggttttgcttagcaggaagttagtctgcctgtggtagctccgctgagaacctgccccagctattcttcatcctcatctgattgcagatcccagctgtgggcttttatccttttcactaaagggaaggggctctccattaatcttctttcatggaaatggtaaccttggtagttactcttggtttttcctgtgtgattttgatgtagaaaagtatgtgtgtgaactgtgaaatatctaattttagatatttgcactagaaaagtaaggtggcattcagctattggtttttctttctcatatgctataattaatgccccttcaccttcagtcttgccccaggcagtactcacctagaggagagatggggcacagtaacaaccaagctttctccactgtttagccagttgcatactagc

SEQ ID NO: 80027 - DNA, 1034 bp, Homo sapiens
ccttgctggtgataatgtcttctgttttacattagagttttgtccccctcattctagattataaacttcctggaagcgccaggcgcagtggctcacgcctgtaatcctagcactttgggaggtcgaggtgggcggattgcctgagttcaggagtttgagaacagcctgggcaacacggtgaaaccccatctctactaaaaatacaaaaaattagctgggtgtggcggcgtgcgcctgtagtcccagctacttgggaggctgaggcaggagaaatgcttgaacctgggaggcagaggttgcagtgagctgagatcgtgccactgcactccaccctggacgacagagctagactccgtctccaaaaaaaataaataaataaaaaataaacttcctggaagcaatgacatgtttattcaaccccactcccccaacccctaaacaaacacacaagtagaatatagctttgaatagtagctccttgcagattgaatgagaaactactagagtttgcgttatctgttattttaatttcttagtagtgtccaagatatcacactctcctagactgggagccaaagagctataaaaaattggtagcaaagtcaccaacttgctaggaatcataaattaccccttactctgaaaggttgaaggaaatttgagttataaaagacaatatggttactccagcaccatctagaggaaagtctagaaaggtttaaaatggtattttacaagttcactatatcagtttatttatctatttatttagagacagagtctcactctgccgcccaggctggagtgcagtggtgtgatctgggctcactgcaacctctgcctcctgggttcaagcgattctcctgcttcagcctcctgagtagctgggattacagtgcgtcaccatgcccggctaatttttgtatttttagtggagatggtgtttctccatgttgaccaggctagtctcaaactcctgacttcaggtgattcacccgcctcagcttcccaaagtgctgggattacaggcacga

SEQ ID NO: 80028 - DNA, 1639 bp, Homo sapiens
gttccttgtcccctgcccgctcagctacccccaaagttcgacttgtagagccccatagcccttctccttcaagcaaattcagcacaaaaggcctctgtaagaaaaagttgagtggggaaggggacacagaccttggggccttatccaatgatggctctgatgatggaccctcagtgatggatgaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagtggacaagaaggcagagatgggcctgaaggagcgggaggcagcactcaaggaagagtggaagcaaaagccgtcaattccaccaactctcaccaaggcccccagcctgacagacctggtgaaatcaggacctggcaaggccaaggagccaggggctgacccagccaaatcagtcatcattcccaagttagatgactcttcaaaactcccgggccaggcccctgaaggccttaaagtgaagctgagtga

SEQ ID NO: 80029 - DNA, 1100 bp, Homo sapiens
cccagaatgcttgttcttacctagaaaacatccactgatgcatggatggattttccttttctccccctgccccatcttgttccctgtgggtgggtgcagaggtgggggcgggggctttttaaccaaaagggagcagagttggattataaacaagatcagtagaggccaaaatcctactctgccccaggtgtctagtactaattatctgctctggtggttctactgggaccttgggcttgaagtatatctgtcttatctgtacaacacccagtcgttgttctgtgattgttgtaggaggcagagccccggatgtggacatatgtttatcctgccaagtactcagacatcaagtcagaggatgagcggtggaaggaggagcgggaccgcaaattgaaggaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggtacagcaccaagtgccagcactattccattcactggaagggggaatgaagcacagatttcacatccagagttttcttgctcagccccaaggcatattgaggctcgcttagatgacggaccttttttcactgagtcattctgtgaggtggccaccataacccatagttccttgaatgacccataatgatagtctgtgtgactacctctctctcccttgctccagctcaaggattgtctctgtagtcagttttcattgctaactaaaggtaaaactccttctctgtcactgctgtctcccctcagctggaatttgtaaaccatatactccacgttttgcagtgtgctaggcactgtgggaggtacaaaagaagtagagccattgagttccttccactcccggagcttacagcttaatcatagtggagagacacaaagaac

SEQ ID NO: 80030 - DNA, 1647 bp, Homo sapiens
gttagaagaaaatgctcttatttaactctactcgttttgttgcccaaagaaccatgtggggtgcttctggggtggaagggcactgctttagcctcactccttagagcctccagcttcctacagcagcctaaatagtctcaacattctggtgacattattataaagcacactctaaatagaaataagcttttcaaacagaaataggaaatttcttacccttgaggtgttcctttatccctgtcactcacacccatcaatataaaaatcatagttgcatttgttgagtgctcgccctgagccaggcgctgtcctctgagatttatagacattatcttttttaatcctccctatcaccttaagtaataagtattgatatcttcatttttgatgatgaagaaactgaagctcaaaacagttatttatttgctcaaggttaccaagctagtaagtctcagagtaaggttttgagcccaaggctctgactccagataagtgtgatctttccactttatcatatcacttctccaagatgaatctgagaccagttcaaagaacagtatcagatctatggaagttggaagcaggaaacagggccatgttcctaatatcccttagctaatttttcctgtagagctcagtaaagaaaggtcaagccaacagtctcagccaaagacactatgttagaaaatacctcagcctgtgcctaggaaagctgatgcccacccaatcaagctcactaaagcagagtttcctctacctctcccatctctttgactgtttgatttctccttccacaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacggtaagaaaagtacagtgatgctggctgttacccaaagactagtaaggccagatccagggtctgggagaaggtgggcaagttcaggtcctgaccacagtgcagcttggctgacttgacactggcagcccccagggcatcttctttattcttaggtatcttgcacttttaggggtcataaggtggcaccctgggcatctcacttgtgtgtgtgtgtgtgtgtgtgtgtgtggttgtatgcatatgtgtctcactatagtgcttttgtgtctctggtttcctttccagataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcaggtaagcctgttttccctaccacctgttgttttgtcttgttttgttttgtttatcttcatcccagtagtaatgtccacagctaggaccctcctacctgcctcataagaatccttttttaattttttttttttgagcttctaatctgtgcacagtcctaacctcctgcagtcat

SEQ ID NO: 80031 - DNA, 2470 bp, Homo sapiens
taagtcacttttattaatttggggcaacacataaagccgggatagttgctacctggatcacagaatccctaggtgagaaatagctatgaggggtcagcagtctggaatccatggaaccctggccaagcctcttgtacaagagtctcccgtgaagccatgtgcatctgagaggacctgtggaacacagtgtcccctagggaccagtactggccactcctacaattcattttcttggagtgccaccttgtggtttttttaccaacaggctgagtgcctggttatctgtccatgtttcccttgcagacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccctctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgca

SEQ ID NO: 80032 - DNA, 1366 bp, Homo sapiens
tcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgc

SEQ ID NO: 80033 - DNA, 1034 bp, Homo sapiens
aatggaaatctaaaggtgaagagaggggaggccagggcacagagtaaagctcctgggctaagccagtggccaagccagaaaacaatgctgggcagaaaagggttacaaggcaggtagtctggacactggattcaacagcttgccatcagccagggaaagtgaagctgaggatgcatatggagcagggccaggaagatcaggagagctgagggagaacaggaaaattgggaggaaggaagaggcagctcagcagcaaactccaggagaaataaccagcagccctcacagatttgtgattgtctcttaaaaagatttattttctcttcttgcctgaatgtacaaaggcaaaaagagtacagtttgtatatatatatatttatatatatatataaaaaaacaaggaacttggtaatgtacactttacagaagggaagaatcaggaagactgaaattaaattcaacagagcaacgccaatggaacaaaatctatgaacagcaacactgcccctccagcccgggcctccagctcgccccaacctgctcccaatgggagggctgagcaccaaggcaagcgggtgggctggggcaggaggggctggggacagggcctgggaggggcttgatcccaggaggggggcccatggtaggagatcactggaaagcttcctgggatgcccaagtaattaaaacaaacaacaaaggcccagaattatggggccaactagctgcccagttgcatcttgggggcatcagagtagacaaggggatggtgagagggtatacgggataagtgacatgggtggcctcaaagcctgtatgaaataattctctagccctctgcagtcttaactcgcaactctaagtcctgccatggccccttaaacgtggaaaaaagagactcaagaaatcaccatttcatttcatagggtgccctcttacccttctaagcgtgtggttctttgaccttgtgatgtgtggagagagttcggtaagagaaggaaatttcatacatgtacatgtacaaggcaggaaaa

SEQ ID NO: 80034 - DNA, 1020 bp, Homo sapiens
gcctcccgagtagctgggactacaggcgcccaccaccacgcccggctagttttttgtatttttagtagagatggggtttcaccgtgttagccaggatggtcttgatctcctgacctcgtgatccacctgcctcggcctcccaaagtgctgggattacaggtgtgagccactgtgcccagcccagagcttctgtatttatattgctggttgtaggcctcagaaaagcctttgggttggtaggggtgggggtggggtgtgaatgggagggaggtctaggaaggtggtgatgggcctaagtacttctctttgcttcctgcagattgttagcactgctagagtttgctgaagagaagatgaaagtgaactatgtcttcatctgcttcaggaagggccgagaagacagaggtgaggagtcagagtggcctgagccttacagcccagacagtggggcctgggggagagaagggagcacctccaggatgaggtgggactcttgaatttgcctttcaaaccctgggaaatcatggcaggagggcaagtgcctgaagggctcgtaaaagcctagtgcttatttgttccatctttgtttggggttttgatttcagcctaccattgtgtttctcatcagacttttttacactctgtcttctgcagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaact

SEQ ID NO: 80035 - DNA, 1018 bp, Homo sapiens
ctggaagtaatttttttttttttttttttgaggcagagtctcgctcttttgccaggctggagtgcagtggtgcagtcttggctcactgcaacctctgcctcccgtgttcaagcgattctgctgcctcagcctcccaagtagctgggactacgggcgtgtaccaccacgcccagctaatttttgtatttttagtagagacggggtttcatcatgttggccaggatggtcttgatctcctgactttgtgatctgcctgcctctgccttccaaagtgctgggattacaggcgtgagccactgcgcccggctggaagtgattctttaacagaagatcctttacttttatcaagagacttaaggttaattctaaatagtaagtaccctagagatttagaaatagcatttgaattataaaaattttatttaccatcatcattgcccagctgtacatctgctgcatacgctgcctgtctgtagtcagtgtgtgaaattgtaacctgctaagggcatttcagacaacagtttcacagacactttaaattagaggcagcaggatgtgatatgttagtagcactcatatgtattctgaggagtgtttccaagggcatgtcctatcactgagaaaataaaaggcactaacagattggctctaatcttccatctctcttccgaattgccttgtatgctggatacctgacaccttagtttctggcatgggatatatgtatttttttctcttccaaagcaggaccagcccagctggatgtttgggttcggtctgatacatttgattttccttaatcagcctgatcttttcagcctctgaaaaggactgagattctttttttttttttttgagacagtctcgctctgtcacccaggctggagtgcagtggcacgatctcagctcactgcaacctccgcctccctggttcaagcaattctcctacctcagcctcccaaagtgctgggattacagggatgagccaccatgcccagcctgtttcttaaatcatcct

SEQ ID NO: 80036 - DNA, 1744 bp, Homo sapiens
tatgagaggcaggtggagagaggagccaactggcctgccagggcctgggtaggagctaggccttggatcaggctcctccacttggcctgggggtggggtgttgtgtgcagggtgtctggtttctttgagtgatggcaatcccatttccatagcgtgtttcctagattccttgggcctgcccctaactttctaaaaggaatcctggtagagtcctaactagggattctgataagagccggatgttcttcccagtcagtgttctcgagtgtttcatatccatagagtggggagctggctgggaatttagctcccattgggtgggggatgggattttcagcttccctggctccagtgaaaaactcaggaggtggaggcttggtttcctggaagaaatagttgcagaggagctggcactatgttttgaaaacaaggctcttcctttccagtgttattctgattggtacttccaaaatgtcagaattcctgatggtgggggagggaagaagatacaagtacgagcacctttattatcctttttgaacatgaggtttaaatccaaggaaatcaagcttcctggtctttttctccctggatttgtgggggcagggagacagtatctgtccagggcttgctttgtacctgtgacagtacagtatgtagagaagcactagccctggcttgatagtgatattattatcaatctgtgctgatgggctttgaggagaaacatttggttctgcaggtggttttttgggggaagggggcagggcataagaacatatcagaactatcagcatcttcactgagtggtttcctgggtaatggaatttctgtctcttcctaaagggtctggtttcagttattccttatttattgacaatatggcttgttgggcatggggtggtagggagagccagttttccaatgatgtgccttcaaggtcactctatggtaggagggttgggggagaggagagaggggagagagagaggagagagtcaaagaggagagagagagagacagacacagactctcctagtatagtcaggaatcccccaaaatcagagctatgcttcagaaagcagtgtgggctaataatagcaattcctcactctgccaagaaatccaaatttagcctcagagctgctcaaaaatataaaaaaggggactgaggagtgggatagagggatgttacaaatgtgcatttctagaaaaacaaaatgagtaattcatccctttttgaaagagtatgcagtgttgattcaagttggtgccatgatttagaaggttatgaagccaaagttacagaccaggccaggcatggtggctcacacctgtaatcccagcactttgggaggctgagacgattgcttgagcccaggagttcaagaccagcctgggcaacatagtgagatgccccatctcttaaaaaaaaaaaaaaaagttatagacaagaaagggacaagtaggcaggcaagaattttgtcacttaaagtgaacaaaacaggtagtgtccggttagcagcagtagtgtaaaatgctttgtataagataaaccttaagaaaatttcttagtcctttgatactatataaacaatgatgtaattctgtcctgggaagaggctggcactgtgtgatgaccttactctgcaaactagattgaggtacttaatatgtaaaagtaaagtcttatattaaagcttgattacctagctatccactcacctctggtagcatatgtgat

SEQ ID NO: 80037 - DNA, 1032 bp, Homo sapiens
catccgggccttctcctcccctaaagcccccaaaagccggaacccaaccttccaagcaagtccccttttttctttcagccccaccgaattgtgccccattccccaaactgggctttccccggcatccagattccccaaattgtttcctgtcttcctcaaatctttcttactccccttataagtcacttcacccttccctttgaattccctccctgatgaaaactgcaccccccacccagactcttctcatatcactgccccccgcaaagtcaacctccatccttcagttctcagtttacccccactcatcaccctccccccattctcttcaggcctagcagtccttacacagatgtccagcctcttcctcctggtcccatacttcagcttcatctttcccccaccttcccctctccacacccctctcccagttaggccccattttcccagtctcccagcgccattccttttatttatcaaacaccaggtttgattcttgtgctccatcctgttgccccaatggtatacccccaacactcttggaaacattcttaccctctaaacatcttttctcagctggaactcatccttctccttcccctcttaactgaatcccgtctttggatcattagatcacaggacccagccatctcgcttccagtgaaccttccccctgtacctccagtgccttcaaaccaagctctatattctggacactagatctttgcaatttcctccctcaaaacccgaccctagtcttcccccattaattagagaaaggctgcacatctttctcagaccgagcaccctggttttccaaacttgcatggtatatccttccccctgcagatagttcctcaattttcctttctctacatgcctctctttctccaagacaacccttctcacctatctctccctcaaattttaatatatcccatatttctgcctctgttctctgaaactgttccacaatttcctaattccccggaatttttaatcctagttgctccttatacatcagaatggctt

SEQ ID NO: 80038 - DNA, 2769 bp, Homo sapiens
ggtgcgctggtacccttcctctgacaccacccagcaaggatggaagtaccgtcagttctgttagtttttcagtaagtgttggccccagaggcccaggacaagtgtcctagactccggctccctgaagggccgtagttcctccctctgccccgggtctcaagagcttagccgagcccagagcaggcctggctttagctctagtcccacgcctctgctcacggccgcctctctccctccctccaggtctggtcaccggggaggtggttctggtaatctgtggtggtgccgggacaggcgccccgagttcccactgcccccgggcggcctgcacagagctgctgccctccagagactgtgaatcccaagcctgactcagtggactgcttcctgttcccctccctcctcttcctcaccttgttctgcaccctcaagcctttctccaatgcctcccaggaggatttggggactttctccctggggcgcccagatccagctcggaggcctcactgggacctggcaaggcctgacctcccgcccaaacttgcttctgtagctccccctcgaggaagtgaggtgtttaattttgcatgttttctggcatgaattaagacacttatacttgtatatatgagtgtacagtttgttctcacactgtcaccatagcgacaggtcctggctcccagtggttcatcctgcctgcccctctctcctcgccccgcccctgcacccaccccgcttcagggaggcccaagttccgtggccccacacgcttccaggctcagctcccacctccacccaacagatagatggggtttgctttttcatttcacatggggctcctccgctcctgccttctcggatgggccaacagtcgtaagaaagccctctctgcccgttctgttcacctctccacagcgcaccccgcccgccgctgctcctcattctttccaaacctcgaaaccaaccaaaacgtgagaagtatttttgtaccctgtgtaacaaaatatttatgcatcataaaggatttttcatgtgcgtaccattaattattaaagcgacctcgttcgccctgtcagataagtttaatgtttagtttgaggcatgaagaagaaaagggtttccattcttcagcagtacgcctttgtgtctggcatttgtttaagaaaatgaaatgaaggaaacactgtgcaatgttttttgttttgagcatatcagtgctttactgtcagccgcagctgtgaccgtctggccatttcagacttgggagatgaggcggctgttgtcattgctgatcctgtgagaatgtgaaactggataatatatgaaatgcaaaataaaacaaaaccaaaatgactgctctcggcctttgcttcccccttccgtggacgcagactgccattgggaaggcagagccagagagatgtggagtcgggggaaggaagtgaagtgggcctggcccgctggcagctggcttgtgactgtaaaggtggtgggggaggaccttggagctcacttagcctctcctgcctccctggtttgtaagctggggaaacaaagtccagggtaagtgacttgcctaagggcctggcagttgtggctttacttcctcagtttccaggctgtcagggtagggagagactccctacaccaagagcaggcccccaggtgggaccttcctgggggaaggcggtgatatactcggcttaaccatttacggcctgtggtctttttgagtctcgctctggtaaaagaggactgaggtttgggctgttgggctctgccaggtggtgtctgtccttggcgtgcctcttgtgaggctgtgctggagggaaggctaggacctggaatcttgcccagaaggggttaacctcatccaccctgtagtctatgggctgcaactctgattcctggagcgggagcaaatgggtgtgaggctcagggaagctgtgcagtgccaagagcccaggctggcctgggccaggtgtcaggatgcccgtcatgaccctcagtcttaccttttgtgacttggggtctcgggttccttgtctgtgaagaggttgcttgaaatcctttcagactcttactggagggctggtgtgctgaactcagggtttaactgtttgttttttcatccactcctgggagagctgctctgcaccgcaccgcacctcagacccaaagccgtgcctggaaagggaggacagcagaggccccggaacccccctcccaataggtgttgctccagccttgctctaagcaaaactaaagtggctgtggctggctctggtcacttcctcacttgcacctcaggtcaccgctccccgccttaccccgtctcctgaatcccagtcctgcacaggtcggcttgggtctaagatgtcagtgctggtgaatgcgtcagctggcgacccaggtgctctgagggaggaggaggaggagcctggccaggaccaggccctgcaggtaaccctgggtgtctgtgggcgagttacctggacctcagagggtggctgtgttcgtgcccagaggagtccggggttactcgtctcccgcgctgtgccccttgcctcgctgcagtatcggaccagctggcaaggccgcccagccttcagcccctgcctgtgctggtgggaaagctgctctgtgtcctatggcccccacccagggccaagccgagggctgacctacttcatctgtgtcaagaaccagtgggtcttcctgaggtcgtgaattatttagcgaaggtgcctgggcctttctgagaggggc

SEQ ID NO: 80039 - DNA, 1098 bp, Homo sapiens
tacccaggaagcaggagttcccagcagccaagtgggtaactgggtctgcctgctccaacctcaagggagctgtctgcaggcccagcttctactcctttcctgccacacgctcatgtgctgccccttcccttcctgaggggactccagctcccctccctggatgctcatcccccaaccgcaactcaaggtcctgtgttgtcccgctccccccgccacacccctttccctgtcctgggtcaggctgggacagacatgcttcaccgtgcataactggggcaggcggccttccctgcggtcttggcagtcagcatacttgccttccagatgactggcccacagggaggagggaacgtgccattttcttgaccagtctctgggaacccagctttggggctactgctctgtggggccttctggcaagtgccagggtttaggcaacttccaggcactggtgaggatgatctcagatagctgccgcccacctgacgttatagacctctggacttagaggcttgtgatggagggcatggcacagcaggggtgggaaggtcaaaacgggagcctcagctgggtctcatccatggcttctcagaagaatcaggactgatgttggagagtcctaccccttggggtctacacggactttgggttttgttttgttttttgtttttgtttttgttggagacggagttttgttcttgttgcccaggcgggagtgcaatggcgcgatctcaactcactgcaacctccgcctcccgggttcgagcgattctccttgcctcagcctcccgagtagctgggattacaggcatgcaccactacgcccggctaatttgtatttttagtagagatggggtttctccatattggtcaggctggtctcgaactctgaacctcaggtggtccgcccacctcggcctccgaaagtgctgggattacaggcgtgagccgctgcgcccggccttgtttggttttaatagagacattatctccctatgttgcccaggctggtcttgaactcctgagcccatgtgatcctcccacctcagcttcccaaagtgttgggattacaggtgtgtgccactgcacccggcctta

SEQ ID NO: 80040 - DNA, 2680 bp, Homo sapiens
cagccatctcccatgctgcgttcacctacccaactgccactgccgctgccgccgccctccacgctcaggtaagccctttaaggttggggagggcgaagaacaagggctcttagctggccagactttgcatgtgcctggccacttggccgctgctgtcccagagctgcagcagaactcttgtcttccttgatggtttgaaagcccagaccccagggacctatttgtcctccccttgggtttaggatttgacagggagggagaagataacccacgagttcccatggaggatgccaggcagcccagctgtggttccccagccccaagcacccctgcccaggcaccgactatgttctcccatggtgatgggactatgattccagtcctaacctgggtatggtctctggagtcagaccatctgcctctgccccttcctgtccctttcatcaagctcttacagattgctgtgcctcgattttttttttttagtcatctgaaaaatgggaatgatcagataatctgccttagggttgttgtgaaagttagatgtcaagacgaagtgactactgagtgctaggatgtaacctagagcgccctgagtgttggctctcgcttccatgaaggctggacgctgtccactgtgaacctgtgccgggcaggaaacagggagtgaatgcttctggggagagtcggggctgttagagcagggccaggaaggctctgtgtggggtgctgggctgggtgcccaatgggcaggcagggagtcaggctttcccctggccatgcaggcgcttcctctggtctgacttggccacaagtgcaggtcactggagcactctgcaggggaggtctcatcccactgtgcgtgtgtcggggagcagtggggtgcctcacagtggcagtgacaagttgcagccaggcagccacaggaaggggctggggggcacttttgagcccacctcaacctttgaccagccaggtgatgagcactaatccccaggaagagctgcccggccagggtgtgctgtgctgctgcgaaggagagaattgaggttgctgggacctggctggggagcaggaggggatgaggaaggaaagcaggagaagccagaaaggagggttcacaggagccagagctgaggcgggaggagtcgggtgctctgcccgagagctgtgtgtacgtccattttcaggttcttccagggactcagtgacacctgggtttgtccagttccaaagcggaaagttcagattcaggggctgctaccctagcaaactgttttccccagcaggggaatgctccctggctccgcaacgttcagttgtactgagggcagaattgtggttaaccctggcgctcttccccagctgagcaccacaaatagcttgaaaattgatcagaggataaggaaggtggtaaagaccttcccctggagggaattgttgggtatttactgcaaactgggttctgtggctggaatagagcggggagcagggaagctcatcctgtctaccctgacctgggcagtgacttgatgcttcaggtcaagcggatgtttaactgcaaggccctgggaggcactggaaggaatcacaggctcccacctcactgggcttctcacctctgatcccagctttggcaccaattggctacatgatcctcacctctgtgtccccatctgtaaaatgagagggatagaccagataaggtggagaggttctgccctatcctctgaattgctaggctgtgacagaggttgggagccagggacaatgagtttgtcaaatgaatcagagagggcacctctgcccagccaggtgggggtggcactgctctctggccctgagctccacgccacagggcttccttcctcctgttggcttccttcccagttttctcccaccccatccacactctgcagctgtccaactctggcccaaatcctggttctcaacagctgtgggacattgggcacgttacccaccatctctgtgtttctgtaaaatggtgatgataatgcctacttgataggtgtgttgttcgcatgatggcatggagtcgcgtgatggcatggagggagtgctgtgaaagtgcagatggttgtgatgttatttaatatcattattgtctgggttcccttgggtcctctctgaggctggaggcctctttgtgcctgagttcctgccttctggccttccttggacggggactgggatagaggccacccaccccaaaggatagtggcgtttttggggaggcaggctaatgggaagagattagaccagggagtcattagttctgtccttgctactcaaactctctgggcagccctttcctcaatagtaaaacaggttgttttactgtttcccgactaagaacattttatttttttccttccaacagccccactgcttgccccctgacagtgctgccccagagatagggtataaaagtgtctaaatgaagtatggacactgttgatcttaagtgaattgttttgaacccaaaagaccaatagaaggactgagtttttctgtgcctgggggcaaggaggtgacttcaggagaaggtagcagctgaaggacaaggtgatgagaacaagtacctctgttctctaccccagctgcatgccctttgccagtagcccagcctgagcccaggcctccacagctacgtggctgc

SEQ ID NO: 80041 - DNA, 1033 bp, Homo sapiens
aagggtgttctctctttttcctactagcctgttggttttgtgatctttgacagccgtgcaggagcagaagcggccaagaatgcgctgaacgtgagtaggtggagaacaggtcttctctgactcacagccctcttaggcagtgggtgtgcagatgtatcttatttcccggccatccctgggcagagtccttggcgacactgtctgtgccaaaggccattactcaaggcctgagctgcctttcctctgcctcagccaccgtgtgggcaggtcttcgaggcgagcttgtttatggcgcccttctctactctctgccattaacactctgggtcccccggagtaagcctttctcttcttttctctacccatgtagggtattcgctttgatcccgaaaatccacagactctgaggctagagtttgccaaagccaacaccaagatggccaagagcaagctaatggcaactccaaatcccagcaacgtgcaccccgccctaggagcacacttcatcgcacgggacccctgtgagtggcactctgagctggcaggccctcatggagttgcattcagggcagacttgcaggctcttgcagagggaagccccttttccaggaggctttttgtgtccacggccacccatttttgaaacacctggttttcctccctcccctgcagcctgcctagaatttctgagctgccagggcttccagcttccctgcaaccttctttaatttctcatttgagacgagctgaggcctgtcttaaagcaggcaggatgcacaccatgacaggccgatttaacgtggcttccttgcctggtctcggggtcctctgtggttgggggtggtctggcctcagtgtggggcatatggctcaaccatagtgctgggtccccttctccgtttggaaggggaggcgagtgttctgatgatggaggccattgtctcctgttgtagatgacctgatgggggctgctctgatccctgcatccccagaggcctgggccccctaccctttgtacaccacagagctgacc

SEQ ID NO: 80042 - DNA, 2357 bp, Homo sapiens
tcccagctactcaggaggctgaggcaggagaatctcttgaacccaggaggtggaggttgcagtgagctgagatcacgccactgcagtttagcctgggcaacagagtaagactctgtctcaaaaaaaaaaaagaaaaaaaaaaaggcatgctgggctgggtttgtacccttatcaaacagggctttctttttgcctctgttcaccagcagactcagtctgtgtgcagaggcatccggcagacgcagcacgatgcctctgggatgtacccagagaaaggaaagggctttgagaaattgagtgctgtgaaacaatgttaatttgccttgggtatccaaggaggcccaggaaaggctgaattcctctaagctctagaaggattccagttgcctgcctgaaggaagcgctgttgtcatccctgtccgtcttgggcagcctggccctgatcactggtctctgtctccaggtccggacactgtttgtcagcggcctccctgtggacattaaacccagagaactctacttgctcttccggccgttcaaggtgagtcaggacccagccgccccctgggtagagcctgggaccctggagaagcagcgggagtgaatctcgggtcgggcagggcagcaggatgatgcgggaaggcgtggcagaagctgtgggggcaggtccagcccgtgtcctggttctgcgaattcacatgctgccttctgagcctctgtttcctcgccagttaaatggagacagtaagaatctttttttttttttcctcgagacgagtcttgctctgccgcccaggctagagtgcagtggcttgatctcggctcactgcaaccgctgcctcctgggttcaagcaattctcctgcctcagcctcccaagtagctaggattacaggcatgcgccattatgcccggctaatatttgtgttttcagtagagatggggtttcaccatgttggtcaggctggtcttgaactcctgacctcgtgatccgcccgccccggcctcccaaagtgctgggattacaggtgtgagccacggcgcttgtcctttttgtttgttttgttttgagacagagtctcactcagttgcccaggctggagtgcagtggcgtgcggctcactgcaacctccgcctcctgggttcaggcgattctcctgcctctgcctcccgagtagctgggactacaggcaccctccaccatgcctggctagtttttgtatttttagtagagatggggtttcaccatattggccatgatggtctggatctcttgaccttgtgatctgcccgcctcggcctcccaaagtgctgggattacagacgtgagccatgatgcccagctaacagtaagaatctttaaatatatgtggttatataaagaatctttgagattcagtgtagccttttcagtttgcagatgagaaaacttaaaaggtaaggtctgtgctctcgggttactagttagtggagcaaatgggaatttctgcctgaagtgatgagtgctgccgcgtgatgcccaccctatgtgctagaccgcgtgattcagaacgcagggcggtggacgtttggcagtggcggaggtcagggtgggttgatgttgacagggagaagggtgtgagaatgactcaggggaacgcgggggctgatgaggtggcagcgctgggctagcacaacatacgcttctgaccttccacggtaacagccacctctctccgcaggggtatgaagggtccctgatcaagctcactgcaagacaggtaatttctctcctagggttttcttcctcccagcccagaccggctgctgagcttcaaacaagggcccgttaacccttccctaatctagaggcatctggcggtacagacttgcgctccctgttgtcctgtttctgacagagcagcctctgtaggtcccactgtctcttcactggccatctgagcccagccagctcctggtcctccctgtctgtttcttaggaatctgggagccccgctggctgaggacagtaaagcagttagctgagctctagctttttttttttttgagatggagttttgctcttgttgcccaggctggagtgcaatggcacgattgagctctagcttttaatacaaggaggccagggcccgctagcctttgggggctatttggggtctagactgatccttgggaaaatgaagttggagcagttttcaacctattgctccttgatagaaccggagtcttcccatgcccttgatacattggtgtcccctttcttgctggggaaaacactgggacttacttttagttatctgcatgcattaaaaacaatacttttactaaaagggcgacgtttaattcagtggaattaag

SEQ ID NO: 80043 - DNA, 1001 bp, Homo sapiens
catcatgttggccaggctggtctcaagctcctgaccgcaagtgatccaccctccttggcctcccaaagtgctgggattacaggtgtgagccaccatgcccggccctctctgccatttatggtatcgttctgccatgctggatcgtatctggtctctggctgtgagtttcttctctgcagggactgaggtgtgtagagatgggggaggtctccagtgcttagacctgactctagggacattgggagatggaaatgttttgaggcttggttcctgtctctagggctttctgtagtcaaggtgaggggtacctcagactgctgggaactataaggcgaggggtcctaacggccactgtggggcttcagaggaaggaaagggtagttgaggactccggaaagacctgaaggctggatacctttagttaaggagtgaggaaggggtgagccgagggggcagtgcaggcagccttgtggacgcttgtcagggccctggagtgggtgggctgggcgggcttgatggaagcaggtgttgggcggctttggaacctcttgttcctccctacatgtggctggtcagcctgcggagcccacgcttcccctgctcctggtttgccagtttcccctttttctgccctcctcactctggtgtggctgtcatcctaaacaagtgtcatactgagtggatggatggcagcacttacccacccatgacgctgatgaggctgccctgtgccgctccccctgccctcacaaacagcagagtcagggtgcctggtctcaggagccctgctcctccgtgaactcagctgtgtgccgttgacaaatcaccaaggctttctgggtctcagtctccctgtctgtacaaggggctgggctttaagatgtcatctgctggggtggctggaatctagtaggaaccaaggcgggtgtttgggaatcacacttgctgtgatttagcctcccggactgctccccacagagcatctgtgctcaggcagacgg

SEQ ID NO: 80044 - DNA, 1021 bp, Homo sapiens
gatggaggcaagaggatcgcttgagtccaggaggctgcagtgagccatgtttgcgccactgcactccagcctgagcaacagagcaagaccctgtctcaaaaaagccgaaggccagttgttcctgggtaccttgggctggccccactgggtctgagtgggttggtgtgagatcaaggtctgcaaaagagcattgactcgtgagctgggcacttgggaacaggctgtttctgacatgctcggtaactgcgagcaactcgctcgacccctaggccctggtttcctcctctaaaaataaggtttcttccagctcagatgttctgtatttgggttgctactgagggctgggagttggggaaggatgtgggaggggcttataagaggctcgtttttccctttttggatttctctcctcttctcacccccttcccaaagtagtgttttccatcgggatgacaccgggagagctcgctcgaagcagtgggtaggggactgctgaagcacgtgcattcgttacttgaacattgtgagtggacagttgaaacaattcttcctttccagattgaattctaacttttagagatgctaaagggttgctgcaaaagtctttttttttttttttttaaggatatttctattgcctgcagtgagattttcctggggtgtcttttctccaagtcccaatcctgtgagacaggaatttacagaaggccagagttggcctctaggggtgactgttcctggtgggttggtgggttgtctgtgggcagggaagagtggggagtggttccagtggtttcttgcctcagtatccttggtggagaagggtctgtttgctttcttttttttttttcgagatggagtttcactctttttgcccaagctggagtgcaatgacgtgatctcggctcagtgcaacctctgtctcctgggttcaagcgatttctccagcctcagcctcccgagtagctgggattacaggcgtgcgctaccatgcctggctgatttttgtatttttagtgga

SEQ ID NO: 80045 - DNA, 1416 bp, Homo sapiens
tcagatatcgagggacaactaaacggtacgaggtgatactaagttatagtaatttttaaaaaccacttttttgaggtatgattggcatatataaaggtgtatatttagtgtatacaacttgaagagtttggagattgttaaagtaatttttaactggggggcacccctggaagggggagagtggtatttatactattgggttgagggaggatataagtttcttaagagttaaaaaagtttttgccagcttaatggtaagctatagaaaggcaggggttaatggcagctaagggggctacagtttgacctgaggggctttgcccttccctgcccttccacctcatcccagtgtggctgggacagggctgctgcttgcaggcctggtatcctagagcccatcatgtgtcctcagaggggtgtcaggaagcagccagagccctgggaccactgggtggcttgaggtcagccctccctgagatgtgggtgaacaggtgcttagacttgtgtggatggaacggggaggggggtgtgggaggtgggggataaggcactctagatgagtgcgaggtaattcctggatccagtgtgctatttgggcacctcccttttctttaacatcaatagcatttgaaagcatctgggacatcttggtctgcaggctttttttgaatatgagggaatggaggcttctctgtttctgggcactcacctagaagccctgccaggcatatagcagtaggaggtcaggttcccctcctcactgggagttattgtggatgtgtcccctctgcctaagtaatctaagggagaggctgtactaataataatgaacctgtatgttgtatttatgccaggcattgttatatgttctgcaccattttaactcttaatctttgtaagagcattatgaagtacttacattattatcaccatttcataaatgaggaaagtgaggcacagagaggttaaataactttcatgtagctattaagtggggaggttgggatttgaacccagagtttgctcttaaccacacagtatactgctattgtgttttatattagggtttttggtgagactggaaggcagggggagaaaggtatctgcaattttcttttttttttcttttttttgagacggagtctcgccatgtcacccaggctggaatgcagtggtatgatcttggctcactgcaacctctgcctcccaggttcaagcgattatcctgcctcagcctcccaagtagctgggattacaggcgcgcaccactacggccagctaatttttatatttttagcagagacggggtttcactgtgttggtcaggctggtctcgaactcttgacctcctgatcctcctgcctcggcctcccaaagtgctgggattacaggcgtgagccaccgcgcccagccggg

SEQ ID NO: 80046 - DNA, 2251 bp, Homo sapiens
gaagggaagaatatacaactgtgacatctgtccactaatgacttaagtgtggtggatttgtttgggctccagaggccttgccctccttgtaccttgatgccaaaaggcccttggctttggggatcttgcccccatcctgactctacctggctgttagaatctcccttgacagttggggagggtgacagggttgctagcgtacttggagtctctgcttggccccctgctgtgggctgaaactgggggagagcatgtctcctataaagctgaatggggacccagaaccccacttctgctaaagggtctacttcagtggggacttcacactgcccaagaggctggtactgggcaaaccctcagacccactgctgttgggtgagaagggtgacccatgtggccattctaagtcttgaaaaaagcatttgaggttttagccactcctttctaagtaccttttctgggaaagagggcaggattctcaaaaagtggaatccctactattcctccttgggagttgagatggcctgcggccctatggtggttccaaatccgcgcacttggaaaagggcatggtgggctcgcgtttagcagaggtccagaacaaagggttctgagggtctcctggagcccagtgtctgtctggtctggtaagggaaagggttattccccaagccctggcctagtcttctgaatagtgggccatgagcccctgtgctggtggctccatcttggattggtggtgtaggctggaactggaatcctccctgtagtttagatgctccctaagcagtcagttctgcagcccctaagagcaaccatctggagaatcagcgttagcagtggtttactcccatggctgacacaggtggcttcttcccagtcaactcttggagactagcgagagcaagcccaggaaaccaaggaatgctgctgcacgccgtaagacctcaattcctaaaggcgctgggtcactggcgaagggagtgtatttttcatggttctgggagttatcagtgaggttgcttgtcctgaactgctttggatagccttgactctgcctgcttgactaccttacctataggctttatccatgtcatacgcattaagttttctttctggacccaggggttaaggatacaagtgaaaattctcagcctaggaggtcggaaggacttgccaggaagtggtggtaggtgaaatgcaatgatagataaaataaaggcatatgagcacatggtaccatggtgctcctgagagattagaggtcagccttccctgagatgtgggtgagtaggaggagcaaggttagacctgtgggggtggaaaaggcattccaagaggagggagtcgcatgtataagtgaggaggtaggtttgtgtaaccacatggcttgtttgggtaactacctggagtttgctatattgcagcaatatcaggcagtgcagccataatgagagtttggaattagggcagtaatgactgtggtattacgggaaaattggcatttttctgccacttgggaagatgtgttcgaagctttgataccctttgaaagctaaggagggcagtaaggaattaaggggaggagctgaatgtccctcccaatctagaggttgtgctgtcctgcaggtaagtcttgactggagctggggacgacatgaggtaatacagtacatgaacctgtccggggcaggctgtatcagtgctgccaaacttcagacctaaatgtcctgtcttagtgattctcaagggataactgggtaattaccatgtctctgaagaggggtaaatgtgatttctattttgaaagtggagaccttgctttcataatacagttgctgttggccttccatttctatgggttccctatccatgaatccagttgtagataaaaaatacaataataaaaaataatacaaataaatataacaactatttacatagcattcacattgtattaggtattgtgaataatctagagatgagttaaagtatccagaaaatgtgcataggttatttttttatttgtttgaaggggagtttcactcttgtcacccaggctggagtgcagtggcacaatctcagctcactgcaacctctgcctcccaggttcaagcaattctcctgcctcagcctcctgagtagctgggattacaggtgcccgccaccatacctggctaatttttgttttttagtagagacaggatttcaccatgttggccaggctggtcttgaactcctgtcctcaggt

SEQ ID NO: 80047 - DNA, 1821 bp, Homo sapiens
gggaaaggcccggccggaggccggcgccccgcggccggggccggggcgagcccacggtgggcggtggggattggctgcgcgttcccccggagaccgcgcggcgggcgggggagggggctggccgggccccagctgaggccggttccggccccgccccccgccgccggcgcccgccccctcccccggcgcccgccccccgccgccgctgccgccgccgccgccgccgcggcgcactcgccggtcgcagtgaaaaggcggaggcggcggcccctccggctcccactgcctcccccgccgcaccccctccccaccttccgcacccgccaaacttgatgtgaccctggcccgacgcggaggctgcccctctcactgccccgtgggtcccccgccacccgctccgcacccgcgagcgcaccgctccccgcgccccttcccacttcccgcggggccggcgccgcgctcgccctcgcgttccttcccgccgccccctcccccgcaccatgagcaacctgaagccggacggcgagcacggcggcagcaccggcaccggctccggcgcgggctccggcggcgccctggaggaggaggtgggtctgtggccccgggacttgccgggtgaagcgcacgccaggcgggcgcgggagagggcgagcggggcctgccgcgcctcgcggggccggggtggccatcgctcccggcgccttcccgccgctgccctctcgcccgggtaggagcggcccgtgtccgcgggcgggagcgtgcggcctggactgccccgccggacaggcattgtctccccgccctctcgggctcgaggcgggccgcgcgcgccggccgccgtccgggcgtcccgcggtgggcgagatgcgccgcgtccgttccatgcctgccgcccgcgcgccccttgctccccaccccgtagccgctcgccgccctcctccgaggcgcacctcctgcgtggccaggaccccgcctcggcggcacggagcggagcgggattagcacggcccgagggcggcaccctcactccactgccttttccgccctgaccccctccccgtgaccttggaggcctgggccggccggctcctcggttcctgcgagctgttgtcatgggggtgggcgggctttcttcacagccccagaacctgggctttggcagaggtgagcccacaatttaattagtttggaagatgactaaagacactcagttcgtccttctcctctctctgggtttgtcctggcaaccaagccaggaccccaaagctggcctgggtgggatcctgccaggaggggcgaaatcatctcgtccaccggccatgtgcgaaagggagggagtgtaaggcggctccgtggaaccaccagcagctgggtggttaatggatggtagggaggatgtgtgtgcggggtggggtgctggataaaagcctcaaagatatcagtgaatagggacgaggagctaggctggcggagacaagaactggagtagaaggggacaggcttcgcagggcctctggcctctgctgcgtcattctaggggtgagagagccttcctgcccctgccctggcatgttctcgcccaggaaaccaagggctggttatccaccttgggcgcccttccccttggcctgggggagaaaccgcagagcccctggtgtggactggtgttgcctcctccccttgtgctgggggttggtgcagaatggcgccggtggccctcggctgggctgggctcagcgccgccagctcccactcggctattcagagaccttcagccagccccagtcgatgacaatctaggtttggatctccactttttgg

SEQ ID NO: 80048 - DNA, 1095 bp, Homo sapiens
tcgcgcagacctcagctccgggggaccgagttctgggggtgatggccggggggagggggttgggagacacctgagctttggcccgggctgggcgctgttttgctgagtgaccttgaggaaatcacttcccctctctggcctcaggctcccagcccagagggtgggacttaggatctcaaactcccttcccactcccagtcactatctgaataggacttaggtggggattcgagtgttgggaccccaatggtcattagcgagggctgcctcgaatgaccaagaaggttctgttgcccaccttgccctcaacacgcctggctttcgggtcttctcgctcctcccccgacctcagtgcccctcacacctttccctgcctcctattctgagcccgaaggctggggacggatgtaatagcctagaggctgggggaggtgggggaggtcgtcgtgactccccccgcacccccgcgcaggtcagtagggcgcggcctctgggtcggttttctcttctatttgaaaacccagccgatgggggcccgccctgctgccacagtagaaacccgcacccacctcggggagcgctggaagcgctgcagcctgaatccggcagagccgcgggagaactgggtccctcctcagtgccccttctcctggacggggcggaggttgcggtgacccgagatcttgccattgcactccagccagggcaacaagagcgaaactccgtctcaaaaaaagaaaagaaaaaagaaaagctggatttgcagtcacggactggttaggatcccagaccgtggacaagtgcctgagcccccagaacctctgtgtgtcgacctcctgaattaggtaggactagcaccacaggatcactgtgctgtggcttagtcttcccagtaaattataatctccatcctgacctgccatctcacagataaattgaggcctagagatgggcaatgtctttccaatgatatactcattcctttagtaaataattattgagcacctactgtgggctggggaccattttctgctggtggcaaggccaagagcaccctggtttcccatcagccctgttgccaacacttggctcagg

SEQ ID NO: 80049 - DNA, 1153 bp, Homo sapiens
caggctagagtgcaatggtgcgatctcggctcactgcaacctctgcctcccaggttcaagtgattctcccgcctcagccttcccagtagctgggactacaggcacccatcatcatgcctggttaatttttgtatttttgtagagacagggtttcaccatgttggccaggctggtctcaaactcctgaccgcaggtgatccgcccaccatggcctcccaaagtactgggatgacaggcatgagccaccaagcccaggcaactggttaatttcagccccaaatccctgagctctccctttctctccttgccttcctctgggccacattgtgaacctggatcccaggttccaatctaagacaaacagtatttccaaagtagctgtgccagaagacctggatctgcgtccaggtcaccacggcaacccgtgtgaccataggcagatagtttaatctctctaaggctttgttttctcaaggtaaaactagagaactagcgacacctttcaggcaggctttcatgagtgttccctaggcttctgtaagaattaaatgagatcctgatgctgaaacttctttgacgtcctcaaagccccaagacaaccggaggggcgattgtaaagtcagcaaaggaacaacacaagaacttcacttcagatccagccttcctgagaggtggtgtctcctccctgcacaccatctcccaaagatgttatttctcctgtccccaccacatagctgaaaattagcaggggaccatctgaggacagggatagcgtctcttcacctttgaatcaaatcttggaagctcagttcaggtcctggcagaggggtttcagtaatgaatattgaatgattgaaaggctagggttaccaaggaaatatctctgacagcgtttttttttgttttgctttgttttgttttgttttgttttgttttgagatggagtcttgctttgttgcccaggctggagtgcagtggtgcgagctcggcccactgcaacctccttctcctgggttcaagcaattctcttgtctcagcctccagagtagctggtattacaggcactcgccaccatgcccggctaatttttgtatttttagtagagacggggtttcaccatgctggtcaggttggtctcaaactcctgaccttg

SEQ ID NO: 80050 - DNA, 1042 bp, Homo sapiens
aggctggagtgcagtgatctcggctcactgcaagctccgcctcccaggttcacaccattctcctgcctcagcctcccgagtagctgggctacaggcggccgccaccacgcctggctaattttttgtatttttagtagagatggggttttgccatgttggccaggctggtctcgaactcaggtcatctgcccgcctcggcctcccaaagtgccgagattataggcgtgagccaccacacccagcccagaataaacttttctttagtgaatttccaagtccacctcctctccctttcctggatacattcacttcccctctgccatctcctgccccaccattttctaagccaccactagatacgtaaaattgtataaattgtatacaaccactgtatcaagtataaagtatagatataatgaataatcctattttgcacagaaagaaaccagggctcatgtgtcccatgtcacacagttagtgagtggcagcctggattcagctccacgcctgtctgacccagagcctgagtgctttcctttcactccatccctcaactcttacctggatctgtctcccggtccccctcctactcagacagccacctgctgtcatgctctccctctgtctagagactctctggactggacgaggagatccaggggcagtagcagggctggtaaagggtcaggcctttcggggcaagggacttaaggctgagctgactccatctctgtccctgcatcccccagggcatgaccctggattgtgtggagatttctctgggccgtgtgtttgccagtggccaggcctatgtggccctttctcgggcccgcagcctgcagggcctacgtgtgctggactttgaccccatggcggttcgctgtgacccccgtgtgctgcacttctatgccaccctgcggcggggcaggagcctcagtctggtaagagggagtcatccagtggtgggctgtggccacgggcagggtgggagctaggacagagggagcgccggcccagtgggacctggggtgggggcagaaaa

SEQ ID NO: 80051 - DNA, 1035 bp, Homo sapiens
actggacaatggtactgtgagtgtaaacaggggtgtgagagtccaaaggcagatcttccccaaggctaagcccagcctctgtgtgcgggctagaggggagagggagtgtgctggaaggatggttctgaaaataaatcttcggagtcgcgtagggttttcagacccgacaccacgcgccgccgggtggctgccgcagcggcggcctcctcccaccacgcccagccgtccactggatttggtatgctcagccaccaccataaacctccttcctctagcaggcaattggtacagcccaagctcctggagtagagacgcaaagaaagacacgcccattgttacgcccctacctctgagtggctggagaatttaaagatccagtcggtgattgggtgattttctgcctctagcatttgaaaaatttctagtttcggagcttagccacaggccggctacgatctgcttgttcatctgagtgtcggcacaagtgagtgtctgcccgaacccagaggtggggagcaaagagcctgatttatctaggggtttccggcgggagggtgcaaacaaatgggtcagcctgagggagcacggcttctagggtcccagggtcccccgcgatttccctagccgaatattttccacctcgtccccaccttggtggtgggaagcgcgagggcatgggaatcacactgactttgactactagccgctgtggcttatgaagggcaagtgagtttccctctcttagcctgtttccacgtctgtacacggggaagagtgagacctgcccgctgcatataagccagtgaatgtacctacaaggcagaagtcgcttattacacggcagccctctttgcatctccccacgggcgattctcctgcttcctggggagagtactctgaggattcatgtgctcgccctgggtctcggggaaggaggattctttctgcgcagggacccctgttctagtgaggtccttgcaggacacctgaggctccctaatcctcggtgcccatccgccgctctggaaattgttg

SEQ ID NO: 80052 - DNA, 1003 bp, Homo sapiens
accgccccctccccggccccgccccggcccccggaagcctcaccccgcccccggccccgcccccccgaagtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggaggtgagggcggggcccggcggggcgttgggctggggtcctcgagcccctcacggggattgcggtcctgggctcaggccctcgttcctgcccgccccactcccgccagtctcacctcaggaagagcctgggcaaatggggcaggggcgaggggctggatccatatcggggacttcgcagaccgcgtcctccttcattctcgctgactttctcaccagttgtggggcgtcgtggttgttaccgttcccattggattgaccaggagactgagactccagcgagattgatgacttgctgaaagtggcctgggtgactgggctcgaaccccgattaccgtggtcggatcctgactctctctctctctctgtgtgtgtgtgtgtgtgtgtgtgtgtgtgtgtcggatcctgactgtgtgtgtgtgtgtatgtgtgtgttggggggttcctgtctcaaggatcggatcctgactctgtgtgtgtgtgtatgtgtgtgttggggggttcctgtctcaaggatgtgaccatgctttggtggcaggaggattggagaagttgcttttttctcccttgtataagtctctgtatcttttcccccactctctccccgctccacatccatctgagcagctagctgtagggaaggaatcgggagtccggcccacctagggtctgatcttagtccctgccttccccacccgagggctggaccaactgtgtccctggagcctccttctaaccactcaaaacactcttggcctgggattgggtcttgcccctgcccctgccctttactt

SEQ ID NO: 80053 - DNA, 1041 bp, Homo sapiens
tggcactttgggaggccgaggcagatggatcacttgaggccaggagttcaaaaccagcctggccaacatggtgaaaccctgtctctactaaaaatacaaaaattagctgggcatggtggcgggcacctgtaatcccagctactcgggaggctgaggcaggagaattgggtgaacccgggaggcggaggttggagtgaaccaagatagtgccactgcactccagcctgggcaacaagagtgacactccagctcaaaaaataaataaaataatgattctgcatttcaacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactgagtcgcttttgtgattattgttgctgcccaactgggct

SEQ ID NO: 80054 - DNA, 1001 bp, Homo sapiens
tatcgttattatttcagttgcagtatccagtttattgggaccatctcgagttctgtgatggattcagaaaacttttagaccatttacaattggataaagtgagtaccctgaaactaattacatacatacaattttttttttattttttgagatgaagtctcactctgtcacccaggctggagtgcagtggcgcgatctcggctcaccgcaacctccacctcccggattcaagtgattctcctgcctcagtctccaaaatagctgggattacaggcgtgtgccaccatgcccggctagtttttgtatttttagtaaagatggggtttcgccaggttggccaggctgctctcaaactcctgacctcaagtgatccgcccgcctcagcctccctaagtgctgggattacaggcgtgagccaccgtgccgagccctcttttattttttaataatagctttattgcaacataattcatataccatataatttacccttttaagtatacagttccatgtttttcagtatactcccaggtatgtgcaaccatcactgcagtcaatgttttataatttttttaatgccaaaaacctcatattcattagcagtcggtcctcatcttcccccctactagccctgcaacctaatttatttttatctctatggatttgcctattctagatattttacataagtggaatcgtatcatatgtggtctttttgactggctttttttatttagcattgtgagtttaaggttcattcatgttgaagccggaatcaatacttcgtttctctttacagttaaatcatatttttataaatatgccatatcttgtttaacgattcatcagctgatgcacatttgggttgtttttaccctttggatatcatgaataatgctgccatgaacattcatgtacaagtttttgtgttgacatatgttttcagttctcttaggtatgtgtttaggggtggaattactgaatcacagttttcttagaca

SEQ ID NO: 80055 - DNA, 1035 bp, Homo sapiens
cacatctggtcctagcattgccatgtgatcttgggtaagtcatttaaattttctagaccagattccttttctggaagaactaagggtgttggaataatttctgtaagagctcttctggtggccgggcatggtggctcacgcctgtaatcccaacactttaggaggctgaggtgggtggatcacctgaggtcaggagttcgagaccagcctggccaacatggtgaacccccatccctactaaaaatacaaaaattagttgggcgtggtggcgggcacctgtaatcccagatactcgggaggctgaggcaggagaatcacttgaactgcaggaggtagaggatgcagtgagctgagatcacgccactgcactccagcctgggcaacaagactgagactgtctcaaaaaaaaaaaaaaaagagtgcttctgattctgtgattgtagtatttcaccaaattgttttctgtagttggactatatactgacaaaatagccagtttccttggctttcttctttaaaatattgttggtatagctagatgagactctacatttagttctgatgtaaacatgaattcttgacgtgaaatatcacatgcttttatttcaggattaacctccatttcagctaatcatgggagagattaaagtctctcctgattataactggtttagaggtacagttccccttaaaaaggtatgtatggttttactatacctcttatttgcaaaatcttgtattgtttttgtgtgtgatttagatgtcatgtcttagtagtgtttgagagtaaaggttactgccgagtatcatgactgtgggttgcagaggattaagttcactccttccctgtcatgtacagtcaacttttgagactcattttagagtgaaagcaagtgtaactgtactcatttttatttatttatttatttatatttatttttgagatggagtctcgctctgccgtccaggctggagtgcagtgcactgcatgatctcggctcactgcaacctctgcttcccaggttcaagagattc

SEQ ID NO: 80056 - DNA, 1048 bp, Homo sapiens
acggagagcgtctacggttgtgccaaaggaaaaaaaatgttcctaagaaaagagtatacaaagttgtgttcatcaaagtctggaacccaaaggtgtccctccaaagctgtacacgacagagaaaacgcgaactgaaagaagaagcaggtcccaaggggccaggcgcctcctccacctcctcctcctcctaggtacgtagggcagaactaaggctgacccagacgtaactcagccctctcctcacgccagccgcagccaagcatcccacggagcctccccccgcgcccgtcgccgtggcgaccgccggggccacgcagcaccgccccttcctcgcgacgtggccccgccctctgagaacccggaagcgggagtctcgcgccagctgagcggcggtcgggcggggggagcgcggcggcccaagctcgctcggccacgcgccccgccccctcagaggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggtgagggtgggcgaagccctgggaagcggctgggtgtgcggtatgcggggttgtaggtgtgtgtgtgtggcgcgtggctgccttggttggtgtgactttgtgagtgtgttctgagtgggccggtccatgtgaccacgcacgtgatcacgtgcccttgtgagtgtgtgtctggggccgaatctgggctgtggggtggtcggtgtgcttgtgaccctgcctttgtgtggctgtcaccggtgggactggcggggagctgtgtgtgagtctccagcgggaggtgggggcggcacagggcttaaccggggcatcctcctgtaaacccatcctggggctacacgactgcagcccaggaacatttctttctttctttctttctttttttttttctcagcaaacttttaagaactgtgagcagaggccagtaattttgga

SEQ ID NO: 80057 - DNA, 1064 bp, Homo sapiens
ccacaagtccattctgaggcccatcagcatcctgccaatacggtggacagaaggaatgtgagccacagaggaagctggtttaatttagaggtagttggagttccccaggaacctaggaattaggatttgtttgggcagggatgaaagggccagcctaaatcctaaacatcctatgtatttccccctgttggctagttatttcaccaaagcgctaacacaaaacttgtagattcagcattttaggtggtcactgggtaaaggaattatagctttgtatgtgcatgggaagctttcctttgggtttctgatgtacagagagcactgtggtttccttgtaagttttggtttacaaagtcaacatcagcaaatgtgttctctccggtatcagtactgcctcccaagatgttttttgatttttaagaagtactatgaagttgcataattgcttttttctcttgtatatcttttcttttttccattcttcagatccaaaattaacgggacaggctcttattccaggatcagtaatataccacaaacagtcacaaatactattggtttattgcaaggtatgtttttcattagtttcaagttatcatagttgttttactatgttatagtctgtatcatttattatttttagttggaacttcacttaactgcctgtccatagattgggtcaggagatcatttaattttcttaagaaatagtgaagtctctagcataattttttgaaagtgatgaagttttgccaaggcattattattactcaaagaaagaagattcagtaacttgagtgctttcttaaaagaacacgtgtattttcagtagcccaatttaattaacagctcttgtgcttggtaacataaaagatagtcatatcaaaatatctgactgaactactacaggacacacatatcctacttgcttttactgcttaacagtagtaaagaggagatttctgaactttttaaaataactttggaatcattattgttttataagatcatggtgtgttctgagaagtgttctacattccttccatttcctaggtattttgcat

SEQ ID NO: 80058 - DNA, 1050 bp, Homo sapiens
ctaaataacttttccacaatgagacagctggtaggtggtagaactaggacttgaacccagagctgggtgactccatagtacattgtcctgtgaggtttcactgccttggcccccatggggtgagagtgtgtatagccaagcccgggctatcctgatgccaaagcttccacagcattctctagaagtgaatcaatgacctgtactctacagaaagcagaatctctactgaggtttccccaagtagacacctatcctcacagcttaagccaatgtactaccttaccctgccacatagatcttttaaagttataggttcagccttgaagagccaatagtaaagattttttttttaatttgaaaaaagaaaaagaaaaaaagttataggttatttcatggtgctgaattgtaatgtgtttctgcttttgttcttcccttcattttgaatatatcacactcttttttttttttttgtagctcatttcagttttgaaaaatttgcctgaaagtctgagcaatggaaggcagcagccaatggagggggcgacttacggtgagtgaaggctgcagagactctcatctttctaaaggttctgcttgtcacgatagcatctgaacattctgacttcttagctgtacttttcccttaattttgattgagtgcccacttttgtgtgcttttccaaagaatggtagaaagcattctttctccctcttagcatatagcctcatgaaggattgagcatttttttccaacttcttgattttgaaaatattaaatagaaagactggtataataaacaccagtttaccccagagtcaacaattattaatgtttgtccatattttctttctctttatgtatttattacgtgtattttaaattctgcttattcatttggaagtatgaatcatgatctttcatctctaagtagtttagtatgcctttcctaagaaaaatgaacaatttcctgatagcatccaatgttcagttcatatttaagtgttcctaattgtctaaaaatttattttatagttttatttttcaaacta

SEQ ID NO: 80059 - DNA, 1747 bp, Homo sapiens
agaagtagggaccagttaggaggcttctgtagtaatgtaggcgagagtggcagcagcggaagtgatgagatacagacagattctacacagattttgaaggcagagccaataggatttactgatggattggatatgggacgtaagaaatcaagcatgactccaggattttggtgcaagcagctagaatgatggagtagccatttattgagataaagattttaggagatgctttgggtatcttgaatgtaaagtggctatcagacatccaggaagagctgtggaggcagtaggtattaggggactagagtttggggaccgagctgagctagagggaccaatttgggcgttgtcagcatatatatggaatttaaatgaaggtggatgaaagcctatagagggtgataaggagttaaatacattttgacaactcatgccacaaataaaatgttctttagtacttgaaaagaaaatatcaggccgagtcatgtgtcagccaaatatggctgtgcccaggcgagttgagcaaaggcttcagtgagcccgggcatggctgaagacgacctggggaggcaccaaccagctgctgggagaagagcataaggctcaagatggaaaatcataaatctaatactatcaaggaaaacttaacaatctttgatatcataaccagaaaaattaaccagcttccacaagcagaaaggaatctacctgaagagggatcagcatatgttggatttaatgctctctgtggcctcatagcaaatggtctttttcaatgcgtcttgaacatgacacaggctcttacagctgctggcttaccaatggcagtgatcccttttcttacaacaaacacagcttacaaaagttttgtaaattttccttcgaatacaggtgatttgaattgtgaaacgtgtaccataacacagagtggattggtcttgcttttggtggtctataccctcttttcttgtctatacctgtgactggaggcctagcagcctggtatgaatcaactctgttaccagagaaagggaacatcttaagttactggattcaaatttataagcctgtctttagaaagatgttatttcctattgtgttccagactgtgtttgcagcattccttgggtttaaacaatataaactacttctaaaggcccttcagttacctgaacctggcagagaaattcattgactttaagcaaacatgtacagaaaaataaaatggtaaaaataaaaaaagaaaatattacagaaagcatagagttcaaattatcacattttatatacaaggtccatttataaagaccaaggtttctatactgtatttccttacaaataaaacttactagggaaatttaagaataagagcctcattcaaaagtcggccaaacgaagccactactccaacatcatattctccagatcccacatccggccactcatatacgggaagctgagactgcacagcatattgcttcactggcagtccttttggtgatggggaaggcattgtgaccacctccagtttgtcgattaactcttcttctttgttttccctaaattagataggaagaaaaatgtgacagtgttaaggcaatgactcaaagctaaaactacttcacatatcgctaagtatgtttatgattaatctcatgaagcatttagggctaaatgattaaaactagtgtgagagactgagttttcattttttctttttctttttttttttttgagctggagtctc

SEQ ID NO: 80060 - DNA, 1077 bp, Homo sapiens
tccatcgaccacagtgttagctaaaacccagggtagagtgggctgtgatggaagcccggggctcagaatctgacgctgtccaggcttagagagtctctggctgaacagggtcccccaggccaggggttagtgttgtgcccccggggtcctggtttgccctgggctttacgtcgccttctttccgcagcacgacttcagcctggagaggacggcactcttctgggtggaggccgccggccagggacccagcccgtaccagtgcggtgacccggggacagcgtcagcccctccagcctggctcttgctagtcagccccgaacatgggctggcgcctgcgcccaccacaatcagagacccggaggccggacaccaggagaggccggaggaggagggtgaggacgaggcagaagcctcctctggcagcgaggaagagccggcccccagcagcctccaaccgggctccccggcgagccccggccccggccgtcgcctgtgctcgctggacgtgctacgcggcgtgcggttggagctggcaggggcgcggcggcggctctccgaggggaagctggtctcccggccccgcgccctcctgcatggcctccgcggccaccgcgcgctgagcctgtgcccgagccctgcgcagtcccccaggtctgcatcacccccggggcccgcgccccagcaccccgccgcccccgcgtcgcccccgcggccctccacggcaggcgccatccccccgctgcggagccacaagcctacggtcgcggtaaggattctgcccgcccctccaaggccgccaatcagcagcccaggccccataatctgggtgtccagcccagcccgcagcctcggtcccctactccacgcgctcctgcatcctcccttgacctgctcccacctgggcctgtaccgtgttgtcctcctgcggccctttgactagagtagagtagtccctgctcagaagcccccattccccgcgtttcccactgtgcctgccttgcttttttttagggagcaggtcacagtggttttaattatccaggacctgtctcttctaaacgaggttgagctctttta

SEQ ID NO: 80061 - DNA, 1050 bp, Homo sapiens
ggcctcaactgatcctcctgcctgggcctctcaaagtgctgggattataggcatgagccaacgtgcctggcccgttagcccttttgtaacttaagaaatgttttgactattacaaggccatgaatatagtctttcatttttatctttgagttttattattttaccttttacatttaaatctacagtccacctggaattgatttttaggtatgacatgaggtagaggtcaatattgtttttgtttttttttttccccagatggatatcaaattaatccagaacaatttatttaaaagactttccctttccagctactctacagagccaattttgtcataagtcaaagattcatgtgtggatatgtttctggactttcttttttgtcctgttggtctctttgtaagtctttaagtcactctcttcattctcataacttgaaggtcttgctatctgatagtgaaagtcttccactgtgttgcttctccaagagtctcttggcttttcctggtcctttgcatttcatttaattttagaattagcttgccaatttctaccaaaaaaaaaagtgatggaattttgatacatgggatgaataaattaattggaggagaactgctatctttacaagattcagttttacaatccttgaacgtggtatgttcctccatttaaccaaatgttttatagttttccgtgtagcggtctcatacatcttgtgttagatttagtcctagagaactatactaatataaatggtaactttttaaattttcctttttttttttttttttttttgagacagcgtttccttcttgttgcccaggctggagtgcaattgtgtgatcttggctcactgcaacctctgcctcccagattcaagcgattctcctgcctcagtctcccaagtagctgggatttcaggcacccaccaccatgcccagctaatttttgtatttttagtagagacggggtttcaccatgttggccagactggtctccaactcctgacctcaagataatcctcccacctcgacttccccaagtgctggg

SEQ ID NO: 80062 - DNA, 1050 bp, Homo sapiens
gtggctcatgcctgtaatcccagcacttagggaggccaaggcagggggattgcttgaccaggagtttaagaccagcttgagaaacacagggataccctgtctctacaaaaataaaaaaaaaattggctagatgtggtggcacgtgcctgtggtcccagctacttgggaggctgaggtgggaggatctcgggcccaggaggtcgaggctgcagtgagtcgtggtcatgctgccgcactccagcctgcacaacagagtgagaccctatctgaaaataaaaaataaaaaataaaaaaaagccaggcatggtggtgcacacttgtacttgtagctacttgggaagccaaggtgggaggatgggttgagcccaggagtttgaagttgcagtgagctatgatcacaccactgtactccagcctgggtgttagagcgaggccttgtctcaaaaaaaaaaataaataaaatgccattttgtcctgtctgcccaggggtctgtcctccagcctcagcagatgagacttttacgcatcatcttcagcgactgagaaaactcattaaaaagcgctctgaactgtatgaagctgaagagagagccctcagagttatgctagaaggagaacaagaggaagagaggaaaagagaattagaaaagaaacaaagaaaagaaaaagagaaaattttacttcagaaacgtgaaattgagtccaagttgtttggggatccaggtatgttgctctataaccagtggagaaaatgaaaatactagattgacgctcttctcatcacgggtgatctcaagctaagaggtggtaggcaacaaatgacaccttccagatgcaattctgtgtcatagaactcatggatacagatagaacacattttctcattctgtcgtaatcataggctcagtcaccttgccttgagaaatacactgtggatatcaagcatgataacgtggtattgtgcttttctctttcagatgagttcccacttgctcacctcttggagcctttccgacagtattatctccaagccgagcactccctgccagc

SEQ ID NO: 80063 - DNA, 1245 bp, Homo sapiens
taggaatagctagggacacatgccattatgcccagcttccatggtgaggatattggtgacagagtcttatgaggagtggcttgaggaactggggttatttagtctatatgtgaactaagtcaagagtaggacagcaatctttggtatttgaaaggctgtcatgtggaagagatccttgggactttagagcagtggaacacaaacataggttgtcactaagagacctttgtagaggtctcagcctttccagccacattccttatccttcctgggaatctgaatcttcaggtctagggaatctgcatttttaacaagtctcagcttaacaaggtaagttggacacctgatctctgcactacactttgagaaacactgaggaagaaacaaaaccagtgctatgtggaagatacagagaggagaggttctcctttaagatgaaggttgtaccatcagtggagggggataacctcttagctagaggggagttgtgcaaggcctaagaaattgggatggagattcaatagagtctctcttaacctggagactgtctgatcctttaaaatctaaccactgggcagctattctctgctgtaagtttgttcctaatacgaggtctcatgggctttgtttctcttccaggagcaggaactcaaagcagccgctgatggcgtactatctgaagtgaggaaaaaacaagcagataccaaaagaatggtggacattctacgggctttggagaaattgaggaaactgaggaaagaggctgcagcgaggaaaggtaactgtggctttgcatttctttccttgttcccttccccttctttactctagctcctcccaccccaaatattattgagggaaaaatacttgaaacttcatgattttcaccttgtcgggtaactgggcttgtcagcaagtaggtcagaacttctgaagcaggaagcctcagaagatgtttagcctgtggtagcccagattgaaaagagaggcaagtgtgggaacccactgcactgtcttccccttgacttatcattcctaccctgggcatttctggccacactcttctgagtgggcttgtcatggctagtcacctttgccttgtgccagagtgaaagcttttcacccttacttgttgctccagaaagtgttgaaaacttggcatgcttcttcagatacatttcaaacctgaattatttctatttgaagaggtatgaatggttggacagggcagggattgcagactgt

SEQ ID NO: 80064 - DNA, 1967 bp, Homo sapiens
tttgcaactcttggttgtatagtctgtttcccatattactaagcaatcttttttttttttttttttttttgagactcagtcttgctctgtcgcccagactggagtgcagtggtatgatttcggcttactgcaacctccacttcctgggttcaagcgattcccttgcctcagcctcctgagtagctgggactacaggtgtgtgccaccacacccggctaatttttgtatttttagtagagatggggtttcaacatgttggccaggcaggtctcgaactcctgacctcaagtgatcagccctcctcggccttccaaaatgctgggattacagatgtgagccactgtgtccggcctaagccgtcttaatattaaaagtgctcctaatattttctattatcgtggctttcttagctaggagaggttactttgctgttttgattttaaagatcatgtttacctccattttttattttaaaaaaacaaacatggcttttcattgtagggctccaacaaaagaatcctctgaagaggagtatgactctggagttgaagaagaaggatggccccgccaagcagatgctgcaaacagctaaactgtcatattgctgtcttgtatatacagcttttccttcttttgtttaggatcataattgtctctacagtctgatattaaaggcattggatctatcttggatatcatacatggtcagagaagcctttaggagaagaatcagatcatgtatataattgtaacatcacattgattttacggaagatgttatatggactttaatgacacaatgtttagagataaaatgtacattattttggttcagttttttaaaaaaaatatgctttaacaaaattcttaggaattcttttaagcaatgcaggtattgcgataactgtagattttacaataatgttactctacaaatgggaaaataaattctttaaaattgaatattgagataccattctttagtgttaccttttttacccacatgtgtttctgaaaatattggaattttattcatcttaaaaattggaccaggtaggccgggcgtggtggctcacgcctgtaatcccagcactttgggaggccaaggcgggtggatcacgaggtcaggagttcaagaccagcctggccaagatggtgaaaccccatctctactaaaaatatgaaaaattagctgggtgccgtggcaggtgcctgtaatcccagctactcgggaggctgaggcaggagaatcgcttgaactcggagggcagagtttacagtgagctgaggttgtgccactgcactccagcctgggcgacaaagtgagactccgtctcagggcgaaaacaaaaaattggaccaggtagttttcaagtagttaaacatttcattgaaaaataccctgaagaactatattttgataattggtttagctgtattcctagtcttatctgctaatgcatgacactaacttcccaattggttctgtaaaaaaggccattttcttaccaagttgtctgatttatttaccatcttttttttttttttttttttaattgagcggagtctcacgctgtcccaagctgaagtgcagtggtgcgatcttggctcactgcaacctccgcctcccaggttcaagcaattttcctgcctcagccttccaagtagctgggattataggcacgcaccaccacacctggctaatttttgtatttttagtagagacagggtttcaccctgttggccaggctagtctgtaactcctgaccttgtgatctgctggcctcagcctcccaaagtgctgggattgcaggcgtaagccaccacacccggccttatttaccatctttaatccattttagtactatgggtgagtacatggaattgaagtctggcttaaatcttcagaaagttatatatctattttattttatttttttgagacagagtctcgctgtgtcacccag

SEQ ID NO: 80065 - DNA, 1037 bp, Homo sapiens
agaccagcctgggcaacatacaccctcatctctcaaaacaaacaaacaaacaaacaaacaaaaaaaaagaggctgggcatggtggctcatgcccataatcctagcactttgggaggctgaggcaggcggattgcctgagctcaggagttcaagaccagcctggacaacatggcgaaaccccatctctactaaaaatacaaaaaattggccagatttggtggcttacgcctgtaatcacagctataatcccaaatatatatatatatatgtttatatatataatcccatatatatgtttatatatatatatatatttgttttgtttgtttctttttccttgagtgaatggattccaatttgtgatttatagaataaaagcacttgtatgtaatctgttttcaatgtgattcattactttttatttctttaggaaaagctgttactagaaccaatgtttgaagtccctaattctgatatcgtatgtgtggaggttgacaaagaagtagtagaaggaaaaaaggaaccaggatacatccggtaaagtgtattttcaagccagaacagatacaaaatttaagatgagctcctcattgctatgtttattggtttgtcattttaaaattacataaaaattattatatttctaagggaagcaataatctcaagttttctgtagaaaaatctaatttgggtattataaaataatagtattttgtgagtctttgaaagttgatcatcaggccgggtgtggtggctcacacctgtaatcccagcacttcaggaggccgaggtgggcggatcacgaggtcaagagatagagaccatcctggccaacatggtgaaactctgtctctactaaaaatacaaaaattagctgggcgtggtggtgtgcgtctgtagtcccagctactcgggaggctgaggcaggagaatcacttgaacctaggaggcggaggttgcaatgagccaagatcgcaccactgcactccagcctgggcgacaaagtgagactcagtctcaaaaaatatataaaaaaa

SEQ ID NO: 80066 - DNA, 1045 bp, Homo sapiens
ttatttccaaaggacacatacagaaagaaacacctttatttatttagaatctttcagaggcccagacctgctggcctgtttttgaaaggactttgcctccgttggtgtcattttttttctctcagtttatactactgtgaaaatgatagctttttttcaacctcctttatgctcaaggaatttttgtttccaggggatttattgaggcatgtctatatttgatgtagatttccttttattttcaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataaggtaattattttatcttattggcatctgtacacattgtgagttccctcctttaaaaaaatataacagtactgtctcttactggcttatatgttttctgtaggaaatatgagatagctaaaatgatctgaataattttatgtaattagatgtttcattttgaaccttaaaatacttttataagcattgcacatagtaagcagtaattaaaatttcttacaccccaaagtagtaaagaagtgtcattaaatgacagtcagtaggattgaattaggaatagccatcatttcctgctttcatataactcttataacccatggcagtataaacctcactttatcctctacctaaaaatttcagatttgtggtataacttaatgttgggctactctggtagcctaaaaatttcatatttctggtataactttatgttgtagctagtataacttatgttggtagttgtattgagtcagtgacttaacagtttttttcattacgtgaatttgactaacacttgagttaattttatatgttagacaaaatgtgagacacttacatatccatacttaacagtgactctgatgtgagtaaaattattcccattttagagatgagaaaagttagatctaagaatagtcagag

SEQ ID NO: 80067 - DNA, 1045 bp, Homo sapiens
tgcgaaaagataatctttctgggcctggtgtgggggctacctcaactatgtgccttatggtaacttgttctgtacctcctatgcctcatgtccagccaggttgagcctaggggccagttgggggaccacaggacaattttcatatggcctaaatgtatccattgcctttgatgatgttcccagccatactccagtcaacggggactactagtccctcactcttaggttttaggggagtccttccatctgctccttcttaaactgtcctagggagttggcttttcagccagggccaaaggaaaaagccctgctgcatttaaaaacaaagtgtccaagctgtcagtggtgtgtttacaatctctcctggcagaggttggccctttctctaatgccttctggaaggcggaaaatgtgggaactataaatcactaggcggttgccttgttttgacttgagacacccaagaggaacagtcatgtttctcataaaaatcagtgggatcatttttgaattccatcagcctttgtatgtgagtgcaaaacattttaacagttttctcaaatcaacaaacagccttctcctatagctgtacttgcccccctccccaaaaaaccatggatgagaaagaaaggagtcaggggcctgataaaaaatacagacttaatgagcaactcaagatgagaaaactgctctttttccaaaaattaccaactgctgattacagctgaaatggaaccaaatgtttgttttctgatttttttttaatagctgtttaacaaattagtctttgctgagtaaaaggggaaatttctaaacctagtgcactgtttggccagtgtccacagcctcttttctggctgtgttttagagaaagggatttgagctataggctcgcctcctgttctcattctcacaaagctgccttgactgtggcctgcaaccacgagtgccatgctttcaggtcttctgtggcctactggccttcaagacagaggcctgccccagtgtgccacagatccatgtggatggagcctccttcagaggg

SEQ ID NO: 80068 - DNA, 1050 bp, Homo sapiens
caggttcaagtgattcttctgcctcagcctcctaagtagctgggactaaaggtgtgcactgccacacccggctaattttgtatttttagtagagatggggtttcaccatgttggtcaggctggtctcgaactcctgacctcaaatgatccacctgcctcggcctcccaaagttttgggattacaggtgtgagccaccacacccgaccgggaaaaatgttattaaagaaagcagtcttgtgctatacgctctgagtttgcttatgtctctatcctcatgaaacctgttgttctcatgagcagagtccatgggagttaagcctgagagtttagggggctatttttgcagcacatttaccagctccccaaataaaattttgatgctcttcatgttttcaagtttgaaaagatccaaaagctgactggggctcctcacacgcctgttcctgcaccggacttcctgtttgaaattgagtactttgacccagccaacgccaaattttatgagaccaaaggagaacgagacctaatctatgcatttcatggtagccgcctagaaaacttccattccattatccacaatggcctgcactgccatctgaacaaggtggggcctaagggacaccctgctgatgtggggaagcagggatggaggtgggagagtggggagggggagattcagaaccctaggagtttgcaggtggggtcgggtaggtttactaacgccttctcactcaaaatgtggtctgcacaccagcagtggcagcatcacctggagacctaagaaaatgcaaaatcttgggcacactctagaccttctgaatcagaacctgcattttaacaagatctctaggtgattcctgcactggttatagtttgaaaagcgtcgatttaaagatagttcccgaccttggctgcatatttagaatcactcggggagcttttaaaaatcccagatgccaggcctggcgcagtggctcacgcctgtaatcccaggactttgggaggctgagggagttccagaccagcctggccaacgtggtgaaacccca

SEQ ID NO: 80069 - DNA, 1068 bp, Homo sapiens
aaaacccaccaaaaaaaaaacctttcagattttagagcttgtaaagtttagtattatttggaaaggggattgtagacctgtgaatttcctctcaggagatcccttgagacgtgcaacaagtgaacgttgcctgccttcccactagagggcccctgattatcactgtgtccgggatccttgctaatggaagttcttccgtcgcttcagcttgcagatgccagcaagttacctaacctgaaagaacttctccagtcctccggagacaaccacaaacgggcctgggacctggtgagctggattttatcctcaaaggtcctgacaatccacagtgcagggaaggcagaggtgagactttggtccgtagcatcacagattttaggggcctaagggctctaggacagcactgaatccagtggctctgagacttccctgtgtaccagtgacctgggcagcttgagaatgcagagtcctggtcctcacctttagactttctagttctgtgtctggagtcaggcccaggagctttcccactggctgtacaaagctgaattctgtctcatctcagctgtgtgaccttgagtaggtaccaggtgcatttcagtccctccgcttcctcatctataaaatggggatgataatagtatacttccatcaggcactgactatgagaattgaatgaattttcacactttgaaaatgcctaagggcacatactaagggctcagtatgtgttgggattcactttatttaacaagcactgctggtaattctgattagggtgaccctgaccataccttaagaaactctgacctagttcagttatcaggagatggagaggcagaactcaaaggagtggaaaacctcatgctctgggttcaaatcccatttctatcgaaaagggcctccttttttccatttataaattgagatgctgatagttacctcaaagtggggcactgataaaatgtgtgtcacccccccagcacagtttctggcacaagtcagacattccataatttggtttaccttgcctggctggggtctcccagggacaggctggataacaag

SEQ ID NO: 80070 - DNA, 1049 bp, Homo sapiens
ggcaaaaggaccaacacccagagtgccagaggagaggggcaatggggccacaacctagtctgtaccccgggtactgggaccacacaccctgctccctgccaggcattggaccaggcatctgatgggttttggccagcaaaaagaagcatgatttattactatctccctctgtatttctttagaactttaaatttttcatagtgcctttgagtctgttaatcatgtcatacaaccctatgacccaagctccattgttcttctttgatctaaacagatgagaaatgggaatccaggacatgttgaatactttacctaaggtcacaccctgaaggtctgtgaggcttcagtgcttatccagggtgaccatcgaagtagcagcatctgtattggagtcagtcttgcttttgggtctcagttttgcaactactgactgtgagaccctgggcaagtcacttgacatctctgggcttcagttttcttacctgtgaaagaggaaatagtacaaataatatctatctctgagatggtctgatgattaagtaaagtaccgccttggatggcactttgtaatgcataaagttctatatataataggaattcctattaacattacagaaacatggggatggggtgcatagacccaaggaacttggaaccatgtgggtggagttcttcctggatgttcatttcatactaacacccctatttccttccatctccccttccccaatgcaggtcttggccactctgctgaactggcatttgctgtggagccaagtgatgatgttgccgtccccgggcagcctatagtgctggactgcagggtggaggggacccctccagtgcgaatcacctggaggaagaatggggtagagctgccagagagtacccactccaccttgctggccaatgggtccttgatgatccgtcacttcaggctggagccgggaggcagcccttcggatgaaggtgactatgagtgtgtggcccagaaccgctttgggctggtggtcagccggaaggctcgcatccaagctgcaagtaagtgg

SEQ ID NO: 80071 - DNA, 1041 bp, Homo sapiens
cacctcctccccctccttcagccagcctatgataacactaaagattattaatgttggttttgtatctcgttaaagacagaattgtcacttgtagtatttctgtagcattcagcgctgctgtggctaacaccactgtgtatgtttcatcattgctctgaaggtcaaaagcctcattttattttgctggtttgattttttttttttaaagaagaaaaaaaaactgccctgaattaaatggctgttttaacagtaggctcttagcattataccacatagtcatttttcatgttcttgtttaacaggcactgaggttctggtttaaattaaatagctgcaaatgagacaatttataacccattaggttgggtggaaaattgtttctcaaaagcaaataagtaataaatctggtatctgcctataactcacagttgataagaaagtggccatttctcactagcactatatatgatttgggctctgggtaatttggaagtgttaggtttgtgtctttgtagcagtatttttattagaaaagaatctattggccttttacagggtattaatccctttgtcacctaccattgatgccttaagttttctgagtctcaattaaaaatcttccttttcttgatgcatgacaagtgtaatcagtacttgctcatttatttgtctgtatttagtttatgctgtactatttaattatccttccagcgttttttttttctccttacaaatatgatactctttagtgttaagctaaggcattgattcatgtatctgtccttataatgaattaataaactattttccagaaatgtggaattctcttttggaaccattgaccatgactagaatttcctcagcctttgtgccctagggattttatttcttactgtgatgggaaatgatgttgttgttgtttttgagatgggatctctctgtcgcccaggctggagtgcagtggcacaatcacagctcactgcagactcaacttcctgggttcaagcagtcttgtcactgtagcctccctagtagctggga

SEQ ID NO: 80072 - DNA, 1670 bp, Homo sapiens
ttgtccactctgactttagtgcatctaacgggaaccctgacctccatctccaagacctggagcctgaggaccccctgcctccagaggctcctgatctcatctcgggtgttggggatccagggcagggggcagcctggctggacagggagttgggagggtgtgagctggcagcccccgggccagacagacttacctgcttgccagaggcagccagtgcttcctgctcctacccggacctccagccaggcgaggtgctagaggagacccctggagatagctgccagctcaaatccccctgccctctaggagccagcccaggcctgcccagatccccggtctcctcctctgcctagctcttcccagaggatgtggtttggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccatcgcccagccttttattacacactctgagagtgtctccaatgcctgtctgacaaagacagtcccagcccattctcctgtctggctgggttgggtgcaagcaggctctgaatgcctggcatttcagctgcatcacctcccagctccttattgcccaaatagagagggtggccctggctcccctccgagcaactctgcatttaattttgtaatctgggaagtgcctggttttgaaaatccgctttctctcactcttcccctccttccttgcccctggctgctctagtgttctgtctcccagtcacctcgctctcccagcaccagtgcccttctcctgctcccagatactctttcctttcctctctcctgttttccttcctctgctatctctcacacctctcccagactatgtcatcttgttctcctgcctgggttcaaactctgcatccttctctaacaacgtgactacctcatgtctgcttcaaggcccccgtgcccttcctgtatccgcggctgccgcgcactcgcctgccatcctcctgcctcctcttcactcagtgcttctgcttgccctgccccaggcagcccacccacgcccagtgcgggtgtggagaagatcttctggcttccctgcatcttgcctttgggattgggatccaagggttctccatggatggatccaagtcatagaggggaatgtttgagacagggaagggggctgtgatccagaggctcagaataaaaagatgccctcccttctatgcaggggggcaagtttactggatggagatgatttgggcctctcttccagaagaagctaaaggaagagaaggggagtgagagttcagggaggcccttcccaccctgtgaggcttgacttgatctggattggggatgacaggaatctcaccctctggggtgctggcaaggaggtctttg

SEQ ID NO: 80073 - DNA, 1038 bp, Homo sapiens
gctgggagccagccgcacctccaccccagcactggtgcacacactggatgatggtagggcctctgaactcgcagtgggcagcttggggtaaagagaattccctggggaggggagctcaccctctctttactaatgtaaaggcatttttacctgctcatatcatcttttgtgccccgtaagagagtgggcggggttcttctcctcagttcacagttggggaaactgaggcccagaaaatgagaatgatttgcccaggtcagtagttcagctgggacttaagcccaggtctgtgatgattccctgtgtcatgcagttctccctgacacctatgtgccatccagctggggtaggggccagtgacattaacccattagacgtggaagattgtgctccaagactttttccagcttcagggtgggaaagatgtcccctcatccttcagcttggggctcccctgagaagctccctttcctccctcagatcctggtcctggcctacttctgacttgctgtgtgacccaggcaagtctctgaccgctcccgagcctcaccttccacgtcggtggagcagagctcatgctgatgttcttctgtctcagtccccagtgcagcaccccagctctccctgtccagccccaacccttcggacatcagggtggcgtggctgcccctgccccccagcctgagcaatgggcaggtggtgaagtacaagatagaatacggtttgggaaaggaaggtgagtgggggtgggtgggctgcaggcatgtatgggaatgatcaacgtgaagagctgtcagggctgctggagacctgagcagggtacgggagtcggaggaaaggaagcagagtaggggttggggaagggtgaacctgaaaaacaggggtctgggcaggaatgaaaagggaagacagaggggcctagcttaaggcagagggaggcctgggctctcaccccaacccctctacagctgcagtgtgtacttctactgagtccctgcctcagtttccttatctgggaaatggggggctgaggtggga

SEQ ID NO: 80074 - DNA, 1062 bp, Homo sapiens
ggcatgagccactgcgcctggcccagagttggcaatattgtagaatgttagggtttgtatgtttaaaagccatgtgaaatgtatatatatctcaagtttgttttttgttgttgttctgttttgttttgttttgagacggagtctcgctcttcacccaggctggagtgcagtgacgcaatcttggctcactgcagcctccacctcctgggttcaagtgatttccagctaatttttgtacttttagtagagatggagtttcaccatgttggctaggctggtcttgaactcctgacctgaagtgatccctctgccttggcctcccaaagtgctgggattacaggcatgaaccactgcgcccagccttcaagttttatgtgtgtagatatatatatatgtatgtgtgtgtgtgtgtgtgtatatttttcttttaaacatgtataatgtttaaatctgtcaactggataaccagttactggctgtttatagatacatgccaaagagtgtaggagatggttatgattagtaaaacacatacaacatacctgatggatcgtaattacttaattgttggactgcaagctatgagggcagggacctgtttgccctgtacaccattgtatcttcagcagtcaagcacaatgctgggcatatagtaggccctcaataaatgtgttgaatgaattaattattaaatgtataaatgcttacaattctgtaaacaaactcttggaaaaatatactagaagaaattacataaggatgataacaattgttgagaataggaattatgagtagtgtttcttttttaatatttcaataacatgatgttactttacagtgaaaagtaattttttaaaattttattttattttatttttttgagacagagtcttgctgtcacccaggctggaatgcagtgtgcgatctcggctcactgcaacctccgcctctcaggttcaagcgattctcgtgcttcagcctcccaagtaactgggattaaaggcgcccaccactattcccagctaatttttgtatttttagtagagacgagatttcaccatg

SEQ ID NO: 80075 - DNA, 1052 bp, Homo sapiens
tgagagtgtatgtgttagagtttgggggtgggagagaagatgcaacttgatgtacaccctacttatacgtaactttggggaactgagatagagccacttgtacatagaaatatcctctctgttttgtatgtccacttgggtagaatttagcaccatttagctttcagcatcctgtacacagttgaggaataattgagatttgttctgtcctctgtgaagagggaatccaactggttagtgccttccttgtgacaagcctctttctctctacaggaagctttaaatgctaccttttagagatgccccatgtcctttctgctgctttgggaaatgatgagaatccgatgttccttttgcacagtaaggcagttactgtgtttgccagtgttattggacatgctgagtaagacatggggattttctcccacagccagttctttgaccttatgttgtattctcatgtaagtttttttgtttttatttttgtttttggctcagtgaagtgagattgcgtgcactggcaggcctagtaatatagacaaggtggtggtggtaggaattaggactttaaagaagtagtatgttcagttcctagaggtagtataatagggaaataagaagacagggcctcaagagcaattccttctgctttactgcactaaaaattaaaaaggagaagtaggccaggtgcagtggctcacgcgtgtaatcccagcactttgggaggccaaggcaggaggatcacttgagcccaggagttcaagaccaacctgggcaacataatgagaccccacctctacaaatgagttaaaaaattagctgggcatggtggcgcatgcctgtggtcccagctacttgggaggcttgaggtgggaggataacttgagcccgggaggttgagctacagtgatccctggtcacactactgcactccaacctggacagcagagtgagaccatgtctccaaaaaaatagataaaaaggaaaagtaaaattaattacttaaggggctaattttttgtctttgggtataggaaggcttgttacaagga

SEQ ID NO: 80076 - DNA, 1005 bp, Homo sapiens
atgcccagctaattttttgtttttggtagagacggggtttcgccatgttggccaggctggtctcgaactcctgacctcaggtgatccacccgcttcagcctcccaaagtgctgggattacaggtgtgaaccaccacgctcagcccaaaagtatgactttttataatggaagttctatgaagatttgctgggaaaggggatggcaagacctctcctgaggttacaaacattgagaaggaatgagccatgcaaaagatgtgagagaaaagcattccagacacagaaaacggtaaatgtcaagttcctggggctagaaccaacttgatagtgttgacaataaggttagagtacagtgcacttggagggaaatggtatgagatgaggtcagaggtagccaaagatctcaagggccatgtagacttattctgaagggtaatggtaggcagtggaggaagccaagcagcagtcatatctgatgtctgatggggaggaaagtttttcttatttgtccttgtaactgtcattcgaatagcacagttcttcagggtagaagtaatcaatttagtaactttttatatggggtgggttgattcacttatatgtaattaatatttaagttagaattttaaagcctatggttgttcagtaattgccctgaacttgagtgtgaagttaagcaagaagcaaataaacagacttgttaatttaaaaagaaatgacttaaaaaattacattttaaaggtaaaataatagtgaaattaagctttctatttcttgcaatgcccagccgctcttgggtttttatatgcttccatatgataaactgaagttgtgtttcttcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatggtgtgtgagcata

SEQ ID NO: 80077 - DNA, 1053 bp, Homo sapiens
gaacttgaggagaatagtattctgaactagtaagactctttgagcaaggaagctgcaactttggagaataaccagctgatagctttcttaaacttttgaagcacttgtaatagctattttaataaaagaacacttgctctctctggaatgagagaaaaactgaattatttgtttaaaatatttgatttcttaaacataaataatggactgggctgggcgtggtggctcacacgtgtaatcccagcactttgggaggccgaggtaggtggatgacaaggtcaggagatcgagaccatcctggctaacacggtgaaaccctgtctctattaaaaaatacaaaaaattagccgggtgtggtggtacacgcctgtagtcccagctactcaggaggctgaggcaggagaatcgcttgaacccaggaggcggaggttgcagtgagccaagattgtgccactgctctccagcctgggcgacggagtcaaaaaaaaaaaaaaaagaatggactggttttatgtatcatctaattcactttaatctccaatctttttttctagtattttcactaactagctatttctgctaaggggttaagaaattaggccaggcgtagtggctcatgcctgtaatcccagcactttgggaggctgaggtggttggatcatttgagatcaggagttcaagagcagcctggccaacatggtgaaaccccacatctactaaaaatacaaaaactagccagacgtggtggtgggcacctgtactcccagctactcaggaggctgaggcaggagaatcacttgaacctgggagatggaggttgcagtaagccaagatcacaccactgcactccagcctgggcaacagagtgaaactctgtctcaaaaaaaaaaaaaaaaaagaaaaaacaaattagtacagaaccaaaaaatataagtgtgttttaatgtccacaagcagaatcagaacttgtaatatggtgatgatctctgcttagactgtaaattatctgctgtacacaaacacttaggagaggtctgtatagctttggtgaac

SEQ ID NO: 80078 - DNA, 1007 bp, Homo sapiens
ctctcaccttgacctcccaaagtgctgggattataggcatgagccatcatgccagcctaccgggataaaacactttcacaggccaactatggttttggaaatttcaagaaagccactttttataaattctgttcaagcttaaagtgtatttttaattaactatttgtaagtgataatttaatatacactaaagcagttctttcatggtgattacagatataattgataggtgccaaaggagataatagggaaatctttttctgatagcttgctttatttctggttcttctcttttatttatttaaatagtgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatgtatgcattttttcctgtatttgtttaaatattttctcagaatgctaaagcaaatgaagttatatagcaaactatcaaaatgcatttttttttaagtttaaagggaccatgttatttctttagtatgagcatttccaattggagtgatggttccagaatggaatggtttgtattgatagaaagtagatgccattgaaatgacatctccttggcttcagatttgttcctggagataatagatattaaatatacagcctcatcagtgctcctgagaggacttcatgagtctggtctagaaaagactttctcttttatgttggtaaactgtaccaaaatataccaattctttttttttttttttttttttttttgagacggagtctcgctctgtcgcccaggccagactgtggactgcagtggtgcaatctcggctcactgcaagctccgcttcccgggttcacgccattctcctgcctcagcctcccgagtagctgggactacaggcgcccgccaccgcgcc

SEQ ID NO: 80079 - DNA, 1038 bp, Homo sapiens
gaatgcattttatggtatgcaagaacaaagtcctacaaaaatgtttttccctgttttaaaaatatgtatacatatcatctccagttgttttccctccaaaagaagtggcttaacaataactcaccttgctactgcaaagactagtgatattttcctacaaaaaaggcagcatattttatacataagttattcttcactataagaaatctgatactagaaggaacggttggttatgactactctctggaataattcttctaaattttcaatatttaaatttcttttaagctcccagtggtggtaaaattcttagaattctatatgaagaaaatgatgaatctgaggtggaaattattcatgttacatcccctatgttggaaacaaggagggcagattcattccgttatcctaaaacaggtactgtactccattggcatttatattcactcatttcctctttccaaataagattctttctgtagtcatccaaaggtgtagccaacaacattggtcatttccagccttatttacgacgggttgttcactaagtaccacaaaaatagattttgaattaaagggtgatctttttgattcttttcaaaggtagggatgtctacacaattggtttcctcaaggaatgaattagaaggtatctttgcgccgggcgtggtagctcacgtctgtaatctcagcactttgggaagctgaggtgggtggatcacttgaggtcaggagtttgagaccagcctgaccaacatggtgaaaccccatctttactaaaaatacaaaattagccaggcatggtggtgcatgcctgtaatcccagctacttgggaggctgacgcaggataattgcttgaacccaagaggcagaggttgtagtgagttgagatcatgccattgcactccagcctaggcaacaagagtgaaactctatctcagaaaaaaaaaaagaaggtgtctttgctagcaaatacagatttttaagtgatatttttcataataagtgatttttttccattttgcttcttacagcat

SEQ ID NO: 80080 - DNA, 1042 bp, Homo sapiens
atatacttctctgtgtaagagagttatatgtcccctatactgtgctccttttcttgtaatcttttttccatgatcctgctaattgggaaaataataacatttatttggagcatgtactgtggtccaggctttgttctaagtgctttatgtgaattaattaatttaatcttcatatcaacctcacaaggtagccttttctcatttacaaatgggatactgcagtggaatgagattggatgatttgcccaaagtcagacattatggaccccagatttgaactcagtccgttcagctccagagtttaccactgtattccagccacctttccaaataaactgaatcattttgctttgtacctatgaaaagatagctttctgtgataattttgccttttatatttgtctagagctagccaacatggaagaagatgccagatcagctggagtcgctacctttgttctccaagaagaatttgatagatattctggctattggtggtgtccaaaagctgaaacaagtaagggggttcaaaataatatattatgggtcaattaaagtattgttaagattcaactgtcatttaagtgcacagttctaaatcttggataatagatttgaaagcggataatagattccaaagtgatgatgattgattcatgcccatagttatttaaaatatgtagattaggctgggcacagtggctaacacctgtaatcccagcactttgggaggccgaggcaggcggatcacccgaggtcaggagttcgagaccagcctggctaacatgatgaaaccccgtttctaataaaaatacaaaaaattagccgggcatggtagcacgcgcctgtaatcccagctacgcgggaggctgaagcaggagaatcgcctgaacccaggagacagaggttacagtgagccaagatcacactattgcactccagcttgggcaatgagagcaaaactttgtctcaaaaatatgtacattatggccgggcgtggtggcttacgcctgtaatcccagcactttggaaggctgaggca

SEQ ID NO: 80081 - DNA, 1048 bp, Homo sapiens
cccagcactttgggaggccaaggtgggaagagctcttgagcccaggagttcaagaccagcctgggcaatgtagggagaccctgtctctacaaaaaaataaaaaataataaaaattacccagacatggtgtcatgcacccgtttctcagttactctgggagccgaggtaggaggatcacttgagcatggatagtcaggctctgttgcaccactgcactccagccttggagtgactgtatttgcaccactgcactccagacttggagtgagctataattgcaccactgcactcccgccttggtggcagatgaaagagagagaccctgtctctaaaaaaaaaaaaaaggatatagaaccggtttgaatttcaagtctaccatttattaactgtgtggccttgagcaggttatttaaccatctcttagtttccacatctgtaaaaacagatattaattaatagcacatcaacatagggttgttaggaggctttaatgagttaatatctatgaagtattcaggatagtgcctgaaacatagtaactgttgtgtaagtatgtgcttagatagaaagtaggtagggagttaatgtcatcagcttattccacttactcacaataggtttctaagtgaaagtccacttgagatggatttggtctatcagtatgtacatgtgtttattctttgcctggtgatagaggaatttaaaagtaataaaatcctagcttctgctctcaaatgacttactgagacaatgagatgatactatttattcatttaataaataataatggaagtctataataaacagtaggaagatacaaatgggggttacttatcttcatagtcttggctctgtaattaattccagaattcaaaacactttgaaaactgagcttagttttcattaggttgttactaaaattcatttggcagtaacacctgacctgaagtgacctgaggatattgataaacttaatatgcttatctgtgtagtgtgcctattcataagtttactgcaggaatattggtgtatatgattgcaaggtatt

SEQ ID NO: 80082 - DNA, 1050 bp, Homo sapiens
gttcaggtgattcccctgcctcagcctcccgagtagctgggattaccggctaatttttttgtatttttagtagagacggggtttcaccatgttggccagggtgttctcaatcttctgacctcgtgatacacccacctcggcctcccaaagtgctgggattacaggcacgagccaccgtgctcagcctgtttgtttgttttttgtaacaaagtctcgctctattgcccaggctggagtgcagtgggctatctcagctcactgtaacctctgcctcctgcgttcaagtgattctcatccctcagcctcctgagtagctgggattacaggtgcacaccaccacacctggttaatttttgtatttttagtagggacggggtttcaccatgttgaccaggctggtgttgaactcctgacctcaagtgatccgtccacctctgcctcccaaagtgctgagaacaggcgagagccacagcacctggccagacatagggttttataagagcaccaatgtgagacagtggtcagggaaggctttccagaaaagatgacacctaaactgatcctaagtaatgtctatatattatccagtacactcctgacaaggggactacgtgagaaaggtcttgatgcaaaagacatcatggtgtttgtgaggagttagaagcagtgtgaaggttctgaagcataagttctgagtcaagaagtagcaaaagattggcagataagggccaggacaagggtagaccatatcttctgtaaaagaacatggactttatcatgatatgagggtccatggaaaggtttttaacagttgagtggtgtgatcatcataatcatattgtcgataagttgttctggatactttgtggaggttaaatttgagaagcatgggtagagacaggaacaccaaagcttgactgttgcagttatccaagttatatggcctaaatctagagcataggatagagaaaaggggatggagtaaggaaaatcttaagttaaaagtatagattttggtgtttaatgggtctccctttgaagtcaggaaat

SEQ ID NO: 80083 - DNA, 1058 bp, Homo sapiens
cgcgccgccctgcccagtgcagagccggtggtgcccttcccccctcccccccacttgccggaagaggaagccgaggctctgagattccgagtcaaccaccgttcactgggcgccccttgagctctgggcgctggcctcctggcttccacgtccgttatcttaattgagtctcgctggggttgggaggccgggtattgtcagcgcttacagatgaggaaacggaagcccacagaggcgaagggattttccttaagtccgacttggcagatgggcttcggcctcagattttctggtttttcagctggtggtcttttttctctcctgcctcatgctaggtcgattccctccctgctcactgccctctcccattctgttccacccactcgcagcaggacactttcctttcctgccacacctgtcttctcacacacttttcttctaagacttggcattcctcccatctctcttctcaatattctctgctatgcctctcctcttgttcctcattcatagtttttcaaggtctttgccccctctgtgctattgaatctctcaactaggtgtggaccctaaagaatgagatagctaggcttcagtgaggctttaggtgtttaagtggacggctgtttggcccttgagttaaaaattaaggaatttcacttgagtggatccaaactcaagagtcctaaagctattttctgagtcaacatgctctatttctgagtgaggggcttagtgctatgaggtgtcttgacatcttagtccattgttgctgtgctggcataacctcgctgtttttcctgcacttgccacttagcttttcccaccccatcccttcatcacctacttgggctatgggagcccaaaattaaaacttatagagtaacagatgtaatagcagaccttcctttttttttttttcctaagccagaatttcaacaagtttaatgcttctttttccagaaaagttacctatttaaattattctcagagtaatgcagcaagaaaatggaatgcacttaagatgaatagaaaattgtttatctcgtgaaaagtct

SEQ ID NO: 80084 - DNA, 1045 bp, Homo sapiens
taaaatgaagaaactggggcctaggggaaagaagtgaatgacttgttataatcagagccagaggcaggtcccttgacctgcaatttctttcctggtctacactgtatattggctgagaaaaagggaactcaggaagatatccaggaaagtagcaggtgtacaacaaaactgtgcaaaagcggggcctcccctattttctattattacaaagaacaatgtgtcagagtcgtgtgtcattaggatttattataatagcactaataaaaaatccatttgggtactatgctccactccacagtatataattattcactctgaggttaaatgagccttccctcaggctttttaaagttgagctcccttaaaaaaaaaaaaaaaaaaaaaggcaaagtcattttccttgggtctcttctattaattttctccaaatgacctgagagcagattttaaaggctttaaatgcacacacaaacacacacacacacaaaatacagagaaatatcttgcacttcattaattcaacaagtgtttgctgaatctctgccttgtacctgtcactgttttaagcagcggggccacaatagtgaacaaagtagataaagcccctgttttcatgcagtttatagcctaataagaagagatagagccccctccccgcaaaagcaaacaattaaaaatatataatttcatgcatttaaaaaaagagccatggacagataaaatacttgcttatatcacatagctaattatatatttgactagattggaatctagatttcttttttttaatttttatttatttttttttgagatggagtctcaatgtgtcgcccaggctgaagtgcagtggcaccatctcgactcactgcaagctccgcctcccaggttcacgccatgctcctgcctcagcctcctcagtagctgggactacaggcactcaccaccacgcccggctaattttttgtattttttttagtagaaacggggttttaccacgttagccaggatggtcttgatctcctgacttcgtgatctgcccgcctcg

SEQ ID NO: 80085 - DNA, 1007 bp, Homo sapiens
caggcacacagtaggtactcagtaaacagaatgcgaaggaccgtccagagacaccagtcccaaacccttttccaggctgatcggtcccccataagtctccagccttttttattttaaagcttattttaaagcatgtccctgaagacgagtggggagagcagaccacccgctgattccaattccctaggcggccgcggcgagctgcggcgtctctgtgccccggcctgcccctatcccgcctgcgccccgcccccgcccggctcgcgccaaggcccgctgctggcgccgccgccatcccggcgcgtcactgcgcaggcgcggcccgcgagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacaggtaaaggccgggtcgggcggcgggaagcgcgcgggatcgcggctccgggtacccgccaggacccctgccccctttgtccgcgtgcgcgccggagagcctgcagtgcgccaacaaggtcggcgacgcggtgcgcttacggcgtgctggcgcttttcgaggctcatctgcagatctcgggccgggggcacaaccccccgagggctgcaggaaccttcgggtccccagagagctcggcctgggcctctcaggctaccccgggcctcttctttgttcgcagtcggcggccttcatggagcccaggcccggccctggctgcctggccgtcggggttcgagttggctggggcccttcgagatgtgggatgagcttgttgggtcaggggtgcggttgtgacagcggcttgctgggccgtagctgaatgcctgccgctggcctgagaggtccagcc

SEQ ID NO: 80086 - DNA, 1109 bp, Homo sapiens
agttttgaggcacccatatttcaactaccattagtttaaaagcatgatgttaccctcataaaagagtgtttacatgtgttagcaatcctctaacacatgtaaggtagtacagatttacaaaggtgagtcagacccagcttttcaagggcatgctatctagaaggaggcgtatcatatacaaacaaaaagttttgtgtaggagtatgtttattggtagaattggagttggatgttgaaccaggtatctggtgttaaaggaatttgttacctttctttcatttagttagtgatgacttccagaaatgagaattatttttgtcaaactaagactgggagaatgttccagaaagagaaaggcatagacttttagacacttgtaatctctgacttaagccgtgtcaatgcccaaaggccaccaataacacacccgtagttaaacaagttgggtttattactcattgcattgagagagcatactccatggggaaccctggggtgtttcattaggagggtgttagaactgattataggatttgggtgttggtgattaggggaggggagggttaaggaggttgggtttcacttcagataagatcctgtaagaaaatatgggagtttcgtggttgggtatctgaataaatcttacctgtagggcagggagactagtataagaacaaaactgtaattgctacaggagtagcagtcactcaatttggccaaagggtgtttggtatttcgtgagtggcatagccactatgtatttgtctgtgcttataacaaaattgtgaaatggcctttgtctcattttatgaggatttcagagtaaccttgtctgaggttggtattctgtgagattgtttatgtcccataggagaataacatggcctggctgtgagtgctatgcctgcttctggagtgtcacgggttgccttttttttttctttctcaactgattgctctatgcagggcctgttgaaaccagtggttttacatgtgcagatttgttatttaaaaaaaaaaaaaagaaagaaaagcagccgggtgtggtggctcatgcctgtaatcccagcactatgggaggccgagacgggcggatcatgaggtcagga

SEQ ID NO: 80087 - DNA, 1561 bp, Homo sapiens
agacttcagcagtggcatcgtctgtgcttgaggtgaacggtagcaaagaggccagctaaagcagggttactttcaagattgaatttactttcacgatgaacataatgaacgtgtttgtcccgagaaacatagttgttaaagcattggtttatttacaaggtgcttgtttgttttgggtgttgtgagcagagaacagagcgtagctgtgtttgagagctgtttgaaagatattgttcctgtccttacctaacagagtctggtggaaagagtgctaactgaacacatgagattgggtccttgttcttattacacttatgctctagtgaccatgattcacttaacctttatgaacctgacgctcttcatccagacagatatgaacagtagtgcctaactcataggaccattttgagatttgaattggaaaatggatttgaaagtgctttgcaaattctagtgtgcagttcaagtgagtgattatgatgattgcgatattaaaccttagatgagagggatggtcacagagcaatggaagaatagagcctattagcagacctattcatatatgaaaagttaaggtatgacaagaggcgctcttacaaattaatgaggagagaatgacccattcaggaaattgtactgggacaattggtaatccaaatggcaaaaagaaaataagatcctgccttatgccatacacaaaaatcagtttcaggtgcattaatgacctaaacgcataaagaaaaactactaaaaagaaatataggagactatctttataatattggaaagggggagaatgtgttaagcaagatgcacaaaacacaaaccctaaagacaaagattggcacatttaagacaaacttgaagaagacatttgcagtgcatatcattgagagatgactaatatcacgactatttaaagaacacctacagaccaataggcaaaagacgtattacctaatagaaaaaggggcagataatataaacatttcagagtaaaaggaaacaagaatgaccaataagtctgaaaagatgcttgactgcaattatgaccaggcacatgtacaggcataccttgttttattgtgctttgctttattgtgctttgcagataatgcggttttgacaaattgaaggttgtggcaacaaagtctgttggcgtcatttttccaacagcatgtgttcatttagtgtctctgtgttgtattttgttaattcttggaatagttcagattttttcattattattatatctgttctggtgatctgtgatcagtgatctttgatgttaactttttttttttttttgaggcagggtctcactctgttgcccaggttggagtgcagcagtgtgatcatagctcaccgtagccttgaactcctgggtttgagcagtcctcctggctcagcctaccaagtaggactacaggtacctgcctagctaattttcaattttttaatttttttagaggtggggtctcattatgttggccaggctggtcttgaactcctggacttaagcaatcctcttgccttggcctcccagatccctgaggtt

SEQ ID NO: 80088 - DNA, 1320 bp, Homo sapiens
gagaatcgcctgaacctgggaggcagaggttacagtgagccgagactgagccattgcactccagcctgggtgaatttttcaaaaaaaagaaagaaaatattaaacaagttcatatcagataaaatggataaattccaagaaataaagacagtttctataaaagagatagaaaacctggatagcccaataaccattaaatacatggattcagtagtcaaaaatcttcccacagggaaacttgcaggtctaaatggcttcacctggaagttctaccaagcatttaaataaataattgcagttaataattatttgttaatctgttgctacataacaaatcacccaatatgtagtggcttaaagcaacaatagtcgtttattgtctctcacagtttctgtgggttaggacttcaggaggggctctgttgggttgttctggcttggaatctcatgaggttgtggtcagatgacagctgtagttggggaacacagaaagctaagcccacagaagaaaaacaaacaccgtgacactgggaaggagctgcctcttgcttgttaaccttgagctggaagtaggagttgggttgtttctcatccactggaaaaagtgttaagtagtttcactttacattatgatgctaaattgaaggtatgtagcaacttctgggaatcaatgagcagtctggagaattttgacctctcccgagtcttgtttcctttgggggttaagagagtctggagcctctaagttagagacacaggcacagcgtgtttcattttcattcaccacctgcaatcctctgcccttccctctacctgttggaattaatttatcattcaggttgcagtacaggtctcacctttggtgaagcttttccccaccactctattcctgttgtgctctctctctctcctaactctgctaacacttactgccttttaccacccttttcgtcttgaccatatgtttcttaataactatttgatatcttctcacagaaagtgcctcatctgtcccactggatcctctgttctacagctcaggggttgagtcctggagatctctgtattcccgtgtcatatctcacatagcaccttgcatgactggccattttcagaatggactaattcagtacttgattgtttgcacagttagagcaggttagggtccttcttgcaggagtctgcagtcttagataggtacagacagacatagagaaagcctacagagatgtgaataaatgactaaatatatttctgggggaggcacagagtaggagtttgagtccttatgggagagggatgaggggaagaagccccttg

SEQ ID NO: 80089 - DNA, 1052 bp, Homo sapiens
ctggtctagatgttccctttgcatcaggacttgcaggaccagagaaagaaggagaataaatatatcctgcagcttctatgtacggcgcccctggcatggtgctgcttcagggaacagaagagggcattctcacattttcactttctctcctagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggttagtaaggatcctaggatctagccattgaggacaaatcatggggaacccacgttattcaggccacttcagatacctctcggtctgaaagaatagctacaaagttacaaattcatttaaagacctggtgatgtgattttcaagaagtattggctatgtattttatagactttccttcggttgaaatctgtctgatgtttctcttacaactagactaaggtgatagatgttgaggagaagaccactgaagtaaagtgcaattcttatcacatcatatcaagagtacatacggccgggcacggtggctcacgcctgtaatcccagcactttgggaggccaaggtgcgtggatcacgaggtcaggagatagagaccatcctggctagcacagtgaaaccctgtctctactaaaaatacaaaaaattagccgggcgtggtggtgcatgcctgtagtcggagctgctcaggaggctgaggcaggagaatggcgtgaactcgggaggcggggcttgccgtgagccgagatcacgccactgcactccagcctgggcaacagagcgagagtctcaaaaaaaaaaaaaaaaagtacatactgtcaacgtgacacatcactgttgatattaaccatgggttagctggcttgaggtgacgcttatcaggtttctctaccataaggttattttcctcttggctctccttggaaggaagtcactatgtgtagcctacatttaagga

SEQ ID NO: 80090 - DNA, 1040 bp, Homo sapiens
caatcatttatatcatgtgagtacatgggtatttattttatactttgagttataatctaatattatttattttgttgctcaaattcttccagctttggcactaactggcctttggttatgtcctcatcctgcccatctttcatttggcttttgtatctttttgagaaagcgccatcattatgggactgtttttttttttttttttgagcacttccttactttctggcagtataagctgctccaggcttatcttgcatgtatgtttcctgctccagccctggaacagccatttcttcaagcatctctgttcttattgtggaatagcattggaaaccaagatctgggtgccgggtatgctcattgctaccaggttgccattgcctttaagttctcttcactgacagaacaagaaaatatatgtttggatagtaacccatgcatacacatacacctgtaaatatttctgtatggatccatctgtatctctgttaagctaaacgtgagttcatagtgatgttggaaacatgatcttagcttctggaaaaattatactaaaattctagaagtcttgaaaaataaaatagcagtctacctcctgccttaaacttctgttttatttctctgactgcgacagatcttctggatgtcctttccagctttaagattccaaggtcacttgtcagtttggaagccagctcactgggttaattttgtgaacaatggatgggcacctgtgatgctaatgctgcttagtaagcaggagtcaggcgtttggccctatgacctagaatattctcccaatgatgcactgaccccaactggaggagttggctttgagggagtcagattactcagccagcatatggacttttgcaagcatctgggaattctaacttgtgttcttggaaaacttttgtctaaattctaggaagaagagcgcctaaataaactccgactggaaagcgaaggctctcctgaaagtaagttgtgctgctgccatggtagttaccagttaacttgtgctagtgttggaagtatgg

SEQ ID NO: 80091 - DNA, 2466 bp, Homo sapiens
gtatcccagtagttcttctcacagtaccttgcacattgtaggtattcagttaatgcttggttgagtgaatatataaccaaatatcagggttgtttttttcatttactgtatctgtctctttgagctagtttgacctcagtgaccttaaagaaattccagaaaagaagaaactatggattatattaagatgactggagggccaggcacggtggctcatgcctgtaatcccagcactttgggaggccaaggtgggcagatcacctgaggttaggagtttaagaccaccctggccaacatgatgaaaccctgtctctgctaaaatacaaaaattagccgggcgtggtggcggaagcctgtaatctcagctactcgggaggctgaggcaggagaattgcttgaacctgggaggtggagcgtgcagtgagccgagattgtgccactgcactccagcctgggtgacagagcaagactctgtctcaaaaaaaaaagaaaaaaaaaattgagccggagctgaggaaatctttatttcctttttgtaatgcctcttcagatggccactcatttttttgccaggtgttatggaaaaaatacaacactacaacactcaactgctttttcctattttcttactcaacaacaatcaacacagaagacttctgtgaccaagtgggtgggttttttcccccacataccaagcaagcaatgagttctgcagcagacaccagctgggtgccctctggttcaattctgacactgtttacctagagatagcatcaggttcccacagatggagggctcagtccccaagacacacccctgcccccagcctgtcccgagtctgaacctccagaacttgtgaccaataggctgtaaattacggttcccacaacccgctcctgtggtttgattgatttgctagcgtggctccacagaactcagggaaacacatttgttcatttattataagggatattatgaaggatacagatgaagagattaggaggaagtatggaggaagtggcgcggagcttccatgccctccccaggtgtgccaccctccaggaacctccgtgtgttcagctgtctggaagctgactaaaccctgtccccttgggccttttatggagacttcatcggataggcatgactgaagcgtgttgaactgtgttgaaatgtgattggacaaaaagggtctgacctaaacccagcaaggcctgtctgtccagattcttctcagcctctctgtgcagtgttccctcctccagagtatgaggcaagaccctctctggaatgagggtcttaggacccacaatcagattagagtcgtgccttgggcagctgaaaggaaggcagggaaggtcatagagggagattctgttgtctgaggcctaaagtgtcccaacattataacaaaaaactgtaacaagggctgtgggagttataagccagaaaccgttgccgaaaacctatatatacatatacacatatcataatatcacaccaggggtaatatttttttcttgggtttgttatgtctgtatacctattcttcaaggctgggaaaggaagtcctgctgaaaatacatgctggagagcaatgttccttgtatgtttctctgtgggagtaggagcccaggctggtgaggacctggaccaggtatttgtgtgggagcttaggagcattcaggaaggaaaaagggttgaagtcatccagatatgcctcatacacctgtctcctgctgggactattgcttttaatagcttactgctttgctttgctttacagctcttacaaacttaaggaaaggatacctgtttatgtataatcttgtgcaattcttgggattctcctggatctttgtcaacctgactgtgcgattctgtatcttgggaaaaggcaagtaagacatttttggattaattttccctttctcagtagtttggcccagtattcaccaaagggagcactctctgcctttgatgttaataataacccctgcatttgtgcagcaccctctacttttcgttgtgctttcatagctcttatttcccatggccttgtgaaataagctgactggtattctttccatataacaggtaataaaatataggcctagagatggtcaaaaatggttcacatccatagctagccagagccacatcttgggctagaatccttttgtaaaaatgttcactaacaactaaataaattgatgtgatacttccagtgccaaagttatgcaaggccaaaagggttctcacccttttggagcctaaatacgttctaaaatgaactattctaaaacagaataaaaagagcatcataaagatattagttcttcttaaattaatttatgtgtttagcaggattctggctttgaccagtggcattccattggtaaatgccaatgggaaatttttgagaatttgatctaaagtattctgaaactttatttgatgaataaa

SEQ ID NO: 80092 - DNA, 1052 bp, Homo sapiens
ttggctgctcagaggcctttattcccttcttccttccttgctgctggttgtcttatcacctctataaactctggatgaggaatatgctactgaaattagtaaaagtgggagcttcttagtctattttaaaaggctccttacttttttttttttaatttttatttatttatttattttttttttttttttgagacaaagtcccgctctgtcgcccagggtggagtgcaatgctgcaatctcaggtcactgcaacctctgcctcccgggttcaagcgattctcctgcctcagcctcctgagtagctgagattacaggcacccgccaccacacccaactaatttttgtatttttagtagagacagggtttcaccacgttgatcaggctggtctcgaactcctgaccttgtgatgtgcccacctcagcctcccaaagtgctgggattacaagcgtgagccaccatgcctgtccccttacattgttttaaacaagaaatatcttatggtatattcccaatcaccaagagcacttaaagaacataatttaactgctggagatttagaaaagaaatatttccttaccatagcatattcccctagtgggtctgtttttgcaaagtaatcattctctaattctgtcccaaaagaattctcatatggacttttacatttctgaatgatttaattctactgtctaagaagtgacaagaaaaagtctgtattaaagaatcaatacttacctaaaaatatcattataagataaatctgaagaaaaaaggaaaatctaactttgattttcactggatatggcaatgtgaaactgaatcgtccggtctcattgaatattggaatggactgaatcactgagacagctgaaaacagaaacaagaacttgttagaagcaaatgaaacagtcacatttaatgacaggaacttccagtcctagtactctaaagtttcagttctgggtgtgctggaaaggctttctcctccctttgtacagaaagctcatgcctctcctttttttcccctacttttctaagagatcagcctcc

SEQ ID NO: 80093 - DNA, 1247 bp, Homo sapiens
ggaggccaagctgggcagatcatttgaggtcaggagtttgagactagcctgaccaacatggtgaaaccccacctctactaaaaatacaaaaaattagccaggcatggtggtggacgcctgtaatcccagctactcaggaggctgaggcaggaggattgcttgaacccaggaggcggaggttgcagtgagctgagattgtgccactgcactccagcctgggtgacagaatgagaccctgtcgcaataaataaataaataaacccactggggaaaaattgctttgtgtctattgtattgttaatttgttctaaattgtactccttcctgagccgctgcaataagctttttgctgtggaatatgacgacagctagatactgtccctgccacaagagcttctggttataaatagacaaagactctaatttctaattgacctcttttctttttcaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaa

SEQ ID NO: 80094 - DNA, 1046 bp, Homo sapiens
ggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaatggtttcactatgaaactaaaggtcgtttgcttttggtctgtcttatcactttaatataatttcaactttctaagtggcatagattcataaatcatgaggtttccttatttctgacactgattaggcctcattgcctaagcaaggttctggctaggtaatcctgacagatcaccgatccgattccaaagttaattatggttccaatttatcagctagctttatgactttgggcaacttctcaaggctttgtctgcatcatcagtgtttttcatttgcaccaccttccatgtaactctcaggcttcaaccagagcaactgtttttggtttaacatgctgaactgctacataatattttgcctgaacaaaggtctttatcactaacagagaaccattagactaaattatctttaagcacagtcattagaattttgattgtaaatgttttaatagaaatacacaatctttc

SEQ ID NO: 80095 - DNA, 1030 bp, Homo sapiens
gtagttagtagctaccacattagacagcacagatatagaacatttccatcatacagaaagttcagttggagagcactgggttagactatatagaattgcagtatatatatgtgtgtctatgtgtatgtatatatatatatattttttaaatatgtatttgttttatcctttgaccttaatttataaatcagataagtgaagcttgtttctttaaaaacattaagctgtttttcacttaaatgggcctcctacatcagtggctttctattgagaacaggttctccaacctgactgaagttaatggattttcttaattaacaaagtgataggatatcaaagattgagtgattcaaagagcttctagtctaaatggaaatgtaactgattgtgttttaccagatgtcatttcaagaatgtcttttcttttaagatgctaaagaaaacccttatggcgaggatgacaataagagtccattccccctgcagcccaaaaacaaacgcagttatgcccagaatgtgactgtctggatcaaacccagcggcctgcaggtaacattaccatttatgttgctttccactggggacaggagacatttgggtaggcaggcaggcattttatttgattttcttttcctttgatacttagtaattcatttacttctaatgtttgtcattatttccaaaagggatttgagatgccctacagtaaaacatgtatatagcaaaatcattttttacaaaatttagagcaataagaatcctagaggaaggaggaagaaggaagacaattgtgccaggaacccaaggcaaaataataactttatgtgagtgttttggctctgagcttcctgttaccaaggtcagttgttcttgtctaaagaaaggaaatttgtcagtttgtctagagagacatattttcctggcattgaattttagtgtgaaattttttatatggtgaggcattgactaacataatgggtattggctttaacaacagttttggaaaagatgtaaaagtcttcataactat

SEQ ID NO: 80096 - DNA, 1077 bp, Homo sapiens
ttttttcttggtgtactatagttcaagtaatttcctgtcattcctagataatgtaatctttcctccttcttgaaactttttttctgtagctttcctgacattgcttctggtaccgatttgactttttctttggcggacttttctttctctcttcgttttgtcttttcttctccttgcctcatggtttccaacatgttctttgccttcttctctttggttattcttctcccttggttattttatcagctgtaataacttcacatttcccaaatctataactctagtcttacctgatctctccctggaatttgcatatcatatttccagttcctagttggatctctacacctggatattctgtcacagtctcaagctcagctgtttgttacagacctattgtcccgcacccctttctcctcaaactattcctccttctgattttcctcctccttttgattaagtcatttgtgccactagctactcaggttccaactgtagtcatctttgactcatttgggcccatttcaatttcaggaacatctaccaagcaacctattctgtgccaggcctaagggataaagagttagctggagttgttcaaagtctagtggaaagtggaatgatcacagactggcacaaatcagagttagcctggaggagatgatgatgagctctgcctagaggactcaggagaatcttcacagaggagaaataccctagttgagttttgaagaaaaggaggaacttgctgagctaatgaagggaagaaagggcatcctgggcaaacagaacacctacagaaagaaaaggaagtgtggcacaaaatgtgagagtgggtgtgggaggggcagatggtagattggagattggtagtagctagagtggagcaggccttgtctgaaatgtgaagaaccaggaatttatcttgcagatactgggaaaccactgaagaggagtaatgtgatcagatccttctggctacagtgagaacagggggataccagttaggaaactatattttaggggctggtgccccctgcagttgtacagtatggccataatccaagtgagagataa

SEQ ID NO: 80097 - DNA, 1026 bp, Homo sapiens
tcactgatcattttctggccactacctggggttggctggtatagatcaagagttaggattaattaaaggaagcatggctccatttctgctacagttaaaattagctggtccaaaaagaggaatgcagatcttactagatattagtctgctatatttcttggcacccaagctacttgtactggtctgaatatgagaatcatctgggaccctttgagaaactggggacagagtctcttttacataacaggatgatggccttgagccctgtggtagaagggcttctcttggtgctgctgtgagtgactcagtgaggcaggtgacaggacctataggtcacagcctttacccctcctcatcacctctccagctacttgctgccctttgtgatttgttttttctctttcaagattgcttttgatttccatatccacataattttacctgaataataataaatgtctcagaagaatggaaatattaggggacagcagtatgcattttcaggtttagggtttggctttggtaaaagtagtgtgcctgatttcaaagctgaagcctgtgtctctcaagagaaaaatacaggctagacttatttaacttgacagtctcaggcttgatgttcttctgatcttccgtcttctctccatctagtcctgaatggcatggaatgctctactcccaagctgacagcaagaagaaatcaaacctcatgatgtctctctttgagcctggcccagaacctctcccatggctagggaaaatggcacagttgggtcctatttcaggtataatccagatcagattttacttatcctgactttgttttcattctgctgttctcaatgtctctgactgtgcagtcagagaactgattgatctcccttactggtatgccatggtctcggatgatgctggatgtgtacggtgaaaacttgaagagagtttgatgtttgaactcctaaattttacagctcaggagaaatcaacatttagattgctttaagtaaatgcaaattcttcagcggc

SEQ ID NO: 80098 - DNA, 1040 bp, Homo sapiens
cattttgacacatatttactgtgtgttggtttgtgaattgacagtggaggtcctctttagagatgagaatgcttagtccctcatccagggctctgcctttcctagtactaacatgctgagaaagcttaagtagttatcagatggttacttgataaatgtgcaagtcaaatacagctttatacacggaagaatcacatctgttctttgttctactggtgcccagcacatagtagataactcagtaaatattgttgaatgaatgggtgaatccaggcccttgtgggtcctccttactgcagcatatatctctaggaactataaagtcatctcctcaaattcagcatctctctggagaatgctagactctaactctttaaaattatctttttcaggggtggcactgtgctgtggtgggtatagagcaggagcttttgtccctgactggctacaggttcaaatcctagttctacccttaaaattatcttttcctctgttttaagctgaccatccactttatatttatcagctttctctaagaactgtatgtagtcagtcaggttttcacatactgagtaatgaccacatcccatttatgcccaggttatctcagttggagtattggatattctataaccaatcacatgttcacagacagaatcttgaatatatacccacagacagctttataatcactgtgttggtaattattattctcagagaacagccagatttcccttagttctaaggccctggggaattctgcatgccagtatacttaccaagaaagaaattaagcaaaataaaccatttatataggggaatagtgaaaagaaaaatacgggaaggtggccgggcgcggtagctcacacctgtaatcccagcactttgggaggccaaggcgggtggatcacaaggtcaggagattgagaccatcctgactaacatggtaaaaccccatctccactaaaaatacaaaaaaaaaaaaaaaaaaacctgggcgtagtggcaggcgcctgtagtcccagctactcgggaggctg

SEQ ID NO: 80099 - DNA, 1028 bp, Homo sapiens
tggacatcaaggctgtaatggtgactgaaacactgataatatccagccctaaaagatttaacatgcacctaagattcaaggagtccacccaccaataggaagcaagtctcctctccactgctccttgctatttttgactcttcactttgccagtctcagttaagcatagtattggcaacacgaaccaggtaaaagctgtggtacatcactttctttcagtcataatataagcagcagtgctagaagagtacactatatcagatccaagaactccaagaccatctggttgattctccctgcctagccaataagaactagaggaagacttcccagggtcacatatcaagagtcatactgcaaagtatagaagctagcccttcttatatgaccttaattatgatactaattaagttcagtatgtctattaagaatcatctcaaagatttcaatgctagtgaatacggctatgatttccaactctaataattcgtggttataattatctaggattggagatcaactgatgaccttaccataaaagaccaatattctgccaccccttaggtaatgaatcttccaatccaaagtgctgatgacaacagcaccctagtacaggttgagtatcccctatctgaaaatctgaaatccgaaatgctcaacaatccacaactattacacatgcacgaagctgacacgaagctcaaaggaaatgctcactggagcactttggattttcagattaaggatgctcaatcactaagtaaaatgcaaatatcccaaaccccaaaaaatctgaaatctaaagcacctctgttcccaagcattttgggtaaggaatactcaacctgtaccacaatatatatttcttttcaaccttcctagacagagaagagagtaaaagtcacaagtcagaagaaagtaaggataacagagaaactaagaaataagtttttttaaaaagttacctgtgttaatgactttagggataggatcaatttcttcatctacaacaaaaggttctggcctgg

SEQ ID NO: 80100 - DNA, 1098 bp, Homo sapiens
tactcctgaatgaaatagctctacctgtgttattttacgtaacattcctctttggtaaccttgagtcaaaattgttgttgttattttcttctcacattggctattaaaaaaatcatctgttatttattgcctatgttatcgtaatggctttgaccttggtgagctgagaataatctggcattttgtgccagccactttaagggtcatctgttttgctttatagctccagagcaccgattccttggaatgccttgaacgtctcatagatttaaacaatggtgaagggcagatttttactattgatggccccctgtgcttgaagaatgtacagtctatgtttgggtgagtatatgcttagagctcttttgccttctttacaatccagtattataatttgacatccaggaagactatctgttttactgttcctaattgtgtcatttcattttccccaagttgtacatttttcagataaagtgatgggtagtaatggttttttaaagtaaatctatactgtctgtagatactgacttccttataatgactcagcaaaatttcaaattaacttgctcttgggcttttcagaattgaaatttcctcaccaaaaatgtcagattttgttctgttttacagatggtcagatcttagttttggaaccaacttgaaaggaaaacaacccttgcgtcctgaaaaattaacttcatatgtatcgtattactcttcctataactattaattatcatattctagaaaactgatagatttggcatatacgcctttccatgctgttctcaagtgtggccacctaactgctgatgtacaagtcttccccaggccagaaccttttgttgtagatgaagaaattgatcctatccctaaagtcattaacacaggtaactttttaaaaaaacttatttcttagtttctctgttatccttactttcttctgacttgtgacttttactctcttctctgtctaggaaggttgaaaagaaatatatattgtggtacaggttgagtattccttacccaaaatgcttgggaacagaggtgctttagatttcagattttttggggtttgggatatttgcattttac

SEQ ID NO: 80101 - DNA, 1069 bp, Homo sapiens
ctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggtacaaaatgtagtaagttattgtatgtacagggcctaaatttattgggaggaaaacagtgttataatgcgttgaatatttagaactttggcattatttaataagtctatgagtacttaatatgtgtaactaaacagcaagaattcacaaccagtaggtcttatgcctactgtttcttcggtacagctatgagttacagctgtgagttgttcccttattttcctctcttggttttctggaattctctgtggaaaagtgagcatctcaggatgtagtgttccattccctaaaatttaggatctttaggctcaacacttaatttttttctactctcccataaaacttgaggaaatgaaaaaatagccctttcttattctagagtaattcaaaatgatatttcctttccaacaaatagctttgattttgataccaataaattataatttttaaatctcagttggtagatattatctttcaaaggtgttttctgtgttatgttagaatttactttctgacaacatctctaaatcataatattcataatatttccagcagtgcctaacacagtgtcttacccatagtgagcagtcaagaagtgtttgtgggccaggtgtggtggctcacgcctgtaatcccagcactttgggaagccaaggcgagaggatcacttgagcccaggagtttgagaccagcctggacaacatggcaagatcccgtctctatttttaataaaaagaaggaaaaaaaaaaagaagaagcatttgtggaattaaactgaacagttttaacaattgttaggtggttta

SEQ ID NO: 80102 - DNA, 1001 bp, Homo sapiens
atgagtcaggggtagaaactccacccctccaggggtgaggttcttaatccacaatgagctgcaggtgtttccaaggacaaactttagtctcagatcacattcatatcagaggtcctaggtcacccagttcactttccaggatcatatacattctttcattagggtcacaagagatacagtaacttctgcatggtcttctgatccatgcccattgtgagcaagagtgactgattcagacagatacaggacaggatatgattcgatcttctaacatcacactgattatcaggaatacaaagtaaaggaggaacattgtgaagcccaggatcttgttcattctccatttacatgacgcaattgaagagatcacaaacagaagcatgagaaaaagcaaaacaattgcacaaaacaagccattgctgctgactggaactggctgtaatccattgataagagagaaaagcaaccaaggaacaggcaagctgcaagattgaagaaacgatgtgaatatccttaatgtttataataatcccatacacttaaatagtagtttatactttacaaagtatttttccaccaataaaatatctatgaagtgaacagaaattattagccccatttcacagacaaggaaattaagtttcagggaaattaaattacttgcccaaggactcattaataactagaagagcttaggttaaaactgaagtattctgagtctgagctttgtttttattttctgcatacttcatgacttctatatgactcagatcagttgatgtgtgcctttttttttttttttaaatgctggaattacaggcacacttcaccacacccagccccaatgtgatatgtactcttaaatctctacattttgataaggcctacatttcttttaattctttagtgatgagggctgcctttttagctgcccctcaccccaaatacacatacacaaattcaaatttaaggaaacaaatctaccacccaaattcagaaca

SEQ ID NO: 80103 - DNA, 1008 bp, Homo sapiens
gagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtgaatcccaatggtattttactttacaacatggatgggctcatccttatctttaggtcatttggtcagaatcctcccgagaagactgatgaagagtatggaatcatgttccaattctatattcttaattatccttattcctgatgctactgcattgctgggtttccatagccaaggcctaagaacaggaggagaaggcaatgcttgtgggagggaggtcccaataccaaaattctgggcactaacctggtgtctgcagcccgttcccgttagcctcggggat

SEQ ID NO: 80104 - DNA, 1033 bp, Homo sapiens
agtgttgtcctaggattgcatgttagtacccctaagcctgagtgtggggagtgagttatgcaagggtagcgtgcactgcccagactgactcatggagccttgtgcaaggagagccagagaggttcactataccatgactccaaaattgtctctattgctaatagatacgtatagtatacagggaaaacagcttataaatccaaatatcaatttaaattttaatattctacatgaaaacttacattgggaaatatgcagacaagtgattatattccaaattttacccttattttaatatctaaaatattgggtatgatgcaaattatactatagaatatttatctgaaatatgacttactggggtattctgttaatactatatataaatattcagaatttttttcaaaagtagaaaaattcccctctaaaagtacagccagatagattttcatccatattgaggaacttagctttttcaacaagcttcagaatctgaagtctgtagaatctaaaatacagaaatatccagaaatcagacaataaattgaaagtttagacatcatgagtattaaatagctttaaaaatatatttttagtcatattatttctaatgtaactttctttgggtaatttctggtaaggaaaaacatcttttggctgctagaattagttatagattttcaatatgtgtgtgtgtttgcacacattatcattagtgaaggaattccctagccagctttaaagaaggaaaaaatggatagtcccaaattaggtgtataaagccagtagagtccacgacacttggactggaggtatcttggagtcctgagacttagaatcagttcagctgcagaaaacccaccttttgagttcacaccattagtgaatagcaccatgctgaaacatttcacagcttccaactctgggaaataatggagagagtttaaaaatgtaaaacttcagttagtttggggctgaacttgcttacttgaaaaatctggtgctaggcacatatatctgcctctcctttgta

SEQ ID NO: 80105 - DNA, 1028 bp, Homo sapiens
gcttaggggtactaacatgcaatcctaggacaacacttgacactagcactgacattttaaaattcattctcccaagtaataaaaaatatatatatagatagatatacacagagagatctgcagctgtactaattacttcaaatagcagcagacaaggaaaatacacgcttgcttgcttaagtttaaattcattttaagtttgctatattaaatttaaaaattaaaaaaatatcaacttactataaacaatttaaaatatgtataatacaacttcatggtcaaaacatttgaatagtctatgaaaacaggaaatacgttcatctgacatttctgtttagattccattcatgatttttcaatctgtctcttccaaaagaaaccataaagcagttgtcatattttatggcaactaattttgtttagggatttcctcatcacaaaaatactttatttcctattacaggggagttaaagaagaagaaaaaagaaatgagaaacaaagtggctttctccccacttgtcactattctcttcttcaaacattctgtacataagctgtctgagtcttttgaaccatttacaaattgtattttcaaaaattgaagaaaaaatatttagagtctaaaagtgttattttatacactgactatacaatatacattgaatgtttacacatacaaatacatcttaaagataaggttctccaaaggtttttcgacattccatcacccctgtacttggtggtctatcacagttgtgtgtactcttgacttgactaggtgtgagacgatcgtatgccatcttgtactctttatcaaaagcatctgcagaaattgataaagaaataaaagaataaagaaatttaggtctgatgttgaaaactatcaagtttctataatactacagaaacacaacattagaggccaagaaggaattgctaggacatttctttatccaaaggaccacagctggattgcacagaccagtgaaacttaaaggtttgaaaatgccaatttttaattttacca

SEQ ID NO: 80106 - DNA, 1023 bp, Homo sapiens
aaaaagtgtgtgtggtatttggtggtttttaacatctgtacctggtaaaattaaaaattggcattttcaaacctttaagtttcactggtctgtgcaatccagctgtggtcctttggataaagaaatgtcctagcaattccttcttggcctctaatgttgtgtttctgtagtattatagaaacttgatagttttcaacatcagacctaaatttctttattcttttatttctttatcaatttctgcagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagactctaaatattttttcttcaatttttgaaaatacaatttgtaaatggttcaaaagactcagacagcttatgtacagaatgtttgaagaagagaatagtgacaagtggggagaaagccactttgtttctcatttcttttttcttcttctttaactcccctgtaataggaaataaagtatttttgtgatgaggaaatccctaaacaaaattagttgccataaaatatgacaactgctttatggtttcttttggaagagacagattgaaaaatcatgaatggaatctaaacagaaatgtcagatgaacgtatttcctgttttcatagactattcaaatgttttgaccatgaagttgtattatacatattttaaattgtttatagtaagttgatatttttttaatttttaaatttaatatagcaaacttaaaatgaatttaaacttaagcaagcaagcgtgtattttccttgtctgctgctatttgaagtaattagtacagctgcagatctctctgtgtatatctatctatatatatattttttattacttgggagaatgaattttaaaatgtcagt

SEQ ID NO: 80107 - DNA, 1029 bp, Homo sapiens
caccatgtaatgatttttttttcccttttccacatggcaacagatggagctaacagactgttacttttatttttaaggacgttataccaaggtctgtgtgccttttccccagaagatagtccacatgtgacaaaaagggacaacagaggtttacaagcttctgctaaaagtttctctcagtctagaaatcatgctaacttattgcttattttaaacacatactggataaaaatttgcccctcagagagccaaatggggtatgaattataacaatgtcactaagatcctatttttctgctttggggaggtgacggacctaagaacatctttcctctctgaaacagtaccacagtggtacccatgaaggcttgttggagttgagtcaagtgcatgagcaagtgagcttctctagcttggaggtccggaattttttagacattcaaggaaatcccacctttggcagagggctagagtaatatctgactacagtctgggcttgtattaggtagggaataaagggatggtaacaaggatctgaataatcctttttggtatcctctgtttcaccatagttaaaaggcctagctcaaataacactattcatgattttggttaagttctggcatctttctcaagtggctagaatgactatcccaatgccatttaatagtctacctttcctaacattttattttttatatatatgtgtgtgtgtgtatatatatatatatatatatatttttttttttttatttttttttttggttagacggagtttcactcttgttgcgcaggctggagtgcagtggcacaatctcggctcactgctgcctccgcctcctgggttcaagtgattctcctgcctcaggcgcctgagtagctgggactacaggcatgcgccaccacgcctggctaattttgtatttttagtagagatggggtttcaccatattggccaggcttgcctcgaactcctgacctcagatgatctgcccgccttggcctcctacagtgttgggattacaggcg

SEQ ID NO: 80108 - DNA, 1045 bp, Homo sapiens
tctgcctaggagaacaatatattcgtctaagagaaggacttacctctgtcttttaaaatgtggacacttattcagtgtctctaaaatctgactcattggtccatagacatcattcattttaatgctttttaccatacttttcaacagttcctggttaaatgagttatcacttttttgcaataaatggaccattggatatttttgggctgtaaacgaacaaaagaacagatgaaggaaaatgttctgtgtagaaaggagaaagaaattaagcagcaactgacagatattaagttacaaagcactaaaaataaattaagggcaatagataaagaaataggaatccaagaatgaagaaagcaaaaaataagacaaataatgacaaaaaaaggtctaaagctttctgtggtcttaaatagacaataactaagaatattgtttcccttaatacagcctctgatgaaaattctaaatcagcagcctgggatggaaacaaataaaaaataagtaaaaagaagaaattgggatgagcaatgtgctgaaagctgaattctgcaaaacacaaccaacccctccagcacatacacagcacccctcaaaaaaccaaaccaaaacaaaaaacaaaaaacaaaaaaaaacccttagacctccatagaaggtagcactaaaaaaatcaaacactcactctcaaacaaaagagtacgactttgacctgtaagacaaaaagtagtacagtaaaataaaagtcagttatacattggtttatgctatttaaagctagtagagattactctcatatgaacaaagtcagcattctatgatggcacttactgtgtgcattccagagaatgtacaagggctgtcccggatcctgatgtaacttcatattgtcccataacatttgtattaaaacatatttgctatcttcagacatacagtggcggggaatctgtgttatacaataaacattcattaatgatccttacatgataatttttcataagtattttataaaattcttataaatattttttaggatgtatatgtg

SEQ ID NO: 80109 - DNA, 1050 bp, Homo sapiens
tagtacttctggccccttggataaggaagatactggaagacagaagctcatttctacaggcagcctgccagctactttacaaggagctacagtatgtattttggtgtatttttttatttggaaattgatcacttacgtatgattttgttccccttgtcttaagtagtcttattagctttattattgccaagaagagtctcttatcccatgatacaattatattacttttctactcatatgggaatcattgaattttttaatggcttagtattattttgcatttgccatttatggtttttatttattcaacaggattctttaggtttagaatggcaccttccaagtcccgatcctgtcactgttccgtatcttagtcctttagtggtatggaaagaacttgaaagcttattggaaaatgaaggtgatcatgcaataacagtagcagactttgtggaccatcatccaattgttttttggaacctggtatggtatttcagacgtcttgacttgcccagtaacttacctggattgattctttcttctgagcactgtaacaagtattcaaaggtatgagactaaaaattaaaaggcaatgaatgcttctgttaccattgtaatgtttgcatattcctaatgattaaaaagtaaggtctgtttttatgctaaatttattttattttattttttgagacgtagtctcactctttcgccaggctggagtgcagtggcactatctcggctcactgcagcctccagctacagggttcaagcaattctcctgcctcagcctcccaagtagctgggattgcaggcacacaccaccacgctcagctaatttttgtatttttagtagagacggggtttcaccatgttggccaggatggtcttgatttcttgaccttatgatccacctgcctcagcctcccaaagtgttgggattacaggcgtgagccaccgtgcccagcctatgctaaatatttttaatagccctctgggtcattagataaatagaattgttttagttgtatttacaaataatattttcttctt

SEQ ID NO: 80110 - DNA, 1111 bp, Homo sapiens
caagtttccctttcaggcaaaaattctggaatggatttagctgaagacgattatagtatataatacactgatgtaatccagtgtttgtgtatagcatctgaatccttctgggttttaattatccaatgaatttatgaattgaaatggtttttaattcataatctgaattaaccagctttctttataaagtgctatcttctcccacaggttctcatctcaagttgctctcggtgtagaacttgtgattgtcttgtccatgatgaggaaatcatggctggctggacagcagatgattcaaatctcaatactacatgcccattctgtggcaatatcttcttaccctttctgaatatagaaataagagatttaagacgacctggaaggtaatgatatttttttccttcatgtttaaggatcatgttccctataatatctcttttctcaaaaagttccttcgattcacattacagatactttctaaagtcaagcccatcaacagaaaatatgcactttccatcctccatttcaagtcagacgaggcagtcttgcatttcaacatcagcctctggtcttgacacatctgctctctctgttcaagggaattttgatctaaataggtaattatgattatgtggaactatattttaacaacatatatttacacatattttagaagtatgacagaaaaattagttgaccatttccaggtttaaatgtctatgaataacagattcataatcttaaattcttactcttaaaacagtgttaaaattctctaatcacataaatctttaaatatgtagttatatgttatgctttattaatccccagagtttaagctgtatgtatatatgataatgtttactagtattttaaaggtaaaaaaaatgtagaacacttgaggtttataatgactatcttttttcttgtctctatctcttcaggaattaagtcaatactactactttttaatatttaattttctacctagggaatatttaataatctaagaaaacatttggagctgatataggaactgcgaaattaaactaaaatttatatagtaagcctaatataagtaaatctacacttaaaactgatgcagaaatca

SEQ ID NO: 80111 - DNA, 1054 bp, Homo sapiens
gtagtagtattgacttaattcctgaagagatagagacaagaaaaaagatagtcattataaacctcaagtgttctacattttttttacctttaaaatactagtaaacattatcatatatacatacagcttaaactctggggattaataaagcataacatataactacatatttaaagatttatgtgattagagaattttaacactgttttaagagtaagaatttaagattatgaatctgttattcatagacatttaaacctggaaatggtcaactaatttttctgtcatacttctaaaatatgtgtaaatatatgttgttaaaatatagttccacataatcataattacctatttagatcaaaattcccttgaacagagagagcagatgtgtcaagaccagaggctgatgttgaaatgcaagactgcctcgtctgacttgaaatggaggatggaaagtgcatattttctgttgatgggcttgactttagaaagtatctgtaatgtgaatcgaaggaactttttgagaaaagagatattatagggaacatgatccttaaacatgaaggaaaaaaatatcattaccttccaggtcgtcttaaatctcttatttctatattcagaaagggtaagaagatattgccacagaatgggcatgtagtattgagatttgaatcatctgctgtccagccagccatgatttcctcatcatggacaagacaatcacaagttctacaccgagagcaacttgagatgagaacctgtgggagaagatagcactttataaagaaagctggttaattcagattatgaattaaaaaccatttcaattcataaattcattggataattaaaacccagaaggattcagatgctatacacaaacactggattacatcagtgtattatatactataatcgtcttcagctaaatccattccagaatttttgcctgaaagggaaacttgcttttaagtgaggatttttttcattataaatcagagtaaaatgtgctgtggttttattaatggaaaagtaaactcaatcactaatttgt

SEQ ID NO: 80112 - DNA, 1054 bp, Homo sapiens
aataaggggaaagactgatacatttgatgatatagaatttaaaacttacatatggcaaaaaaaacacccccaaaaaacaaacttagataaactacttgcaacttatataagcaacaaaggattaactccccaatataaaaaaagctactaaaaacattaaaaaaaaaaaggaccaacaattaaactgtaggcaaaggacagtccacagaagaagaaatgcaaatggtccttaaacagattctcaacttcatttataagagaaatagaaatgaaaactgactgaaatacattcctcacctatcagatggtaaaaatccaagtgtgccaacatagtttgttgacaaggctgtggggaaataggtattctcatatactggcagtgggaatgcaaaataacctgaggaagggaacttggcaatagcacttcaaggaagaattctgaagtatcttccaaagacacactggtaaaaatataacatatatgcattatagcattagaaaaactggaaacttgacatccattaatagggaagtcgctaaaataaattataatacatccacacatgatgtataactataattttgtactatatagctgaaaaaatgaatggggaacattgctatgggatgatatagaatgatcttcagagtatattaagtgaaaaaatcaaggggtaggaaactattgacagtatgttacctttgagtaagaagacagggaagtaataaggaaaaatatatatatatatatatatatatacctatacctatatttttaaaaaagcaacgatggaaggataaaccaaaaatgaataaaaatggttgcttctagggatagggagaaaacaggatgagggagtggggatgaaagttatacttttgtgaaagtgccttggttttattgttttgactttggaactatacaaattgtttacaaaattaaaaaacaacattaaatcataaagaaaaaagtgaaagtgtcacaattcaaatgaaactacaaatcaaatgcagtatgacagaactgtttggacaaaccttccaaggatgcaga

SEQ ID NO: 80113 - DNA, 1079 bp, Homo sapiens
caggcatatgatttgcccttctggttaggatggagtaacttacgatagacttacataccttcccctaagagctaaaagctagatgaaatagagaaagtatctgtttaaagtcatcagagaactgctgaagtaactagaaagcagagaggcaggattctagagaggtgagctgaagttctagagccactttctccctgaggggatttgctcattatgggcatgaagcactaggttgtaaatctaggctttcccttatcagaagttttgggaacttgtgggttagagagacaaaattgaagactttaagggcctcaaatacactgaagattttcttccttcaagacattttccaaatacttgatactgcatgagaagggtaagtagaacgtctgtgagaaatcaagttctcagaagtttcatggtactggaatcataatagctcgattcaggagctgccagagggaggagggcctcagttggaatacttacagaggtatgccttaggaccattggcaaaccagaggtagactaagcctgaccaaaattgcaacctagacttgactcaggttatctgtgatttggttaaaataatcagcttttactctatcaacagagaaaagattgtaccttttctggagaaataaaacatcagttagaatccttacagtttttaatatacaatgtctatcactcaattaaaaatagctatgccaagagacaggaacatagctaaaaaatgaagaaagcagataacggaaagagaccctcaagtgatccagatgtttgaattaacaagggactttgaaataattataatatgttcaagaatataaaggaaaaggtttaaaaaataactgtaaagatggaagatttcactagataattggaatgtattaaaaataatcaaacctaaattttagaactgaaaatgaaataaaaagcaaaaatcttgagccagagagaagagatgcattacctgcaaaggagcagtggtcttctgaagagaaactatgatgtcagaagacactggaaagatatctttaaagtgctgaaagaaaataactgtcaacctatttttc

SEQ ID NO: 80114 - DNA, 1063 bp, Homo sapiens
caatcatagttcactgcagccttgaactcctgagctcaagtgatcttcccacctcagcctcccaagaagcctcccaagaagtgtctataggtgcatgccaccattcctggctaattttttttattttttatttttagtagagatgaggtctcactgtgttgcccaggctggtctcaaactcctgggctcaagtgatctgcctgcctcagccttccaaaatgctgggattataggcatgaatcactgctcccagccccttttgcttttcttaacaatatcttcaacactagatttttatctcattcccatgtatttgtactcacatacagttcaatgattattcagctaaatttttttaaaaattaattacccatcaataaatttgaagaaatccaatttttttgtaaaatcatttagacatttagctctagtgacctatgtatgaatgttctgttataaattctttacagatttctccattgcttagttgaaactcaaactttcaactagaaaggtcatggacttgtataaagaatgtctggtttgtctgtgtcttggagctcatatagtagtgtgaatgtatgtagttacttttgactacagtgtggaaccaagagtaaattatttcaagatcatctctttcttatattaatagagatgatggaagggatagttaacaaactaatgctttaagggtagctaacaaaataatgctttaagttggaagttgtccagaaaaaaatttataaggaaatccaaacactagtatgttgctcctaattccagttgcactcactaaagaagtttctaatagagttttgtttatttttgtttttaccaggtggccagtctgatcttggatataattcattatctaaagatgaagttagaagaggggatacatctactgaagacattcaagaagaaaaagataaaaaagggagtgattgtagttcctgtaggtattgtttaagttgatattgtataaaattgagaacttatattcatagaaaatgcaggtgattttataaaagtgctggttttactttccatttttccatta

SEQ ID NO: 80115 - DNA, 1032 bp, Homo sapiens
atagccctttgcccatgttcagaagaacaaaacaggtactttatcacattcttcatgtaatcaaattttagaacaagaaataaattggatatttatcctcccgtaatatgctttatcacttcatatataactattactagattattatgttcaccaaagcactgtgaagatggagcaatctgacttcaagaaattaactagttctcttgtcctagaactttattttatatgctgtttaatacagattcaaaaagaaacttgaaaacgcattaattacagacatattttgttatggaaacattataaaagcatgtgacttgtacttgtttagcactcagttaaataaagatgcctaagtgcataaatttattagtaagatctttatattttttccaggaaattaaatcagcccataaaattgcaaagaggtactcttccatccctcagatgtggtctaggtgtctactgcgccactgttatggactgtggtttatttgtctcccagcttatgtgaaagtctgtcattcaaaagtcagggctctgaaaacagcatatgatgtgcttaaaaaaatgcagtcaaagaagatggatccacctgatgaggtaacaattattttattgttgttattttatttttttgagatggggtctcactctgtcacccaggctggagtgcagtgatgcagtcatggctcactgcagtcttaacctcttgagctcaagagatgcaatcctcccattttagcctcccagatagctgtgactacagtcatgtgccaccacgcctggctaattttttaatttttttgtagagacagagtctcactatgtggtctaggttagtcagaagctcctgggctccagagcttcacctgccttgccctcccaaaatgttggaattacaggcatgagccactgtgccctgccacaattattgtttaaaatgcattattttattctagatttatgtacatggtgacatctgtgtttcggtacaattttgaacttgtatttcaggtatgctaccgcatt

SEQ ID NO: 80116 - DNA, 1050 bp, Homo sapiens
accgaagtattttgataagctctgtggatcatgaatttactgaaagtttttgtagtgctttttcttacagtatttaagaaaaaaacttatggtaggatttttctattatttaggtgtctaagcacacttaaatggagattaagagtaaagatcaccacattaagctttatggtgattagcaagattccaaagcaactggaatttactcagtataaatataaacttgtgaactatatttaatacaaggttctaccctcatacaaattaatttttgtatattcaacatgccaatttacccctgtaggatttttctcttgttaatgcaaatattttgtttttcatttttcattcaaggtgtttaatcttttcccgtttttatatataacagatatatacctttcccctccaaaagaccatgtaacaaatatattcctgttgttatttaatcttagaattggtgacaagaaaaatgtagcctggaagatacttccaaagaagccatgtaaaaatctgatgaacacactgaataatttgcatcagcaattggcaaaatgtaagtggataacttaattaaaggaggtaatttaatctgaaaaagggactccaattactttgccttacttataaaagaataatgtttatctagcagaaagcggttttaccattttaaaggcagatgatcattaaagcaaaatttgttagaagatgaatgagagatttataaaatgtgtatttttttttttttcgagacggagtctcgctctgttgccaggctggaatgcaaaatatgtatattatatctaccaaatttttatagaaccatcttaaaataataaaattcaaaaggatgttaaggtggtttattttaccgttactgaaataccatggaaaaaatgtggggttccacctttatattgttttttttttctcttttgagacacggtcttgctttgtcacccaggttatagtgtgtggcacaaacatggcccactacagccttgacctcctgggctcaagtagtcttcccacttcagcctcttgagtagctgg

SEQ ID NO: 80117 - DNA, 1049 bp, Homo sapiens
agcactttgggaagccaaggcaggcagatctcttgagtccaggagtttgagaccagcctgagcaacatagtgaaaccccatctctacaaaactacagaaattagttggacatggcccatgcctgtagtcctagctgctcaggaggccaaggcacaagagtcacttgaacccgggaagcagaggttgcagtaagccacgatcatgccactacactccagcctgggtgacagagggagaccctgcctcaaaaaaaaaaaatttccttaccgtatttacatataatgaatgtaaaggagaaattagatgaatgcattttttttcctttggcaatatatgcagtaatggaatcgccagatcaatttattttaaagataacacacccattgcatgttaatataaatgtcttttttgaaaaataacttttccaaaactaaaaaaactttagtgagcagaatggcattgttttacatttttgcagatctctaatgtctagcttaattaaacatagctgggcttccatatatggtctgcattcaatctgttgcagtagttgttttggttgaaatatacaaagaaagcctggcctcccacagatatgtaggtagaaaagggagggattttggatcatattttcagaaagtttgggatattcttttttttgacactgcaccaagcttgacaaatgctggtttcttacaggttatttgcaatctaaaactgtagtagtgaactttgtcagttacattaaaatctattggtctgggcaggtgtggtggctcacacctgtaatcccgacactttgggaggctgaggcaggtgaatcacctgaggtcaggagttcaaaaccagcttggccaacatggtgaaaccctgtctctactaaaaaaaaaaaaaaatacaaaagccagctgtggttgtgggcacctgtaatctcatctactctggaggctgaggcagggagaattgcttaaacctgggaggcggaggttgcagtgagccaagatcatgccactgcactccagtatgggcgacagagcgagactccatct

SEQ ID NO: 80118 - DNA, 1001 bp, Homo sapiens
cccagctacttgggagactgaggcatgagaatcacttgaacccaggaggcagagattgcagtgagccaagatcgcaccactgcactccagcctgggtgacagagcgagactccatttaaaaaaaaaagatttgaaagttaagttattcttttaaggagtggtaattaaagcctgattggaaatgaatttgggagaaagtaggaaataaggaagtggacttaacaaattacaactcttgaggcataaaggattgcagaaaaacctggcaatatctgaaacagattgtggagtcaaaggtatgcacttgagtagatactttatagtttatcatttatacccacagtttggactcagaataaaatctaaatggttgtgacttagctttgtttaaaagagtcaagttttcctcatgttattgctgttgcaaggggaaaaaagtagtaatttacttctgaaagaaaagtggacagtgattccaataaaatattgacaaaacagccaactgaaaatagctagcagagggaaatttgttactacatattagataatacatactagagagctcaaagagattccattttatcaagttcctaccttttaaaaattaaatgatatttctatttttttaaatccagtggggatcagcagtatacttgtgttataaaaaatcggtggcaaagacgaacactgtatcttacaaagctggtaagtgtaatttttcatgcaatacttcatatataaatgtattatagggcccggaaaggttaaagtaaagaaacctgcctagtctgtgttagtatcaggactgggactacaatccgtatcttctgattctcatttttgtcttcacttatatgtttattggatgcttgatggaagattaattttaaaataaggtgagtttttattttaagccttgggtttaaataaataataagatctcaattatctttaagtttttaaatcagcagaaatatggtaaaatgtattttcattttaaa

SEQ ID NO: 80119 - DNA, 1048 bp, Homo sapiens
tgcaagcagactctacacagttgggcaagtaaccttttgtaaaattttaactttggccaaaatgcccagttgctttttctaaagaaggtgcttgttttagagacaaaaaataaattaataactatattaaatgatgtgccaaaataggtaccttcacatttaattgtacctttctctggtttatattaacaaacacaatggtttgtcagaatttttccttaaaacaaagtttttggtggggaaaagagttattctttaattcatacaagaccgtgcattttaaaattgcagtaagattggaatatttttaccatgctactacatttaaggatcagttgatgatgcctgagaatattacttttcatatttaaagtgctttgtgtatttatttttaaaaatttatttttagggttttatatgactggaaagaaagattgaaacagggttgtgaaattattcagagtactccctatgggcgccccgcaaatattagtgggagtacctcatcacaaagaatttatatcacttaccgaagagcctctgaaaacatgactcagaatacgttggctgtcactgacatatgtattattatacccagtaaaggagaaagcccaccacacacgttctgcaaagtcgacaagaatctcaataacagtatggtaagtgacttacttgcactggtaacattaaccactgatgaaaagagcataattttaaatacatcttttttttttttttttttttttttttttttttggaaaacagcatagtttaattacagaattgaaaaatgtgtttttaaagatattagatattttacttttcggaaagtactttggttgtactttcaaaagaaactatgcaaagtacttttttttaaattaaaaaaataatatcccccaccccccccgcccactacaaaagcaatgagtatccttccacttgtgactagatcccacacctcaacgggactagatcccacatctcaatttacccatttgaagacatggctttagcagtcctccctacttttttgtaaatcattggt

SEQ ID NO: 80120 - DNA, 1228 bp, Homo sapiens
ggagtgcaatggtgcgatctcagctcaccacaacctcttcctcctgggttcaagcgattctcctgcctcagcctcccaagtagcggaattacaggcatgtgtcaccacgcctggctaattttgtatttttagtagagatgggttctctccatgttggtcaggctagtcttgaactcccgacctcaggtaatctgccctcctcggcctcccaaaatgctgggattacaggcgtgagccaccgcgctcggccaacctgagagcgcttttattattaatttcttagtttgtagtttcctgggaccatccatatggtttaagtacaaaccccaaacccaagtgtgaataggcctattgttaggaattctcagaggagactcccccgctaccctccctacaactttattatctccctgtgtcagtggataggtcttttaaaaccactctttggctgggagtatagtcctttgaaactctcagctttatataggtggctcagttccaattctctatctatgtggtctgaagtgcttatctcccatgcttttaatgccttctaaaacacaagccggatcaggtgcagtggcttatgcctgtaatcccagcactttggtagactgagatgggaggatcacttgaccccaggagttcaagaccagcctgggcaacatagtgagacccccccccccccatctcagaagaataaaacaaaataaacacacaagcctcttgattattgaggagatcagtaaatttccccactcagtggtagtttacagactgcattctgacttttggtttcttcagtgttttggggacctaggaatttcccttacattcttacaagtctgtgtaagatttatatttaaaagcgtttactgaacgactgtgcatttatttatttatttatttatttgagatggagtttcactctttttacccaggctggagtgcagtggtccgatctcggctcactgcaacctcagcttcccggattcaggagattctcctgcctcagcctcctgagtagctgggattacaggcacctgccaccacgcccagctaatttttggtatttttagtagagacaaggtttcaccatgttggccaggctggtctcaaactcctgacctcaggtgatccacctgccttggcctcccaaagtgctgggattacaggcgtgagccactgcacctggccagactgtgcatttaaaaagatctctttttgt

SEQ ID NO: 80121 - DNA, 1019 bp, Homo sapiens
ttataacccaggcagctattttctttttttctttctttattttgagacagcgtcttactctgtcgcccaggctggagtgcagtggtgctatctcagctcactgcatcctccgcttcccgggttcaagtgattctcctgcctcagcctcctgagtagctgggattacaggcacatgccaccatggctggctcatttttgtatttttagtagagatggggtttcaccgtgttgtccaggctggcctcgaactcctggcctcaagtgatcctcctgcctcgtccttccaacttgctgggattacaggccaccgtgcccagccccatgcagctattttcttactaccctggggtagcatgatttctctgagtcttcctgcttttccacttcatttttcttactttgcatgttgtctttcaccactgcacgtggatggacatgtcttctaactcttaaattcatatattcgctcatggttctgtgatttcattctgaacctctgggagaaaattgagtctgaggcaggtatctctttctggtctaatcaactgtggccgatgaagccaaaggttcataaaacatggctttcaggcccaatttttatggaaggggaatgatacaggacatacaattctcagaggataggtgtgtaggtaaatagactttctaaaaggtggtggatacaaagggatacttaatgattaaaaaaattatgatttttatgaaataaaaaagttactgctcagtggctttatatatagtaggaaacttaaattatttcatccccaatctatacatgattattgtgaagactaaaaatgtctcccttttttaagtaaaaaacaatggaggtgattagcttctgcatacagaattggaagtttgagtcattattttatgagcatatgtgtatgatgatatataccttctttaatattaataccattaatacatcacatcattctttatttagcaaacatttattgactgacttctctctgccagggagtatgctaaaacag

SEQ ID NO: 80122 - DNA, 1430 bp, Homo sapiens
atctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcaggttagtgataggaattccatgatatttcttaccattgtgtcttgtggttttgataccttccaatgagagtaataggttataatagtttcagagaggtaaacatgaatgcttagcaagaattgttttgaaagtttgtgatgactgtatagcttttttgctttgagtcattaaaacactaatattttgctgccaaaaaatgaatataaacattgtatattctgtctctttttctgttatgtttctgtgtttacaaaggctgctgtacgtgagctctatgtgagtgaaaggcagaggctcagggagtgtcagggaccaacagggatgcagctgcttaggagctgtaactttttggcttcataaagaattcacgtgtctcttgcccctgttctggtagggacagcatgccagaagacaacattgtgcattgtggctagtgaaagtcttgcggccgggcgtggtggctcatgcctgtaatcccagcactttgggaggctgaggtgagtggatcatgaggtcaggagattgagaccatcttggctaacatggtgaaaccccgtctctactaaaaatacaaaaaaccgggcgcggtggcgggcgcctgtagtcccagctactcgggaggctgaggcaggagaatggcgtgaacccgggagcagagcttgcagtgagccgagatagcgccactgcagtccggcctgggcgaaagagcgagactccgtcccaaaaaaacaaaacaaaacaaacaaaaaaagagagaaagtcttgcctttgcactaatgcttatgctatgaataactttctgtaacagttttttaaatttcccatgcaagaatagctttattgtaaataatatggctacaacatacggaatactatagccaatgtagttgatggagaggatagcaagagatggaaataactgggcacttgatacatttttaccacattttaagtggtgtcattcgtcactagtgagtagtacttagatataacaagtatttattttaattaaggagccaattgacaatttctcactttttttttttttttttttgggagccaggatctcactctgtgacccattctggagtggagtggcacagtcaaggctcactgcagcctcgacctcctgggctctagtgatcttccacctcagcctcctaagtagctgagactgctggtgtgtgtcaccacgctcagctaatttttagtattctttatatagagagagcaaaacctctctccagtgttttgccatgttgcccaggctggtcttgaactcctgg

SEQ ID NO: 80123 - DNA, 1049 bp, Homo sapiens
actgtcccagaagttgaggaggtcttaagttttaaaaagttctgttatttttccttttgagggcttgagtatatcctattccttgttttaaaacttaacaagactgaacttttgtgtctcccctcagaaaagaatggtttgtcattcattgaaacttcggccctagactctacaaatgtagaagctgcttttcagacaattttaacaggtaagacttgtattttcagattacaccagtaggactagaagttttaggaaggtaatttaaacaaactaatcagtaactaaactatatatcagccgagagtgactatcatttgagagctactctagcaaaagctgtttagagtgcaaaattaactacaacccttgctcactgagcttcagttgtcctaattcatctgatttatagtgggaaaaatactttgaaaataattcattcacttccattattacttcagtccaggtattccattcttcatggtcacaaagtaatgtttaaatgtacttttatgaggtaaatattgagatcccagctatagaaagatataaatgcccttttttaaatttagtaaaggcaaagctagggaaaaaacatttttaaaaattatagcgacaaaataaaattctcccatgatacagaagaagggtatcccttgcgtattctatattgtatcatgggagataattggtagataaaatcagccaatgattgcatatagaaaagttttaaaaagtagttggaaagagatggagttcatgctgttttggaatgtgaatgaccaggtcagcctctgagataagaagtgttcactcatatttatcctgaaactattagaataaccagatttattagtaagattagtcttaatcttctaattagtactttgatgggttgtttttaaatacttttaaattgtatgttacttttaagaactcatgatttaaaatgtggtcttaatatatagtatagttttacgtggcattgttctaaaaagtctatacagagatatgattgagtttccaattataatgtaacaagttttgat

SEQ ID NO: 80124 - DNA, 1078 bp, Homo sapiens
atgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatg

SEQ ID NO: 80125 - DNA, 1050 bp, Homo sapiens
aactttatttcatgcacaaaattattaaaaatattgtataaaattacctttaggctatgtgtacaaggtatatatgaaatgtaaaatgaattgcatgtttaaacttgggtcccatcccaaagatagctcattatgtatatgcagatattccaaaatttgaaaaaatcccgaatttgaaatacttctggtcccaagcattttggatactcaatctgtatttacattcatagtatctatctccccctccccttgacagttccatgtcaggacaattagggagggccatctaaaaagagtgagagggctagtcttagggttcattctggtgtagcctggggagctatgagaattactatttaaattttaaagttttttattaaaaattatacagaattatatattacaattatataaatatatacttatatataattattatacaaaagtataaaagtacaatgaacccccctatgtatccatctcttcatagaaagagtttccatctcctgttgctgcatattgattaaatgggcctcttctttcttccctctggttaaatgaatggctaatgtgtcattcttgagtgcacaacttgcagcaattggccattagttatcattcatagtattgagtaatattctgagacttgtaatgcataatcttacactactgtcagtaaatatcttttttagtcttaaaactctttgattatgttttgtctttaactgagatgtcaactcatagctcttgagaattacctattagtaatttcttctgaatgggtcttcagaatgtgagggttatgtacatatgaggattatatacaaacctttggaactatgaaggaggaattttaaacttatttgaatgaactcagtaagccatattttagcatctgtattttattacaaaattaatcctgttgcttctttaccagtttgatcacaagtttatgtctttaaagtttataaaatagatatacccatagtaactatactggatgataacttctactagtggaaagctattcattgcattatagaaatgaag

SEQ ID NO: 80126 - DNA, 1936 bp, Homo sapiens
agatttttaaataagttttgaacatgaataaaaatatggtgctcacatttattactttaaagaaagagactcgtctatcaaaaatttgatacaagtttttcacttattttcaaacatctactagaataattttcattcttccaggtgttcaaagtgcccaagcaggatgtaggttagttctacccttaaacttaaggtgtagattataagcacgttttccatttgcaacacaacagtaggcattcttgttaaattagtttgagaaatttgttttattttgtacaaggtacaatccctctgcacagtgaacatatattacaaatctgtgatttaaaaaagtattgccgtttcatagtctcattaatacctctgtacaataatggtttttctttcattcattttaattgtacacatattaattttttgaaaatttagtttctgaaaaataattgaacagatctttcaaagtcacccataaaatgcacagtatacatgtttaggctgaccatgaacctatttgtgatggtgttagacagaagtttctaacagttgctttgtaagattgaaatgtcttttactgataactgttcgataggggaaggcagctattgtcaccataatcacaccctctgcctttcccttctcctctgtattgcctggtttgacttgtattacatttccttaaaaagtcatggactgctagagctgaagggttagtagagctgtcttcccactctctgcttctcccctttttatgcataggaaaaaagggagcccagagagggcgactaacttgaccagagtaacactgaaatctcttgattcagtgtctagccattccacctcttgctgaatacctttgcccagaggatagttgacaaaagcggcgaaacttcaaacttgagtgatgctgcttgtttgcagtttgccaggcagcagttattgtacatgcaggataagggaagaagagaaaacctgggattgagttgaagtttctccttgctgatctgacatcttcatgctgctcatccttgcttcacaaacacttgctgccctgaaatactgaggtaagctgcttacctatatttctttctacatatgtatgagaaatatttacttgggtctccaaagtaattttctaatatttatattttaataaggcttttttggaaagtaaatttactattgctactcagttgctcccatgcacacatgcaacattcatgtaagtattacatattttcctctaacagtaaaatctgcttatgccttgagtgatgtgggaaggggagatgtactcatttatttatttttttgctttttctgattattgcccaaagtattgtgttccatggcaggcttccagtttctatcaagggtttcagaactctcatacttcctgtagcagtattccagcttcgcagtcatttagttcctcttctgtgtatctttttggaagtgttttttactggctggactgtaccagtgaatagagtggtacaggagtagccgttagcttcctaggtttgccctttttgtttttaattcttgtgagaaggttctctttagggcttgggagttgatttcatttcatttggacttatctgagcctcagtttatctgtgttcatagtggaaggtatagacacatctgaatactgggatctggagcattagctcattgtaatgcatattgggctagctcagtaagtagtagttttaagatagaaggtggaaggacttcatatcctcatgctgtttacagtaacgtttttacatcacgttacagcaactggttacagtccattctttttttgatcatttagttccattaaaaagcataatgtactttaagcagtgtaaacttgctgtatccacatttgtccaatttcctgtatacttttaggtttcatactacgtcaatctcaagatttatg

SEQ ID NO: 80127 - DNA, 1072 bp, Homo sapiens
cgtgcacgtgcatgtgcccatttcccacccccagtatttgtttcatattagtcctggtgttttttaaagcagagttggtacaataatttgacttcctgcattagctaggagggtagtcctaggaaagacagttcaccttagagatgcctttaaaagcaacaaaagaaggatgtgtggtcaaggtggggtgagtggagagggcttgcttttacttcaaatgctgcactattgccctgatttcactaagttacttatttgagacacctaccaacttcatatatatttttattagatgtcgacaaggatggcacatctgtgtacggagaccccatgtgcacaggcgacttcatttctacatagctgctttctggaagcttgcaggtgaggatgggtgggtccttaattgtggcgtaagggttttcactgctattcaaggaacaagtactagaactgcacacggattctttcatgtaatctgcaaggcaagagacatttcttaggacaagcaagaatacaagtcttcatgttaatatcagaagcagactgcagttgagtttatgtgccttcaggatcttagagctggaaaagccaggataatccaagatttatttacttattaaatgtgctgagaagtgctctcccaggtaggcagagttctttttccaaagaaacttatgtttttggaggataggaacatttttgtttttagtagttgggtattaattcaagatatgcataatatgctttgacatgtatttaatttttgtaaattcctgcaagggttgctgatagttgcattttatgagatcaaggctcagagatatgaagtgacttagctaaagtcacacagctagtgaatggcagtgccaagaattgaatccatgcctttggactccttggcctgtgcattttctgtgatgatattcttgtgaattcttcttttttgagatgttgcctaggctggtctcaaactcctgggcttaagtgattctcccgcctcagcctcctgagtagctggtattatcggtacgtgccaccacacctgacttgaattgttttcaatgactgagaa

SEQ ID NO: 80128 - DNA, 1067 bp, Homo sapiens
tgagaggctcatgctgcatacctctggacacccacctgtgcctgtgcccatagacacaaaacagtggggagcagggccatggtgggagtgggaatctcaggactcctagcttcccataatatccattcagggacaaaagcatggctttcatagtccacggctatgccctagagatctaggagtcctttcttccctgtctgtcccatggagaatgaccatcagcctacagacctggtccagcaatagtaatatagatactatacagcctcaagggcaaccactatcaagccaacaccccaaggccactctcagcctccaccctcttttggtaaggggctggaattactgcagagtagccaacttggtgaccctctgggtcacctcagcccaggggcccagagtggctctctgtggttaaccagtctaacagatagggcatctgcagcagaggcaggcagctgtgatgacatggaaaggacacggcactgggaactgagttccagacacagctttgtcactgactcgtgtgtgttcatgagcaaggcacgcaagtcaggactcaggtcgccatctgtgaaatgaggataaccatccttgcctcatatgaagggcagctgtgaaaatgcagagaatggaaggactacaatataagcctcaagacactctgttctgaagctttcctttggtcgcaggaaaaggaaaatctcacattcagccccaatcaggatcaggtggcagaggtgacagtgatattgcaggcagcctcaagacttccctctgtgctggagatggcctcatgttgcagctgagacatcaccagaggcccctctcctaaagctcagccccaccccccagctaatctgcttcctctgtcagggccagcttggctcaagctaccccaggaggcctgggaaccctacaacttcagcccaacagctggggtggggtatgttctattcccactagcatcaaccacaccatggtggcctgtcatggaacacctagctcgccctttctctcaacggcctaggacccaggtgggtcaggattattacagggtgtgtgca

SEQ ID NO: 80129 - DNA, 1024 bp, Homo sapiens
ctgggtcctaggccgttgagagaaagggcgagctaggtgttccatgacaggccaccatggtgtggttgatgctagtgggaatagaacataccccaccccagctgttgggctgaagttgtagggttcccaggcctcctggggtagcttgagccaagctggccctgacagaggaagcagattagctggggggtggggctgagctttaggagaggggcctctggtgatgtctcagctgcaacatgaggccatctccagcacagagggaagtcttgaggctgcctgcaatatcactgtcacctctgccacctgatcctgattggggctgaatgtgagattttccttttcctgcgaccaaaggaaagcttcagaacagagtgtcttgaggcttatattgtagtccttccattctctgcattttcacagctgcccttcatatgaggcaaggatggttatcctcatttcacagatggcgacctgagtcctgacttgcgtgccttgctcatgaacacacacgagtcagtgacaaagctgtgtctggaactcagttcccagtgccgtgtcctttccatgtcatcacagctgcctgcctctgctgcagatgccctatctgttagactggttaaccacagagagccactctgggcccctgggctgaggtgacccagagggtcaccaagttggctactctgcagtaattccagccccttaccaaaagagggtggaggctgagagtggccttggggtgttggcttgatagtggttgcccttgaggctgtatagtatctatattactattgctggaccaggtctgtaggctgatggtcattctccatgggacagacagggaagaaaggactcctagatctctagggcatagccgtggactatgaaagccatgcttttgtccctgaatggatattatgggaagctaggagtcctgagattcccactcccaccatggccctgctccccactgttttgtgtctatgggcacaggcacaggtgggtgtccagaggtatgcag

SEQ ID NO: 80130 - DNA, 1119 bp, Homo sapiens
atgtccctctggcaagtgtgccagagcccagtgcatccatgaatgtggttaacagctccaataggcattttatttgggagtctgagtggggtcaagatggggctgctgggcgatatccttcctttcccctgaaccctggactgctgccttggaaatacgaaaggttttttgcttcatattggctaaacagtagaggccaaaatgctctgaaattgccctatagtcctgggctatgtgaggctgagcctgtctgggtgagcacaaggtgacagctctctccaggtagctccatggcacgtggctcatggctcatctgcagcctcctgcatcttgtgcttagaaaacccagatcacttcagcccattcctgctaagtgttgccttctgtatgtccagcttcatgctaggcactgcaggatagacagaggcaggccagtgcacaccatgccttcaaggagctcctggtctacatgccacactacagccaaagcagacatcccacacacagatttggggattttcttctatgactatactgagaaggctggctagggtttcctatgccattcctctggtattccccagccctatggagaggttctggaatccttaggagggaagagcagagtcagaagtgaggttctctttatgatctcattaccaggatgtgaccctagaaggaagcaggtgagtccagccctaaatagggactcagggacatgtaaggctatcaaagcaaacatgccccatccaggctccagttgatagtgcctccccttggcacaggtgagcctatcctgcattctgcatgctgcagggaggaccagcgtaagggaaggagcaaatcaggctctccagatttcagtaggagtagtggatgccaggaagcttgggggatggggtacttgcctgtttgtctttgcagggctctctcaaggctcccagcgcaagcattagtactgggggtatctcatgccaggggcaggggtatgatggtatgtggcaccttgttctcttcccagatttgtctcaaagtagcagccatgcccactgcttttccaattccagctaccacgcactggcatgtggggggcctgccaccagccaggccagcactctg

SEQ ID NO: 80131 - DNA, 1051 bp, Homo sapiens
ctgtgtgtgggatgtctgctttggctgtagtgtggcatgtagaccaggagctccttgaaggcatggtgtgcactggcctgcctctgtctatcctgcagtgcctagcatgaagctggacatacagaaggcaacacttagcaggaatgggctgaagtgatctgggttttctaagcacaagatgcaggaggctgcagatgagccatgagccacgtgccatggagctacctggagagagctgtcaccttgtgctcacccagacaggctcagcctcacatagcccaggactatagggcaatttcagagcattttggcctctactgtttagccaatatgaagcaaaaaacctttcgtatttccaaggcagcagtccagggttcaggggaaaggaaggatatcgcccagcagccccatcttgaccccactcagactcccaaataaaatgcctattggagctgttaaccacattcatggatgcactgggctctggcacacttgccagagggacattgtccaaactttcagacctcccaagtcaggtactgtccccttccgctgtactaataggaccctcctaactgggaactgggaaggagggttgtcctgaggcgttcaccagggaaacagaaatggatgagctctgggcactgggctccaaggtctagcctcctgaggtggtacaggcatcaggttggggagacagtcctctggagagcttaggaaagtgactggttagtgtgggtgctcctgaggccgaaggctggtgagaaggatagggaagctctgggaaaatggcaggaggctcccaaccacagctgctcagagctagggactcaggaaacaattttcccttggaaccccagatatcttctctaggtaggctcctgctccccatccccactgtcactctaggggagactgagcttccacattcagccacagcagccaaccctacaggcacaaccattcctggggtatgtgtgtgtggaggggaagaggagggaggccaggagcatggcccttacctgagagggagtagtcggtgctggtcatc

SEQ ID NO: 80132 - DNA, 1040 bp, Homo sapiens
ggatggcaataggcaatgatgtgtggaggcagctcctaccttctcactggttgttcaatatttgggaattttgtgaatgatgttaaaccattggtaccttaaaatcagccgtggtaggaatatttatattttaaaaatctgcagatgttacagatcagggtttttcccccacaaagagctggtagggtggaacaccaatgcaaataagctttatatctcttttcaactcctgctgagtggtagcagttcttggagtcggtattgtgaaggattctgaggtcaagtcaggaaagcatatggggagggattagggatggtggcctgaatatgacggggagaagggcttggaagttgccatctccagccagagccagctcctctgcactcccacagcattctctgcctttacccttggcactcggcacagaccacatggtgccacttctgatgcagatctctgtgcttgtttcacttttcatcccttcagcatgcatgtcggaatcagaatttgtttctgccacttgctagctgcgaaatcacagacaaatcatttcacttctgtgaggctgttaactgtgttagggcctttgtctcatgccatgtggggctcaattctcataaaggcagcccaagtcctgaagagggaaggagctacctccatagcgtatgatgaaaatccccaagcccttccttccctgccactttcctcccagaacctctcacctccccacccagtaccttcccactggagacagtaccttggttgcagagagctccagagaatcctgggaggcactcacagatgccgctgatgtggtggcagggcctgctgctgtgcacgcagagggggcatggctgggcgcagccgtggccatagaacccaggggggcagactgagggtgaagggaagatggtggtcagcagcccaagagaccccagccagcctagctacccttcctgttccacacttctcagaaacatggggagacctgcatccttccctcatcttggagggcgcatccctttctgcagagaagagc

SEQ ID NO: 80133 - DNA, 1121 bp, Homo sapiens
ccaggaggaagaaggacccctactctgacttttctttttttcttttgagatggagtctcactgtgttgcccaggctggagtgcagtggcacaatcttggctcactgcaacctccgcctcccaggttcaagtgattgtcctgcctcagcctcccgagtagctgggattacaggcacctgccatcacgcctgatttttgtattttttactagagatggagtttcacctcgctggccaggctggtcttgaactcctgacctcaaatgattcacctgccttgatgtcccaaagtgctgagattgcaggcatgagccaccgcacctggcctgagtgactcttctctccccttttctcacacacacgcattctctcactgtcctcggctgcttctgcccttcactcctccctcccctccccgcctcagcccctcctcttagcccccctacttctgacttgtgtgtggaggagagtctaagctgaatggcctcctgtttaactcattacaagtaaactggatgatcttgaaagatgactctggtctggcacaattttcctgaataaactagcttctgcagggttggtgattattggtgcttaataattgtgtgttgaactaattgattaattaattggaggaacatccttgatctccataagagaaatgactgtcgggtatgcgcagggctggaagggcagcaggagacaagagcaggctcagatctgttaaaaacctaagactcatgcatgtaattttaagttatataataccacaaggctaatactggggggcaggggagtcccctgctccatttacaaatcctgctccctaaaggcaacactttcaaatcttttaggtatttcttctggcatttccctccatttttctacataacatgctttatagccgtttcttgacttttccatcttagacagtcattgaatccattgactttctgccacagaataagattcagctctgtcatacacacccatacaaacacgcaacccctctcccaccctcccagtggagttatattacaatttgtggttaaatcatttaaaaaagttttaagacacgggatttggctgtgtcgcccaggctggagggcagtggctattcaca

SEQ ID NO: 80134 - DNA, 1023 bp, Homo sapiens
agggcatcactaaacgctgccagtggtgccatggacacagctttgaatcccaggtctgccatctctaagtgctgtgtggtctgaagcaagttactcacctctctgagcctgtggtctctcgtgtgcaaagaaattgaattcttcttgtaagattagctttgtctttgggtgtgagcacccacatgagctgccacaggccctgggccagaggtggcagaaaaggctgggaaaggaggagaaacagcaggtatggatgacctgaatttatctaacttcgccccctgcacttgcacacacacacacattctgattctgtgggccccagaatctgtattttaacaggtactataggtgattctgatgtagcctgaagcagcccaggtctcatgtctgggaaaaaccactgtgggaaaggagggtaagatttgtaacctcatgggcctaaattcaggtctcaaagccaatgttgaccctgaaaaaagcctcaattactccccttcccccaagtacaaaactgatataacaacagtgagccctgccctgcccagctgccatggttggaggctggctcatgtgaggctgtgcatgtccaaagtcttttgcaaactctgaagccctctatgatagcttgatttctatccctgggtgccacagaccctccacaagcctccttttagccaacataccctgcctgtcagtgcctgcctcgcagaccaagcccttacaggcagtgagtcagctgaagctgaccttcctgggctgcgtccctgcctctgactctccagtaacacgctccgtttcaggggaagctcagcgacacagtccaccacctcccctggggcctgaggctttgcaaagccagagaggaaagggctgctgagcagaagcaggatattttaggaggctgcgaatgcagaggtcacagggacagatgggaggacacctgcagggcccatcgatgcaggcacagtcttgacagaatttttttagggcaggaaaggaccttggggaccacttggtccc

SEQ ID NO: 80135 - DNA, 1172 bp, Homo sapiens
gagggtgcctgggtggggagggtagaggaggtggaggggctggggcggggcctggagtggctgccctcaccgcagctgcacgcccagccctgggctccttgtgggtgggctgggtggtgggaccaggagggatagtcttggctgtgaaatctcctgtgagtctaaatgcccaggcctcacccacgcaggtctcagattccttccttccaggaccgcgttgactggtccttcctgagactgcccgagtgggcactccctaaaaccctcccaggaggcccttcctggcagagacagcccttatcttgaaagtctcttctgaccttacccaaatgatgctgctcacctggggccttcccttctagggcatttgggacagagagaggtgagggtcctaggcagataccatgtacagatttgggaggattactctgcctgttcctctcccctactttctctccccagacaccaaacagcccctcattccagttccccagagagtagtattgacaggagacctacaagactgcttagctgagaccccctcagaggcaagattgaagttctcctcccaaccctgtagcagactctgtggcctctccaacagcctagatcctgaggggtggccaaggactctgaccacagagacgttgttgattgagggtgttccctaccccgatgtctggccagctcccaagtcctagtgagctagaggccagggccattggatgaaggcccaagaccaagaccccatgcaaatcctgccccacccttcaacagcacccagtccctgcaaatgagcctgtcatgggagctgggagccttcctgagcctggaaggaacgtgctccagattcttcccctctctgaatctaggtggattcttaaagatgggatccatgagcacttctcagtgccttcattaatgcaatgactttggcctggcatgcccttccttccattctcctggttaaattaacttcacctttaaggcccaagtaaaatgccttcctccttgggaagccttcctcagcctcctccccagaatactcttctgtacactaagaacacttaagtcatcccacaagtattggcccaagcaccctacattccaatgtattcagtctgagccttgcttccccctcctggcagggagcaggactgcagttcagcgga

SEQ ID NO: 80136 - DNA, 1047 bp, Homo sapiens
agtttgcaccactgcactccagcctaggcaacagagttgagactctgtctcaaaaaaaaaaaaaaaaaaaaaggaaaaatcagccaaagcccaatataattaggaaggaaagcctgggacagaaaaaaagaaatgtgtgaggggtgacattccaaggccaaattggtaagagtttgcgattctctgtgaaagaatgcaaagtcttcttgtaattataatgatggtagtttttagtcaccttcagcagagttgataattgactcgctgcagctctgcctcatttctctgtcattgctggagaatgaggtgttttaagtgaattttctagataactgaagcttatccctgtgaaccctaacattgtttttttttgtttaatcactctggtgggaaatttctctggaatgaattacacacttctctgcttccttaatcagaatattctaaattgaatgtcacttcttcctgtcaatttggatatgagaggctatttgcccctatattaatggctgcaagttgctttgctttttttcatctataaatgtttcctatttccatagtttcttactatgacacagagctcttgctcacatactttttaggagccccataaaacatgcagacattgtcctgagccacaatctcagcactttgggaggctgaggcaggtagattacctgagatcaggagttcgagaccagcctggccaacatgatgaaaccctgtctctactaaaagtacgaaaaattagctgggcatggtggtgggtgcctgtgatcccagctactcgggaggctgaggcaggagaatcgcttgaacccgggaagtggaggttgcagtgagctgagatcgtgccactgcactccagcctgggcaacaagaacaaaactctgtctcaaaaaaaaaaaaaaatgcagacacaaacatacacatgtgcatatacacacacactcacatgccagtctgtgttgtgagaaagcagagtgccaggcttaatagaattgtgtttacatgtccttctataatcccctgagctgcccttattag

SEQ ID NO: 80137 - DNA, 1047 bp, Homo sapiens
gccctctgtgccttcttttcttttcttttcttttcttgagacagggtccacctctgttgcccaggctggagtgcagtggcacaatctcagctcactgcagcttctgcctccagactcaagccatcctttctcctcagcttctggagtagtagctgggaccacgagcacgtaccaccatgcttggctaatttttgtattttttgtaaagataaggtttttccatgtttcctaggctggtcttgaactcctagtctcaagtgatccacccacctcagcctcccagggtactaggattacaggcgtgagccaccacacccagcctgggccatcatttcttttgtttgatgtttaccctagcatgcacacagggaaattattcaacttttccctgacaaggagaacctagcagggaatcaaaatatttgaattgagggggagccatttcacttgcctctggaatatgctatgtggtataaatgtgtgactttattttcctgagtttgtcccaagtatgggcttggctgttgcttaaggctaaacattgcataagcctcatgctgctagtgatgcatgtaaacgctgccgtcaacataaggtagtagccagggctagccaaagtgcctggtgactcacgtgtgctgacctatgagtcttcctaagttagcacactcagtgctggcacggtggaccctcagccccaggcaggtcaacagcgtgcagccgctgaatccgaacctgaattagccttgctgttagccactgagccaagaggggaagaattcaaaccaggctaatagaaagaatgtggtgaggtaaacccctgggtgagggagagggagggggcttgtgtttgtttgcaatattggatcagtgggctcaatttcctctgcttccaagggaaagcatgaaggtctccctcccattatgtgtccacatgtgcacgcttccctttcttggagactggaggggctgccagcagggagctgcccttggctgtctcccagccataaagcccacctctccatgttcactgctctgctctttaga

SEQ ID NO: 80138 - DNA, 1712 bp, Homo sapiens
ttccggaaacagcgccaggccccctggaggagccggtctgctgctggctgcggggctggaaggggcttgcggttccctagcctccctcagagctgctgggttcctggaggagaggcttgtgctgcccccaggggagggagggcaaaattggcctaagaccaaggcagccgcaggaggggccagcctcttgcaaatgaaatattcatgggggttattgaatcaagttttattggaataaaaatacacttgctgaatacatttatttcccctggttcctttcaaccccattccctccctgagtgatttgatttgggggccacagaaggtttttttccccaagtaaattagacttcgttcagcagcagaaggatgccatgtcaggattggtgcttggcaaggggagtgctgtctgcggcctctgggaggactgagggcccagaagggaagggtcaggaggtcaagctcctggttcccacgcacaggccctgtcaccaaaatcatccacactcgctgcaccctcccctctttcttggcctccctgccccttgccacttatgagggaccaagcctgacgtgtggagacagggagagtcccacaggcctggagtcgtggtgatgggcctcactgtcagatggaccttccgaagccatctaagaggtccccatctggggggcagagcagatgactctgccctctctgccaaatctctcttctttctgcgtttctcctcctcaccttagcgttcttggtttctttctcttctctcctgctctacacatctcattctggcttcccggcctctggcctctctccagggtcagtctctctccaaatgtttcttttggtctcagtatctctttggctgtgtctgtgaaggtctctttttcttcctaacctcacactcagcaccattccacaaccccacacacactcacacagagtctcatgcacaggtgcacacttgcacacgcagacaccctcacccacgcataggcaggcacccgctcgcacacactcacacatgcgctcaccagcttgcacacgcacaccctctcccacacagtcattcacggtcgtgggctgctggctgactcagcagatacagccagggtcttctgtccccactccctgccctagagtgggcatctggggttcaccttactcttcatgcactgcacagaaaccacagcggggctgagtccaggccaccctgtgctgcctgtagccccactctcttatttcacagggaggagtcggaggggagagcctagaggaaggagcccagccacaggtgtcacttctcctgaagagcacagctgggcaaggcggaaggactctcccaaatgggcagggccactggctggctggtctgtgccctgcttagtgactggaatgagatgggaggggcagactctgaactgtgctgggggctccatggaccccgagacagtcaggcacccaagggagactccccggctctgtggcccagccagcctcatcctgtggactgcccttccttttcctgaggctggagggaccctgctggggtgggcactgccccatcacacacatgttggtgccccagtgcccttcctccccgctccctctcacattcaccacttgactgtttctggcttcaagcccacccggctccttccctgaagtgtgacaatcaggctctttgcctgccctgcgagcggctccttccctg

SEQ ID NO: 80139 - DNA, 1004 bp, Homo sapiens
aattagctgggcgtggtggtgaatgcctgtggtcccagctactccggaggctgaggcaggagaatcacttgaactcgagaggtggagattgcagtgagccaagatcatgccactgcactgcaacctggcaacagagcaagactccatatcaaaaaagaataaaaaggttgaggactgtgtgtgtgagtgaggtaatggatgtgtggtctgaggcctgtatacaacatgtatgggatatgtcatgtgtattgacatagcatgggtccatgaagggtagatattacatgtgaggtttctgatatatatgcactgggtgtgatgtggaaatgtggtatgggctggatatgtcatgtgaatacctgccattttgcatgcggcaggtacatagcatatgagttgcagacgtgtggcctgtgtgcacgagaagtcatgtctgaatctctgtgtgtgctcaggtgtttgagcctgaaggacattgtcactgtcagaagcaagattgctgagaattcccatgacattgggcagaattatgatcccgcttagcgctgagataacattggttggagaaagtatggatgaaaaatgtccccaggaatagaaaaaggagttacactggcttagcagaggatgagctggtgctggggagacagggaggaatacttgattaaaactgaaaatatctgttaccaggagggagaggtccagaggagggaaagggacagctcagcctagaggagcgcaggagggaagagtcataggcagtggaagccggaagccccaggaggggcgttgatgttggtggagaaatgtgcaaagaggaaggcctgggagggagagaggaaggcacagaggtccccactcagctcccaggacagaggtaactcatggaagtcttgagtagggggcaggtggcccagggcccacctagaacaattcttgacatctctgggtctgcgcccctcaggggaaagaccccaccatcacaccaccgttcatcagtcaca

SEQ ID NO: 80140 - DNA, 1021 bp, Homo sapiens
tgctcaagggcgatgtttttcggtggagtgatgcatcccatcgctgccatccctcaaattctatcgcataggtagtcacctcattaccctgtagaaaatggacccatttatcattcatttctcctttggtagggctgaggtggagcccgagactgcatttccagcaagttcacaggagacagtcctgctggtgctgctggcctggggactgtaatttgagaaccattccctagactgcactggcaggagtatgtgccctgagtgaactgttaagccctacaggtgcccaagggttaaactaagccttccctggaatgcccacttcttttttcccctcctgctttggatccaggtgctgctcggcacagatgccagtgagacccaggtgattggatttgtgaacttggctcaatttctcatcatctgccctaggaaactgcattataaggtgggaagaacacaggactcagaggcagaaccggggttcagcctggtatctgtttcataataggtgtgaccttgggctgctagtagttgtaactgaagcaatggggacttagcttgcctgggcctcagttttttcatctgtaaaatggggacattactgttctcctggcacaccgcccatgtttttatgggatgtgcttgaacagcctcgttaaattaaagtgccgcaaaaagactataatcttattatccctggtgtgaaaggagaggaaatagtgaaaaacagattctaacatcacaaagatgcaaagccttagccactgaggggactttagggcatcgctcccttaaccatccctcgattttataaaggagaaaatggaggctcagaggcaggcagggaagtgacatgcccatggtcaaatagcaaaaccaggagaagaatccagctctcccctgagccctgctctttcctccataccaaagtatcaacatctccccaaacctgggctcagaaattctgctttttccgtcaccccgtctttgaagagaagccaggtatgcacctcaattt

SEQ ID NO: 80141 - DNA, 1030 bp, Homo sapiens
cccttctctcctattaccttccttagtaccaacaactactctataaggtatgtattattttccctaatttatggatgggattcgaacccaggtctgggtgatgctagcaactatattccttccacatcaccttgccatagtggagatgttcattgctttgtacaagctccccaagggtcgaggtttcctctcctttctcagattagacccagatcactgcctcctgtgggaagcattctcaaaactttcctccatacaccacccactacaccaagcaccccttgcatcttttcagtttttgtttcttaaaagccttattgaggaatatttcaaatatatataaaagcaaaagaataatataatgactcccatgtcatgattaccccactccctttcccccttgcccaggcatcgtgctggttgatctgtaaatacttcagcatttatgtggtcgcttacttctgttcatccttcccgctctggggctggtattgggtctttttcatcttcaattccccagtgctcagttcactagaaactgggtgtgtctgttgagtgaataaatgacagagtcccatgtggggacatgagtaggttcctggtgcctgtcactgccccattacagcttctaaagagtctggcttctcagcagggccagttcttctgggtaggacgttccttagattgcagtgtgtgaaaacctttctgttgtggtcatctgggactctggatgctgataaagccttctcaaatatggcttcttttgtgtcaacatcacgcgggcataattacattcgctgtgcaaacacacaggcgaagggcctctgggccacgcagtgtggtattatcgtggcttctgcccagacatccctcagaagtcctgccaggagagcagatggggccagttcagtcccccaggacgcccccagcatcccagctggcctggcaaggccctgttctttgatctgatttcagcccaagaggacccacagagctggtcagccctgtggccctgctacatttctgacag

SEQ ID NO: 80142 - DNA, 1903 bp, Homo sapiens
agcttgtgtcacaggcaagatctttacgtgaaaactgtgttgagtcccgaatgttaccaaacattataaatagcagctggtttgttttccaaatgctctatgctctgaaatgagaaaagaaatacatagaaccaaagaggctgtttctgtccccccgattctgacacaccagcacaaacacacgctaccgaacgaggcaccctcgtgcaattatgttgtggatcacgtctgaatatctccttgtacatgacatttacgaagaaaaacacttgcaaattaaatgtttgattaaattacatcttttacagtgtaaaatgggtgagcataattgaaagctgcattagctaaagaacacgaactttatatgagctttatcctgggcctacgaatctcgatagttttactgaatccttagtgccaatggcccagagtatttatgcattacatctcgtaaaataatctaaaggttcagtagtgtgcagccttatcagagctaaaccggtacagtttgaccacgaatcttgtctaagggcagtgagcacttgccggtggaattgtgggtgtattttatcaagagctaacttggttagtctttcttgtgtggttcaatacaggagggatggctacccagtcacccagattctaagtctgtactcacttttccagattccatgtctacaccaataatagcatctaatttactgccggcttctagagaatagcctcttttataatcttgagatgtagacatatactttctggactattcccttcttcccttttgtatttcatccttttctcttctctttactatccctccctctctttccttcgtttccacctttaatcttccctttaccaccctcataaccctgccttttcctcaagtttgaggactgcatcaaatttcccaaggtagttccctatttaagagcacctctcaatgactgtgtgtttaaaatgaagactttatatagtagagtaaggccctaattccattatctggcctttcttgtgatacttttaaaagaatacctctgcagcccaagtgttcaacatgtgtgctcactccattttccaggccgctcactctgcccaggccaatggaggaaatcttcatccagacacccctggaggtgatttttaaagaccgagttagagtttgccaagtgaagaagccagagtggggaagggacattctaggcagtgggagcagcacattcaaaggccaggagttgggaaagggcccaggtagtctgggaatgttggagagtctgtgggggcaggtggagatgaggggctggagttgactctggagggacctgttaggatcaggctgtgagaggccctcatggaggagcctgcagagaattttaaaccaagaggggacctgatcgcttttgtgtttcacatggttggctagagtacagggtggactgccagccagtggagagcagctggctaggagctgctgcatcaacgcaaccaggcaggcacttaggagacaggggctgggccaggcagccctgccaggaaggcttcagggaactgagcagagctgggaactggggacccaagagggcaaggatgccagccaggaggggagaactggcaaaagaaaggctaaggcctccagtggagatcaaaggggtcagggaggccgggcatggtggctcaaatctataatcccagcactttgggaggctgagctgggcagattgcttgagctcaggagttcaagaccaacagcctgggcaacatggcaaaaccctgactctacaaaaattagccaggcatggtggtgcatgcctgtagtcccagctatttgggaggctaaggtaggaggatcacctgagcccagggaggttgaggctgcagtgaaccatgatcacaccactgcact

SEQ ID NO: 80143 - DNA, 1040 bp, Homo sapiens
agatcttgatgtttgccaagtggaaaagacaggaaaatcaatagggggaaaaaatctcattttcaagcctctaagcaggtattgcaatcaataatgcaaagagccgcaggaggccattaagccacactcggcagtgtcctcttggacgcaggaaatgtttgctgagcaatgggacttcaagggcacctcagtacccacccccacctgcccaaggaccacggctgtgggctgtgtcttttaagggagctggtctgagtctccacaagggaaacgctacttggaagtgagttagcccatcccccaaccagtgcggaccccagtgcagtggaccctcagatccagacatgcagagcaaaggacacaaaagtgcagggggtggcatcccatctaacttggccacaggaggtttaccaggagttgacacttgccattttcccctttgttttttatttgctcctggagataaactggatcttttttttttttttcaccatcatagaataaatagactcctggtttatgttccatcatttcctagcttattgtgtatgctgcaaagtttcatttttccatcctatttctgataactgccaaagaatattaggtgctctggtgggatgttagggacgtgtgctctgacaatgggtgcatccccctcctgccccacccgtggcagcatttgcttcccctcttgcctctgagctgtgactgtgcttttaaaacctgctgggtctctatggacacaagggccagtgaatcagggcttattggcatggcactgcatggaccaggaggaagagggcttagaaggagacctggtgccttccagacactcccaggttggggtgggagctccaggctctgactcacagtgctcccagcctgatggaggaatctagaccctgtctataagatgatggaacaatagcacttaaaaaaccatataaaaatcatctcacaaggccgggagtggtggctcatgcctgtaatcccagcactttgagaggccaaggctggtggatcacctgaggttgggaggt

SEQ ID NO: 80144 - DNA, 1137 bp, Homo sapiens
gtggaaacagtaatgttgatttttcagggctgtcctgaggctctaataaggtgacagatgtagacagtggataggaatgcattttactgaggtactaggcatcattactgttggtgaccaccgtgtgggtaataataactgcagtagtaacgtacagggatttagtcaaacattaggcccgagactggatctgaggtgtcatcaaacattagacctgggcaaagcttcataaatccatctagttcattgtgtaagtaatagctttcattcatcctgcacttgtgatgcaccagacaccgttctaagcactttatctgtattaactcattgaatcctcatatcaaacctatgagttagggatgaatatgatccccattttacagatgagaaaaccgaagcccagagagatagcaaggtggtgcagctgggcgcaggcagattagctccccctgtgaccacgctccaccctcacacggaggagaactggaatcaattgtgggtgacaggcagatggtgcctctcctttctgggggtctctctctctcctgattgctggggccacagagcatcatctgaccccaccctccctgcagcaaaatggaaacacaatggtttgtttttgtggggcttgatttttgggatgactccaagcctcagcccggtgggctgatcagggaggtgcattaaggaggcaggctcagccctctggctggcatccagagacctcccagcccccctaggggtgtggcaaggagatggcagggactcgcagccgtggagcttggtgtgaccacagtgcagcaggtgcatttcagacagacctgtagtgagcagggtctccacttggacgcaggccacttggacccagggcgggcagccagggaggacagcttggtgctcggttataatgtggtcttccaggttttgcacaacatgctgatgtttgttgtttttaaaattatcattgaaatagccacataaaaattttaaattcctatagattccccctgggcttccagcaattctagagaaacactgccttagatggatcccagcatgccaacagtggggaggtggtggggagggaggtcagcaaccaactggggggctctggtgtttgtgctgggaccctaagag

SEQ ID NO: 80145 - DNA, 1088 bp, Homo sapiens
ctctggttgatgccctctgccttccctccccaacccctcccacacttgggaggtggggaggctactgaaacgccaattgggccacacctgtgtccctgctctctattgcctgccgggaagtgctcatctccttggcccggccttcctggcccctctggatgtggcacctgcctggctttcaacctcatctccctcccatcattcccacccttgccctctttcatccactgacccattgctcttttgctgtcaaagcccagcacagatgcccccctgctgtgaaggttccctgattcccaggggcctcgactctgtacatggccaggcggtccttgccaccctgggcagttttggtttgattgtgtttgtctccctctcacccgtatcccctgaggcctcttcatgcaggacccacgtctttcttgtctctatgacctggagcacctcatgctgcctggcacatggaaggtactaagcagtgttacatggaatctggtagacttgctctcctgtcttatcacgtctttcgttccttctggaggtggaggtgggactagggaagattatggggctctgggttggatgcttgagagaatgcaaagccatatcacgtgatcttccaatgcttctcacctatggggagtagggggccagacacgtgccccaagaattgcaatatgaggccaggagtcaaattggtccttcagaggaagcagagatcatatcctgtggagagatcggaaagatgctaaaaatatggtagaagcagagctcaaagaaggatgagatgtgaggtttcagtcatcagatatggaaagagagggtgctccaggcaggcccacccacatagcaaaggtgccagtgctgagcaggtcagtgtggttgaagcggaggcacccagaggagtgggagccaggctggactggtgggccagggcaggtggcatggtgttctcacaccaacagcccaaggggctctggcattattctgtgggcatggggagcccctgaaggcttatttttcatctactcactctgcagcgtttcctggtgggcaaccttttaactctttcttctcctaagtagcat

SEQ ID NO: 80146 - DNA, 1019 bp, Homo sapiens
gattccttacggtcccttaccaggtggtctaggcctggcatccctcagtgggaatggcatgtgatgactgcatcactctgggcagaagtagctgataccccataggagacagaagaagcaagatccagtcttccatggcttgtgggcccagagctcagggttttcttggctcatttccccccaggtccacaccagacatcttttttctctttctccttggcaggagggagtagggaaaggaagtagatgggcaaagaatgtcaatgatgagggataagggaatggggagggcattccctttaaagcagtccagatctggggtccctgggtccaaggatgggcccgggggcctgaggacaccctgcaattatagccgattttgcacttgtgggcattttcctggagagaacatctatacctttcactggattctcagagcagtccctgagtcaaaaaacattcagaacccctggcctagaatttggactttttcctgactcaggcttcccactctcctgttactcagaaccagtgaactgttacagtgttagtcaaagcctgcaatgtgaaatatcaaatgctcattacccacgacgatgggaaactaagtagttgccaggaacatggtctgatcacagacgcagcctcctttgttctcctgtgcagggcccgggatggtgctctccctgacggggctcattgccttctccttcctgcaagccacccttgccctgaaccccgaggaccccaacgtgtgcagccactgggagaggtaaggtgtgggcctcagatggccaggcactctctgggggatcgccctgggcatggcagtaggggacagaggcagtcaggagatccaggagctgccctctaagggtctgcagcctggctggggagatggcccacatgctgagagacaggacagagatgtgtagattctgtctggaaggtcagggtggaggcaactcacattaacttcagttacgatgcactgtcctacccctccctgcactagcact

SEQ ID NO: 80147 - DNA, 1154 bp, Homo sapiens
ctgttaccagaggtttataatagaacagccccacctccatctctctgcagcccctttctgatctctggccttatccttccctttggggaggctttctgggtgatagcctattccatctcaagatgaccatggaaataggatttgctgatgacttttaggcttgggccaggtatatatggacttggcagttttcgtgggttctcaatccctgtgaaataattgagaccaggccagaatgaagtgtcaagtgtggaccacaaagtggtgagcagacaacccatcaccaggtgccttgaaacacagggagaggattctgcctcaggagacagaggacatatgggagcatgtctcaggctatagaggaaggcagggtcggcccctctgaggactgttctggagcagaggcacttgaccatccaagagaatattgacttgagctgccaggatgggctgttgatttgtggcaaactgtccaagggtggtctctgcaggaagcaggtggtcagggccttttccctgcagtgaatgactcctgtgatggtagagggtgagttggacccttcgtgaacagctcgcagggctcggagttgtccctgtcgacctcactggtctccttcctggggaggggaggggtaatggtggagggaggcagttcacagctataggagaaactccagtagaagtttattgactaaataatcaccttctgttggctgggtgtggtggttcacacctgtaatgccacactttgggagattaaggcaagtggatcacctgaggtcaggagtttgagaccagcctggccaacatggtgaaaccccatctctactaaaaatacagaaaattagtagggcatggtggcgggcacctgtaatcccagctattcaggaggctgaggcaggagaatcgcttgaaaccgggaggaggaagttgcagcgagccaaggtcgcaccactgtactccagcctgggccacaagagcgagactccatctcaaaataaataaaaattaaaaaaaaattgccttctgtcatgaaggacttatgtaaaaaagagaggctttgggtggaaacttggaccccagatctattggtttggttggggtttgcttgtggtagagatggtctagggtttggcattttcaataggtgcact

SEQ ID NO: 80148 - DNA, 1034 bp, Homo sapiens
ttcctgaaggtctgcgagttgctttgggctcttctgctcccctcctcccacgtgtggtagaagttccagaatcaccaacctccagctgggcggaatggctcatgcctataatcccagcactttgggaggctgaggcaggtggatcacctgaagtcaggagttcaaggccagcctggccaacatggtgaaaccccatctctactaaaaatacaaaaattagctgggtgtgggggcgtgtaccagtagtcccagctgctcaggaggctgagaagggagactctctagaacctgggaggcagaggttgcggtgagctgagatcatatcactgcactccagcctggatgacagagagagacttcatctcaaaaacaaaccaaaacaaaacagagtcaccaacctcctagagctggggctgtgatgcttcccgggctgacagattgaccctgttttgagatatccggagagtgaaagtactggaaaattaattagcagcagtagacactggctacccggaggctacaggaatttatggggtttttgtttcttttttgtcatggaataagttttcagcatgtgtgttgattgatttcctgctaagttcctctctgtcttaaaaaaaataaaacaactctcagagtttggagtccgttgaagcatgttaatgaccttttttccgaatcacttcttcttggtattgtgtctatcccccacccccactctccttctctctcttttgcttctgactttcagacaggcaaggggttggtccctctgaagggctgggacccaggacccgggtgaggcaagctgaatacctggggctgaaacatttaaggaggcactcactctcagggtctgcaaatgcagggtcagcatctgagagtgcgggcttccttaaatgctgccctaggcacctgcttgtcttacctaggtcctggatttgctctcctgactgctgtgcatgccacattcaggggaagaaccaaacaatatctggggaattcaggtgctaaaacctcatggacagcaacaa

SEQ ID NO: 80149 - DNA, 1042 bp, Homo sapiens
tggtggggcttgggcagaaggtctggctggttgcccaaggggacattcctctaggagaacttcagtggagcccttcctcatttaggagcaaacagattagtattcatggaactcacaggatgggaggtcagttcctctggactactgtgaaaagaactttgctctcaattaccagggctgataagcggcagagacacagcgcccctcccccagcattggcactaaataaaaatttaattaagaaaaattagtctatgcctgtggttcccaagggtggtctgtagacctgtgctagactgcagctaactttccacagatgagattaggaaaatgagaacagagaaagtgagttcttcatgaagctaaacatattcactattaaggactattctttctaagattggcatcctacatccctggtattcaggaaattgggatgatagtagaagttatagtagaagagaatagaagatgaccgcaaagtccttatgtggctaaataaaaagctggcaaatttctgccaggctcactaaagtgtgaatgtgtgtgcatgcgtgtgtgcattcaagtgtgcataaatcttactgttctgtgaacctccaaattctgaaaaaaaacaaaaacaaaaacctgagcctgggaggttgaggctgcagtgagccgtgtgagccgtgattgtgccactgcactccagatcctgggcgacagagtgagaccctgtctcaacaacaacacaaattctgtgaatcttcaaagtctgataacaacaggcaacaccaatcagacattgattcttagcttcttccccaaatggataacacattgtatctaatttttgcctaggtaatatgttactttgtttctaataataacagatttttgttaagataaaaatcttccctttggaaaaggagcaaatgcttaaaattaggttactttagcaaacatttacattttaatgaatatattctgttaaaaatcgcataagatgtaaatgagcgcagccggaggagctggtgagtggtcagctgagggcaattga

SEQ ID NO: 80150 - DNA, 1017 bp, Homo sapiens
tgttccagactccctcgtataccaaattccacacaaactcaagttctgtaattgaacctgcagaacccacgtatacaaagtcagccctccatgtccttggtttcacataccacaaatactgtatttttgatctatgtttggtgggaaaaaaatctgtgggtaagtggacccttgaagttcatgagttaactgtaaatgtattatagttagtacttatatacttatctaattattctattatattgctctcctagaggactgtaagctccatgagtttagggtctgcacctactttacttaaccttgtacctcttgtgcttaacacagcgtctggcacttagtaggtgctgaacagatttctgttgcatgaatcaatgaatgaagtcgaaagcttttgaaagggtccaggcagtcactgagcagctatatgaacacaaaggagtcagcttcagtctgagcccagacatctagagggaggatgtgagcacaacatgtagactcataatgggtttggagtcaaagaacaggatttttttccataactagaagtacctaggagtcttcacaaaatgttaaaatggtatattcggcatgggttctgcctttgtatactgacagtttgttaacacatggtactaatctgaaaacagaaatggatttaaggatttatatcgatccagggattgtttggttcattccagtgaatatttcccaatttagggaagattgggatgtttgggaatgtccttggtgctgccttggtgctgacctattcctctccatcacaccactgccactgccatgttgccaatgaatagctagtaccaaattatagaatcatttgatgttggtgacatcacagacggaggcaaaatgatatagtgcaaagggcgccacgccaggaatcagaagatcctacctattagctgatgattttaggtgaatcagattcacagtaatgctggctcctcatctccaataatgttgctcttcctgcctttatgggaaggctgagaa

SEQ ID NO: 80151 - DNA, 1033 bp, Homo sapiens
tacagcctccgcctcctgggttcaagtgattcttctgcctcaacctcccgagtagctgggactacaggctcgcaccaacatgcctggttaatttttttttttttttttttgggatttttagtaaacagggtttcaccatattggccaggctggtctcaacctcctgactttgtgatccacctgcctcggcctcccaaagtgctggtattacaggcatgagccaccgtacccggcctggaggcaggtttttaatggcaggccacatgtcagggtgtcggcagggagaggtgccatcattgcagagcggcagtggttcttttgttacactttcctttctagctgtggtttcacagctcctccatcacccctttatcccttgagcatcacccctgtccagtgctgcttggcctcagcacccctgggtgccgtgtgcctcatcctaccctttcttccccctggtgtctcctaccctgtgtcaatccctccctaccccaacaatcttctgagagcaactgtgggtgggggcttcctctgcagcctcgaaacagcctctccagccccacattctgcaggaggaggaaggaccagggaaagataacagtggaggaggggctgtgctcctgaggctgaggcctggaggaagaacagggcgagagggataggtgagctggacttgtggtgggatgagggagaagcgaggacctcagtggggtctgcggaattacgggacctaattacccaagcagtgagggcttctggtcttggtctgtcatcacacaccagggctggtcctttggagaccctttccttatgatcctgagtcacatggaggccatgtggtcctgactctactcgccaccctaccttctgaatggggtgtacatgcaggggcagcccagccatctggccttgggctcgtgtctgaatacttctgtttggcagtggggagggctgaggggtactttggatctcagtggcaataatctctagggacaacctgacctcacccaagactccatgatgcatgctgggc

SEQ ID NO: 80152 - DNA, 1041 bp, Homo sapiens
gtacaaccttgagaagacagaagtctgggcttccctcttggcctttgcttgtgggcccacagttggtgtttggctggagttgaatggctgttatccccaccacccccaagacaggatctcgttctgtctcccaggctgaattgcagtggtgcaattatagctcattgtaacctcaaattcctgggcttgtgtgatcctcccacctcagccttccaagtatcttggactatccaggtacgtgctaccatgcccggctaagtttttaaattttttatagagacagggtcttgctatattgcccaggctgatcgcaaactcctagcctcaagtgatcctcctgcctcagtctcccaaagagctggaactccaggcatgagccactgtgtctgactgagtggctattatctaaaagtttcttgtcttgctaagctgcccctttcttagtcctctggcaagagagagcaggattttgttggtgttttttgtgtatgctcctattggcatttctgggttcctagtgtctttagctccaaatcagggatatatggagcaaaaaaaaaaaaaaaaaaaattcaacccaaggaacacaccaccatgttgttccttggggcttaaagttcctagttgctttggcctcttccctctacctttcacagtcttcttatgtttgttttacatgtaatgtccaggggttttagttgtgcttagcagaaggaatagggaaaaatatgcttactttatctctctggaagtggaaatccttccttaaattttgagtctcattgtctcttgctagaccggtggtcttcccaagtagggaaatgcagaagaggacaagaatgaatgttgatggaggcccctgggtgctgtgtgcttctgcatgtgcaagtttattgagttctcatgacttggtaaggatggtttcattattccctctttacaggtacgaataacctgaggctcagagagagtaggttcaggcaggtaggcgggcctgtactggccttgaacccagtgcacatgccttttctaccacaggtc

SEQ ID NO: 80153 - DNA, 1023 bp, Homo sapiens
tgctctggccaggcacagtgtaatccctgtaatcccagtactttgggaggctgaggcgcagaccacctgaggtcaggagtttgagaccagcctggccaacatggtgaaaccctgtctctactaaaagcacaaaattagccgggtgtggtggtgggcacctgtaatcccagctactcgggaggctgaggcaagagaatcacttgaacccgggaggcagaggttgcagtgagccaagattgtgccactgcactccagcctgggcaacaagagtgagactccatctcaaaaaaaaaaaaaaaaaaaaaagtggccggctcattttgggcatatctaactgcttctgaggtctcagggagaggagaagggttggcggccatatccttaccaaggggtaggtttctctggtttgggagccatcttggggcctctgaaagttccaggggatagtcattggcagtgttgccctgggtggaggcacttctcagcttagctcctggcagggtggagagagcttgctgagctgaatcctctgaaatggcactgtctaatgttgtagctactagtcacatgtggttatttaaattaaaattaattaaaaataaataaaataaacaatttaaggctgggtgtggtggcttgcacctgtaatctcagtgctttgggatgctgaggcaggaggattgtttgaagccaggagttcaagaccagcctgggcgacatggcgagacccccttctctacaaaaaaaaaaaaaaagtttctggatggaaaaggagatatatcatgcaaacactaatcagcacaaagcaggagtgcctatatcactatcagacaaaaagttctgttgggctgagttggagattgccaactccacgagggcagaaattttgtctgtgttgttcactgctgtgtccttaccgtctggaagaatccctggcacatagtaggcgctcagtatttggacacttgaggagtgctagccttgatgctgccaccatctttctgtgtgaacggggacacactg

SEQ ID NO: 80154 - DNA, 1043 bp, Homo sapiens
gagcctcggttgagaatgattttcaaagtctctcactgaagttcaaagatgcatttctccagccagaccagtaaattataggagcaatttgccatgaatttccaatgtggagccattcctagttcctctcagggtgcagtcctctgtccctcattccctcctgccagtggaggtggagactgtggcctggtgtctggagagcatctcctcccaacattcactgaactgtttatcccaacccactggtcttcctggcccccaactctgttgaccctcctgttccccatttcaatcttgtctcgaacctgtgctgatgcctcatttttgagggtggggaggtccaggtcaattgtacactctggtacagataaaaccttgatcctgagtgtatgtcttcacactttatttgtctgtatgataaatgcaatttctgcatcaagactatcagtcattttctgatgtgatctatgcagctctgcttgaattgaatcagctcctgtattattgtgacagtttatttggtaagaaaatgaaataagatgtgtaaattaaagtggaggtgtgctctgtgcaatgtggaggttcccagggctcaggtggtccctctgggggcatttccattctctgttctttctcctcttttttccactccttgcactgggctcacagctctactgccttctaagctcaggtctaagagaccaatgcgaagatacaaagcgatggctgagggaaggtaaagatgctgggatagtgtcaagagcccagcagataaaaagtgaaaacgcactgagactagaactcagattaagctttgtggtcttaatacagagggctgcagagagcgcgtatgagtgtgtgggaggaggcgttagagctccagatgagaggttaatggtaaagagaacatcaagactctttacctgtgcattccatgtgcttctgcctccctcctgctcctcagcccttgccatgcaggaccattgctgacctagggtagcaatccttttctttttccttctctgcacccctcccctccccta

SEQ ID NO: 80155 - DNA, 1018 bp, Homo sapiens
gggagccctggttgcaggccccatgagccctgccctggcatgcgggtgtgttggcagcgtttggggatcatcactgtggccctgggaacaggcttttagcttaattcaaccaagtgtcttaaaatggcaactcatcagttagctttcattttgttcctttctttaatgtatctccctctagggatgaaccacattgatgtaaatgctgggtgatttttcccccatttttaaattttggggacatataggtgattgtcgactgtaacaacccagccaaaaccaataaaagtatctctttccttcattgaaagaaagaggctcccaataaatcctgtaaaatggcagtgcttgtgcccttttctgagaaggatgctggggacatgtgccaagagctgccgagagatcacccagcaagttattggcttcaggacaccgaatttcccacaaaataacagagaagctgtggggtgaatagggacagggacctgacccttctccattactcagctgaggcccaagcctctctctggggagggatgcttggggcctcagctttctggatggttcctgggaaagttggagtcaggaggcccgagttctagaagcagctctgccagggactggctgtgtggacagaggcaaatctcttcccttctttgggtccccttgggtctgacatgaaggattagatgaaacaaggggcctaatgtcactccaaattctgtggtacccacaacatcaggcttgtctccatcttggccatgaaaattccctttcctgtgccttaatcccctggccaggtacttctgccctggaagatgtgaacacatatttgcatgttggccacctctacaaagaaagtcccacactttagtggggatacagagggtctttttaacatcaaacaacaagttctgtacctgggaggagtgggtagtcagttcttatcacaagcctcagctgcatagctgtccttttgtgaagtagatgttggtcaaacaccacatccaaaggggcc

SEQ ID NO: 80156 - DNA, 1126 bp, Homo sapiens
agcactgagataccaccgacagtcgatctgatagccaagatggccactaagtgaccaatgggcagggggcgtctacagcgtggctacactggacgaaggcatgattcatgtcccgggctggagggagtaagagggcacgacatttcatcacactactcagaattgcatgcaagtcaaaactcatgaactgtttatttcttgaatttgccatttaacatttttggactgtggttggtaactgaaactgcagaaagcaaaactgtggataaggggctgctgtatgtatgtgtgttcatgtgagtgtgagtgtgggtgtggacatgacagtgggtgggagtgaatgtgtgcatatgagcatgtttgcatgtgcctgtatatgtatgtaagctgttacgtgctgtgtgcatgcctcagtgtgtgatcttatgcgagtgtgtgcttgtaaacatatgccttcatgtgagcatatatgtattcatgtaagtgtgtgtatgatagtgtgcgtgtgtgtgtgagtgcatggggttgtgtgcatgtgtctatgattgtatatgtatgtaagctgtttatatgtgcatgtgtgtgctcaagtgtgcaggaccatatgtgaatgtgtgcttgtaaacataacgctggtgtgtgagtgtgtctgccagatgtgaccagatgggttaagcccactaggttcctgcctccaaagggcatcattaggaagcatttgaattttccagacccagttaaggagcctggtaaggtagagggtggcaccacccactgagcgctggtctccccgctcctcactagggctcttgaaggccatattacctacggagaacagcatcctcagccattgcctttctgggcagagagctggtttttattgccactcttaggcaaaatggagtgtgggtggtgggcaagcatgctgaagaggcctctttttcaggcagggctgctgcctcttccccaggatgggaaatggctcctgcaggtttgagccttggctctgctccctaatgggcacttggtagaggtgctgggccgtgaccaagtgtgaatccatgccaggccactcaccttggctgggagagcagatggcagggccgggcccttctggctggctgct

SEQ ID NO: 80157 - DNA, 1011 bp, Homo sapiens
aaactggaccatgtccctgcctgtcggaaaccctttaacagtttcccattgccctcgggatgaagtcaaaactcattagcacagagtcaaggcccagcagcctcaccccatcctctataatccaccttgcacttgatgcttgggtagcaccaagccgcttctggtcctccctcctccagaacacacagtgctgtgtcacacctctgtgtctttgcatatgttgttttctgactgcaaagcccttcctaccttccttatgtggctgactcttactcatcctccacaattcaacccagacaccatctcctccaggaagccttccctgaactcccctccctctggtgggctgagtgacttgtctttctgttctgactctctgtgcttattatagtcaaatacactcaacactgtagtgagagcctcaggaggagggacttggtcaaacagggagccagtacccagtgctgtccctggcatgtagtagggttaaagatttgttgtcacactgaaccgggatagtccttgtccttgatatggagacttgatgcttgcctgtggctctccttgacctgtggggaagaggtgggatttggcaggcaattttggggtggactgtgagatgtgggagcccgggcagtcttgggacgcttccaggatcctgtaggaggacccaggctcttctggagtttagagaacatcactgctctgagtgcctggagggttttggcaggtattggggtgtagtgctgttgctcagaggcttgagaaacgaggatgatcctgggtagttgagacccctgggtaggtagtcagtttctattctccctcttggccatgtctctggatttgttacagattttgaccttttttttttctttgagacagagtcttattttgttgcccaggctggagtgtagtgataccatcatggctcactgcagcctcaacctcccaggctcaagcagtcccctcatctcagcctcccaagtagccgggaataaaggtgcatgc

SEQ ID NO: 80158 - DNA, 1024 bp, Homo sapiens
tcgaatcaatcctctattaccgtgcaaatacatcctataggatattgctgtattttcccttcaaacacttaatacataattaatgatattaaaatacatctaatgccacagaagataccagcctcaaaagcttcctgttataatttattcccacctagataaaagattgatttattggttcacttatcattcaggagtggtcctctcctggccatccatgggaaggggcggtggaggcaggaagtgcctgctgtgtggcagactgccctccagacagcattgagcccggcgggagatagccacgtgccagtgtcttcaaggattactcattcaattctcccaaactactccaggaaggaggtcctgttgttattccactctatagatggagaaacagaggccagagaggcagccccacttgcccaaagtcataatcttaggcttccccacaggacggtggacctggaaggtgggcttggcatttcttaccccttaaaacggcagccattgtcactactctgcaggagtatttgagaattagagataacagcagatgttaggcactaaaacatgctgctgacgtccttatttggaggtgaaatggtgagaccatcaattttaagggtattgttttggcagctaggtggtcttttgttggggggagtgagttggaaggagacagggtgtgggaccccactgtcatcaggcacacaccttctctggccgataagacaccatgagaagaaaccacactccagagtccatctgggagtttcttcatccaggcttcacccaggccctcctgtgaatcacgagagcgctggacttgggaatgaagataacgtggtccctggatgaggcactgtgtctggtggaaatggacagacacataactagtgtgacgaggtgtgatgggtgttagcatgcaggcaccaggattccaacagcccggggtgcctggatggtgctgccagtggacaagggaaggaggtgctgggtgagggagtggcatgtgacccatgcc

SEQ ID NO: 80159 - DNA, 1077 bp, Homo sapiens
tatctccctccctccctctctctttctttccatctgtccttctttcttcttctttttctttctttctttctttctttttttttttagacagagtctcactctgctgcttaggctggagtgcagtggcacaattatggctcactgcaacctcgacatcccaggctcaagcaatcctttggcctcaacctcccaagtagctgggaacataggtgtgcactggcatgccaggataattttttatttttttttgtagagatggggtctccctgtgttgcccaggctggtctcaaactcctgggctcaagtgatcctcctgctttggcctcccaaagtgttgagattatagatgtgagtcactatgtccggcttgcccctacttgttagtgctgctttgtgaagactaaatgaagatttaatgttctgcaccatgcctcacacaaaggcattcaggacatctaaatttctttcttttccagatagatttatttgactggctgcagttgtcagtatggctatgtttgtatttgtgtttgtgtttccacttgtgtctagattggtgtgtttctctttgttgtctgtgtatgtgctgctgttatccacgtgtgtatttctgagtgtggtggtgtagatagggatgtgaggacgtctgtatatgtctttgtgcttgtgtctttgcgtgttgggttgagtagcgtgctttgtgcctgtgagcagctgtgtctctgtgtgtcagtgtttccatgatggcatgactgctctatgtgtgtgtgtattgcagggctggtatgcccagagatctccagggattcaggaagcttcacagtgcacaggagccctggacctgggtcccctctaaggtccctatggtgtcctcctccccgcaaaaaagcctcctgcagttcctggagaccttcctaattgccctctgtctgttttcctctgcctcccactggaggcacatggggcctaagaatgcttccgaggtggcagggcccctggtccatttgcattcgtgtttgcatatcatttgcattgtctatacagactgtgctttcagttctgcagttttcaaggtaa

SEQ ID NO: 80160 - DNA, 1050 bp, Homo sapiens
aagaaaagaaccataaaagagttgttctcctaaacgccagcatttttcatctggattctatttatcgattattttatagttgagagggagcaaaaatccatgtttttatagcaaataaagctggctgcagtaattatgcaggcttaacatgtctgttctggagcaggaagttggaattcagcctgactctcaaacatttgggtgagatctaattgaaaaagacatttcaaagaacaaatatttaggaatgaggagtttcgctgatggtctctctgggccaagtgtgagtaccttgcttttagtttgatcctcagaggtgggaggagactatggagaaggacctggtcagtaatgttgagaccacagtcaaaatgtgaggctgaaacttaaagataatcagtgaggcttagtaaagggaagaaagatgccttcagggaatatatcccctgtacctggtgagcaaggggaagatcaattaatcaaatatagattgaatacttattgaatgccaaaccttgggataggcacaatgagggcaggggccaggactttactagttatatatcttttataatggttagctcaggtatccattgtgacaaaagcccttgattggagtgggaatgaaggctgcaagtgacagagaagctgaattcaactggctgaaacaataaggaatttagtatctcccataacaagaggtctgggttatgtctgccctatagttggttctttcagtttgttcaacagcatcatgaaagatccggatgcttttcatctttcctgttcccaagatcacaagatggtggcaacatttccaggtgttatatcctcacaatcatgagcagaggcagaaaaggcaggagggagtcttacccagaagcccctcagcagactttcccttttgtcttattggctagaattgtgaatcatgtgtcacgcctaagtcaaccaccacaggcaagagaaggaagtcattgtaattgacctagaacaattttttttttttttttggagacggagtttcacttttgttgcccaggctggtgc

SEQ ID NO: 80161 - DNA, 1052 bp, Homo sapiens
cagagcctgcggggacgcagcaggttttcggcggcggccggcgatgcgccccgcggccgctaagccccagcaagtgccatgcacgcttttgcttttgggagaagggaggcggaacgtgtatccccctatttctttcccatcccatagccgttactctattccgggaagtccaggacctggacggccttgttggttggctcccaggacgatcctcctgccctagactgcgaccctggctcccaaagttaaaggagaagcaagtgactctctgcgcgcgcctggagcgtggtcccgaagttcccaacttctcgcccagccgtgggcggtagtgttggaggtggggaaatgggtggtggttgtggctccttggagctgccgagcgcagccgccttcctcctggacttggtttattttcctaatttgttagaaaaaatactacttaaaaataggcagaatcgttcctcgagggcgtcaaggtccctgagtgggatgcagccgtcacctgtcctgagcccgggagcgccgagcctcggcgtggcggtgcccagagcccccgagcccgggcggcttctcccggacctggactcgcgggctccatccagcggcagccgcgtctcgggatcggtgccccgcagcccgcgctgcgaggccagtgtgactgtctcccgagtggtcatgttctccggaaaaatatttcaaagtggctccgcttcaggatcgcccactctccatccctccaagagccgagagaacagggcctgcggcgggttggaggaggcctttgggatggtttgggctcctggccatctcggctcccttgggcaggggtcctcgcgccccggcaccagcgcccctccggcgctctgccagggaaacaagggttaaaaccccggccggtggggggtggggggtggggggcggggggtgcggctcgcggcggccggctggggcaatcggagcctgccgggggctcagtcccactcgttcccggagtcggaggggccggattcgccgacctctgcggcttctcggagccagcggagccccggccc

SEQ ID NO: 80162 - DNA, 1105 bp, Homo sapiens
aaaacatcatatgttgtataattccatttatgtaaaatgtccagaacaggtatatcaatagcaacagaaagtagattagtggttgccgggggctggggtcaaggggaacaggcaatgactgcttaatggatggatacagatttcttttccgagtgattaaaatgttctgtaattagatcgacggtgatggttgcataactgtgactatactaaaacccactgaactgtgtgtgttttaagggcaaattttatggtatgtgaattatatctcaataaagctgctcttttttaaaatctctagaactagtgatagatttaggtacaataaagctgctcttttttaaaatctctagaactagtgatagatttaggtatgtgagatggcggggaaggtagggtcaagagtatcactgaggtttctggcctacatgactggatggagagagggaacactagaggaagcctgggggcaggggagtcaaggtcgagagtttgaagtgtctctggggcatctgagagggccgcactgacgccaaatggcagtgcagttagaaggcagtcgttcagatggccccaaatgtactccataaaaatgttttgtgagtattgtctaatataaatggcaatataaacttgtggaaaactcagtggtgtctgaaggtaagtctgtgagaccctacctgggttctgcaaaatccaggtgatgaaacacatttagtacagaattcactttgtaggtctttccactggtgtgggactcccacttctaatccttagagagaacagtcagcagcggaaagggatgttgcatctgtaggtaaggtcaccactgaataaaaatagtaaaaaaaatcaacctaaagaaggtaggtttaactgcccctctgagaaattgcttaaaacattaagatgatggagttttagaaaacatccaagccagtccaaggaactaaggtttttctgcaagagttgaatttatatttatttatttatttatttatttatgagaaggagtctcgctctgtcacccaggctggagtgcagtggtgccatctcagctcactgcaacctctgcctcctgggtttaagcggttctcctgcctca

SEQ ID NO: 80163 - DNA, 1034 bp, Homo sapiens
gcattccatatggttccatatcagaccctattggattatgatcttcagctacttgcaccttagtttttctcttagccaaagacttgcttcttcatcttttaagcctcacataatatagcttgtcatcttgtgtgctgccccagttaaatggtgtaaaagatggcagagcctcatggtttctaggccatatcaagaaatgaaagtggttgcagtggtggttggatgtcttagggaagagaagtcaggttctttctggttcatatttgtatcccccagagcacccagcccagggcttctttataatggatactccagaagtatttgttgaacgaatgaatggttatctatatagtccaaaggatagcaaaagccagatgtgaaattctgaacaagagcttgtgtttgtctgcctggggagagctcatgtgccctttgcttttccaggagcatatacaacgcagctgtttggtactatcatcactgccaggacaggatgccaattgttatggtgacagaagatgaagaggcaattcagcagtatggaagtgaaacagaaggagtattcgtgattactttcaaggtatttccagatattgtatatgtatgagtgctcattttctaagtagtacccataaggctctagatccctttggtaacacagaaaagagaaaagaggaatagacattaagttccattttggccaggcgtggtggctcatgcctgtaatcccagcacttgggaggctgagatgggaagatcacttgagcttaggagttcaagatcagctgggcaatctagtgagaccttgtctctacagaaaaaaaaaaaaaatatatatatctccaagcatggtggcacgcacctgtagtcccagctactcaagaggctgagatggaagaatcactggagcctgggagatggaagctgcagtgagccgtgaacacaccactgtactaatgcctgagtgacagagtaagaccctgtctcaacaaatgaagttctacttcttcattatgccccaactatttaatgtt

SEQ ID NO: 80164 - DNA, 1028 bp, Homo sapiens
tttagttgtaaggtggttggattgacaaaccagaaacctgtagctttgtaatttcttttaagttacagttaggtcaaattccacttgcttcaaaaatagaagacttaggtggggcatggtggcttacacctgtaatcgcagcactttgggcaggagaattgctcaagtccaggagattgaggcagcagtgagcagtgatcatgccattgcactccagcctgggtgacagagcaagatcctgtctcaaaaaaacaaaaaacaaaaaaagccagatgaatttgaatagtgatgttgtcaatgttactgtttttgtaggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttggatgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtattcctcttttgagggggcagaggaatggagtggcatgctgtatatttagttatcttacagttgttcttaaaatgtgacagccagatctttgaccaaaaagagaaaacagattcttggctctcctcatttttgaagacacatttttccctcttcattgttatgtatagagacttaaa

SEQ ID NO: 80165 - DNA, 1076 bp, Homo sapiens
gctgtatgcagtggctcacacctgtaaccccagcactttgggaggccgaggcaggaggatcactgaaggccaggagttcaagactagcctgggcaacaaagtgagaccctgtctctacaaaaaaattattttgagaataaataaatagaatgcttactacctctttaaaaaagaaaaactaatttaggtttcttttacttgtacaccaagtccattattttacctatatatagaatgtttaaggttaaggatgtaaagaattcaattcaacgagtatttgaccacctattatagccaagcactaacttaacctagtattaaaatcagtacatgattcatttctacttaagaaatgtatttaaattctgacactcttgttttgtttaagccgtaaagcaaactagatttctgtagttgaaaagaggtgcttctgaaacgtgtccaaaacaaatttactggcagatgaaggtattcagacggatgagtgaagggttcccctcaaagtgttgtcttgtaaattactgtctgggactagctaacggtttttctgttctttgtcaggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtgaatcataccatattcctatgtgtggctgtaactttgcgctagttattttaaaatagtttttgtttattttgatcttttgctttctttttgaaggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagtaagagggaatttcaaaattctcttacctgtcatctcttgctaagaaaatatcagctttattgtgtagtaccgtgaagtatcat

SEQ ID NO: 80166 - DNA, 1038 bp, Homo sapiens
ttctagataagcatacaagatctgtgtactaagaatacattgtctctggatttatattctggtcataatataggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagtctgtgtttctattaagtattattaatattttaaatgtaaggaataaataatgtgatttagtaatatgtattttcttctctatgctaggtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccag

SEQ ID NO: 80167 - DNA, 1206 bp, Homo sapiens
tattggctaggcgtggtagctcacgcctgtaatcccaggactttgggagcctgaggcgggtggatcacctgaggtcaggagttcgagaccagcctggccaacatagtgaaaccctgtctcttctaaaaataccaaaattagccgggtgtagtggcgggtacctgtaatcccagctactcgggaggctgaggcaggagaatcacttgaacccggtggaggttgcagtgagcccagatcgtgcgattgcactccagccaaagtgatggagcgagactccatctcaaaaaaaaaaaaaaagatatatttagaagaaagtgatcataattaacattaagtgatcttagacttcattttactaaactgagcttttgaagaggtttgtactcatgcggtaagattggatcaggtacttataatgaataataatggtatgatttctttcagatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatgcttgtcactttagttaaatctatttgttctctttagtgtttgtttttatataggtatttcttcataaaatgattaggaggtaataagcagtttctgctgctggtctgtcattgaatgccttgttttcactaagttgggaggttttgtttctgttttttactgctccttgcaaagcagggctaatccatggacagtgtgcccagagtagtctagttgaagttttttgttttgttttgttttgttttttttgacacagagtctcactctgttggccaggctggagtgcagtggcacagtcttggctcactgcaacctctgcctcctgggctcaagcaattctcctgccttagcctcccgagtagctgggactacaggcgtgtgcc

SEQ ID NO: 80168 - DNA, 1106 bp, Homo sapiens
tgggaggctgaggtgggcagttcacttgaggtcaggagtttgggaacagcctgaccaacatggggaaaccccatctgtactgaaaatacaaaaattagctgagtggggtggtgcacgcctgtaatcccagctactcaggaggctgaggcaggagaattaacttgaatccaggaggtggaggttgcagtgagccgagattgcgtcgttgcaatccagcctgggtgacagagtgagactcttgtctcaaaaaaaacaaagccttggtacatctagaatgttgtatatcaaatttgttgtagaatatgaacttttgaaaactctggtgacccactgatcctatatagcacttgttaataaaaatatatatcaagataaaagtgttcatatacatatacaccattggataaagtggtactgggaaattaggcaaaataatttatgatgaaagtttgcatttcacttggagcgcagctctcggatataggactttagtgagacctttgtgactgttcctggtattgattgcatttgttagttgtacagtgcaaccatagacagtcacacacattaaaacagatggttcctgccgacagggtctgtatagttatcagattttctgtgcgatggctccatacatgtttgtttttgttttttaacttttaacagatgtggaagaaaatacaggttccatgtagaataccctaaagttatttataaactactttcaaacatgtaaaggaatgtgatttaggccgggcgcggtggctcacgcctgtaatcccagcactttgagaggccgaggcgggtggatcacaaggtcaggagatcgagaccatcctggctaacatggtgaaaccccgtctctactaaaaaataataaaaaaaattagccgggtgtggtggcgggcacctgtagtcccagctattcgggaggctgaggcaggagaatggtgtgaacctaggaggtggagcttgcagtgagccgagatcacgccactgcactccagcctgggcgacagcaagactccgtctcaaaaaaaaaaaggaatgtgatttaaataatccgtgatttaaatttcttggtaaaatatggtatgtatggatgg

SEQ ID NO: 80169 - DNA, 1001 bp, Homo sapiens
agtagagacggggtttcaccgtgttagccaggatggtcttgatctcctgacctcgtgatccgcccgccttggcctcccaaagtgctgggattacaggcgtgagccactgcccggcctactatcttttaactttattaagtgtttttttttttgtttttttgagatgaagttttgcccttgtcacccaggctggagtgcaatggctcgaccttggctcactgcaacctccgccgcttgggttcaagcgattctactgcttcagcctcccaagtagctgggattgcaagtgcccaccaccacgcccaactaatttttgtatttttggtagagatggggtatcaccatgttggccaagctggtctggaactcctgactcaggtcatccacccgcctcggcctcccacagtgctgggattacaggcgtgagacactgcgcctggccaactttattaagtttttgtactgggattttttttcatctaatttttatgaatctgtatccaggcggggtgctatggctcatgctgtaatcccagcactttgggaggccagggtgggcggatcacttgaggccaggagttcaagaccagcctggccaacatggcaaaacctcctctctactaaaaaatacaaaatttaggccaggtgtggtggcgcacacctctaatcccagctacttgggaggctgaggcatgagaattgcttaaacccgggaggctgaggttgtagtgagccaagattgcgcccttgcacttcagcttgggtaagaaagcgagaatctctctgaaaaaaaccaaaaaaaccaaaaaaacaaaaaaaacccctgtatccagtgctcttttagactgcagtcctctaagttcttaataattttctctcttttttttggatataggatctcgctgtcacccagtctggagtgcagtggtgtgaacttggctcactgcaacctctgccccccaggctcagggagtcctttcacctcagccacctgagtagct

SEQ ID NO: 80170 - DNA, 1050 bp, Homo sapiens
tgaagttcttgcggggagaggggagtcggactagccagggagccagatggaagagccagggagccagacagactagcgggaaagcctaattgtcgcaggaagggggtcaggaggttggggggtcgacctgacccggcctggagaggcggggaggtgggcgcgtgtcccggttgcttaggttttgggatgcctcttactctgccaagccgcttagcgggagggaacgtgttcctgatcatctttaccccaggcttctgtccggggcgtgtcaatgtagaaatcccccagcgaatgttggatgaatgaatgaagttgaagagagggtaggcggggaacgaggatgagggggacggctggagaagaggtatgggaggttcgatgtttcagggatggcacccaagggggacatcgaggcagcacggtagcacttcctttgcgatgaggggcgtctctttggacttcttggaaaagaggtgggcattggaaaccagggtctgggaacaaaccgtggtttggacataacatttgttaccttcactcttctgggagttggagaagtagaggaggaagttcagacaatttcataagtgtctaaaaagagacagttatgcgaccattgacgaggagtaaaagtcgtctattgagcatcttattcactacaaatagaagaaagaaataccagtttcctgacaagccccaccccatgcttggccagttcctgagtacacttaatatattttaggtactgtcatcaaactcaaagctcgctgtcagcctcaaaggtctgaaccctagtatagattcttgtagcttgcttgaagttacagtgggtcatgatcaggaattgatgctttgtttttgttttgaaacggagtctcgctctttcgctcaggctggagtgcagtggcgcggtctcggctcactgcaagctccgcctcctgggttcaaatgattctcctgcctcagcctcccgagtagctgggactacaggcgtgtgccaccacgccccgctaattttttttgtatttttagtagagatggggtttcact

SEQ ID NO: 80171 - DNA, 1022 bp, Homo sapiens
acatttgttctttttttttttttttttttgagtcggagtttcactcttgttgcccaggctggagtgcaatggtgcgatcttggctaactgcagcctctgcctcccgggttcaagcgactctcctgcctcagcctcccgagtagctgggattacaggcatgcgccaccatgcccggctaattttgtatttttagtagagatggggtttctccaagttgttcaggctggtggcaaactcccgtcctcaggtgatccacctgcctcggcctccgaaaatgctgggattacaggcatgagccaccgtgcccagcccatttgttcagttttagtatacagtgtttcaccctcttaaaatagactgaaagtcatgactgttgttaggacaagttttgaccacagtggattctggctgagtgttatggcctcattatcctttcctatttgatttggaagtggatactgagtagaagtacctgttatcattctgttgtaatcgtgataccacaactgtattctctcaaggaggaggaatttcattaaaacagtaaaagcaggatgagaagaaactaccccagatttggtggcagaaaaatttggatggtactgggagagtctaaacagtggttaaaaggtaagggctctggagtcaggctaagtttgaagcctagctctgttgtggttttttttttttttttttttttttgacagtctcgctctgttgcccaggccagagtgcagtggtgcgatctcggctcaccacaacctccacctcccggcttcaagcgattctcctgcctcagcctcctaactagctgagactacaggcacgtgcaaccgtgcctggctaatttttgtattttaatagagacagggttttaccctgttggtcaggctggtctcaaactcctgacctcgtgatcctcccacctcagcctcctaaagtgctgggattacagcccggcctctgttgtggttttgtgacctggttcaagtcttttagtctaaggcttaggtttagttttt

SEQ ID NO: 80172 - DNA, 2001 bp, Homo sapiens
gccctccttggcctcccaaagtgctgggattacaggtgtgaaccaccgcaccggctattaatctctttctttaaaacaataccgttaatccagttgcagtagtgaggcagggtacctctcaagatctcactttttctttgaccttgggcaagtcctttctactttctgactcttggtttccttaatctgtaaagtggaggtgataattgtttacaaaatctttaccatggtggcctacaaggccctacctgaccaggtccttagttttcttccagtgttctcttcactcatgcactctagccacactgtcctttgtgctgttgggttgtaggttgggcacattcttatcttagaatctttgcatttgccattcctgctgcctggaaagcttgtctctcaaataccgtatgacttgcttcctcacttccttcacccctctgttgaaatgtctcttcacagaggccatctttgatcactgtaatacagaactccctgtcattttctaccctttgattttgccttatttttctttgtagcgctgatcactaactgatgttacatcgtgtataagtatttatcttcttctgccaccccaagtgtaagcttcatgatggttggggctttgccttgttcattgctcagtgtgtagaacagattctggcacatagaaaatactcagtagatacctgttgattaaatgattgactagatcctacctcagaggaatacctttgaagatgtataaaatttctttgaaggctataaggtgccgaataaccttaggagggttcactgcttggccttagtagcgttcatgattttggattttgaattgtttctatgtaaccctgaaacactcagacttacttattgcattcagggtgtagttcatagcatcagcagttctgccaggtttgtaaggaacacacatctgttagagtgtgaaggccctggaggaagaaaggttgagacaggttgatgtgcttttttttgtctcttatggctctttctgagatgtgtaccatgatgataaccaggaactttttttttttttttttttttgagagacagggtcttgctcagacactcaggctggagtgcattggtgctcactataaccttgaactcctgggttcagggaatcctcctgcttcagcctcctaagtagctagtactaccggcatgtaccaccatgcctggctaattttaaaatttagagatagggtcttgctgtattgcccaggctgggctcaaactccttgcctcatgcaatcctccctccttggcctcccaaaagtgctgggtttacaggcatgagccaccatgtctggcctgataagtaggagcttttgaagtggtttcacactgattttgtagttttgaacttggatgcttcttttgggtagttgatgcagtaactaatactggtgctgtctttcagaacagcttcatgtgaaaaaggcctgcttaagcctgtgtctttgggaagaacatctctgccgctgttacagcagatacagtaatagcaaagaaagtcttaaagatgatttagcccatggcaaggaaatatatgggactcttgtttgaatataaacactcacagaattccagtttcacttatttatgcacctttcaaagaaaggaagaagatactgtggtagagtacagtagtcctcccttatctgagtggcatatgttccaagacccctagtggatgcctgaaaccacagatatcaatagtaccaaaccctgcatatactgtgttttttcctatgcagtatatgcctatgatgaagtttaatttataaattaggcatagtaagagattaacaataataaccaataaaaaagaattataacaatatattgtaatgacagttacatgaatgtggttactgtactcactgtgggtaactggaattgtcaaagcaaaactacatttaagtgggtactcctgtagctgttggccctgccttgcctatctagcttaattttcctctg

SEQ ID NO: 80173 - DNA, 2597 bp, Homo sapiens
gagctgtgaaaaaaggaagcagctgcccagatttatagaagcagagcttattagggctggatgggacctaacaggttctctagacctgggccttcatttgagagatgaggaaaccagacctagagaggtgtgaatttgccagagttcacactgctgcagtggaaggaggtggttgagcttttactcttatttttttatggtacatattacatacagtacatgttttcatttgggaaagttacttggtttgacagttttccaagtttacccaacattaaattttggtaactatgcaatatccttaaaaaaattattttcaagtaattatctgaagctctagaaaaggttacccctctatatcctcactctcctaggtggttgagggaaaagagaataaagaaaagttgtggggttggggctgggacagggaggaaagggtattttagtccttgatccttagtaggagggcctatttttaagcttcataatgtcagttttaaaagcagtggttttcaaaataaccgcagacgaaagtccccttgaaatggatgcctttctggaattgacctattttgagtttagctgttaccagaagggttcagaatctcgaatgctcttaaatgcatttacttttcagacaaagtggaaattgagtgcataatccacgtgggttccagattcaggttaaatttagaaatttggggagttgtggagagaagacatgaaatgagtcaatcgttgttttacaggtttgtccgaatccaggttaattatatttccttctttattgaattataatttgtatatccaggttagttttacaaattagatcagaccctcagtccatttgagagtagactcagagtcagaattatttgccccctttgctgctttcataccaccctttagtaaacagtcctcaagaatgtccttatgtcggggagggcagacctcagaagttagcaagaattccaagctcactgtaaaccttttgtttaatggtttactcaaatccagatagaaattctaccaaaatgccagcctgtatttcagctcctctttcttggagtctttaggatggtgggaaaacaggcagaagaaagctgtttaacattccaataattattaataatagaaaatgtatcctgctaatcaggcactcatttgcgtccactgataaaactaggtcattggagccaaggaaaggtaccgttcactaaaggaaagaccagtagatagtcaggcatggtggcgtgtgtctgtagtcccagccactcgggggctgaggcaggagaatcacttgaaccagggaggtggtggttgcagtgagcggagatcgcgccactgcactccagcctgggtaacagagtgagtgagactctgtctcagaaaaaaacaaaacaaacaaaaacagtggaatattgggctaagctcttaacacattatatttagagattgcaacacttcaatatttactggaatactcctataaaacggtctcttttgccttgttttattttggtaactaagtgaatgctgggttagccataaaggtagcttgctgcatttctatttcttgtgttctaaatcactgaataattttttaaaaaagtagttctaaagcatttccagttaaaaaggaaggcgtaacatttattaggggaagtcaaggggagaggtagtgaggaaagtaccagaaaccaccaacaggtgtttcggttacgttgaacaaagaatcagcttgatatgcagtccctgggaagagtttgtaaattcctgaaggagggtgagagctggaggggacacggtgagcggaaatggtgagcggaaatcagtggttcctgaggcacagaggacttgggttaccggaggcttgccctcagctgaggacctgggaacaattcctgagcaagttgcttttttgatagacaaggatgcatctgtaggaccactgctgttaatctgtggggcaataagaattgatcctactgcaagaaagagagtaggataagtcagaagacatggaacttgtatccctagaggacatcgcaactggaaaaatagctaccatttatgaaggcctacctcatctctttgcattcattatcttgaatttgcactaaaattctgcaagaaaggtcatagtattctattttacaaataaggaaaattaagctcagggaagttatttcataaggttgcacaactagtaggtggtagagctaagtttagactcaggtctgtcctactctgataggcatgctttttccacacggccctctcagtactgtgtaaaatgccagagggctttctggatcttcacttcccaaaactgctaaatttaaattaattaaaattaaagttgaaaaatcagttcctaggttgcactgcccacatttcaagggctcagtgtccatgtgtggctagtggctactatactggaccagcacggattagaatgctttcttcattgcagaaagttctattagtgctggtctagaggtcattcagttttgcccctttatttaattttttcccccttttattccacaaaggagaaaatgagggacaaagaaaggaagtaacgttcagcatca

SEQ ID NO: 80174 - DNA, 1089 bp, Homo sapiens
ttgccattgattcaaatggcatttatgttagagtcaaatagatttagattatggccaaaattacaacaatagatttctaacttgtatgttaagagtaagatgtattaacagtcattgaactgatgtttagtgtttaactcatacataccaggcactgggttgcaacatgaactaaaaggacttttgctgaaatggaaaaagatgtcttattatggacaagttgaatgcattttaaattcctgtctgaattatattgctggtatttgccatccatgtaccttcctgtttagccttgaaattcagtaaaagcctcagtgtggatcatacttcatagctctgaagtaaagtgaggagtcatgtgcaaatgtccttttagtagatgctattaaaaggcatttaaattatacactccagtgtctaaatgacagtctgaagtgtatgtgtgtttggaggatgggcaagtgggagcaaaaggaggcattgtgctggggcgattgatatttttaggaagcctaaatgtaatgtttgatttcggtataactaacagactcatggtttagaaaagttgtctatcaaaaactgagaaattgaggttttggtttcttcttaaagaaatgttcaagtcatgtgcatgagtatgctcagagagattaaaaatggagagaaattggaatggtggcaaggtatccaggaaagtacctgtcttctctgagagtccaagggcaggagcagaaaggactttaaagatggtggcaacaggctgggtgcggtggctcacacctgtaatcccagcactttgggaggctgaggcgggcggatcacctgagctccgcagtttgagaccagcctgaccaacatggagaaaccccatctctgctaaaaatacaaaaaattagccgggcgtggtggtgcatgcctataatcccagctacttgggaggctgaggcaggagaatcaattgtgccattgcagtccagcctaggcaacaagagtgaaactctgtctcaaaacaaaacaaaacaaaaaaaaagattgtggcaacagctggaaggggtccccaggagctctgacacagggttttccaactgc

SEQ ID NO: 80175 - DNA, 2535 bp, Homo sapiens
tagtgccactacaccccagcctggccaacagagcaagacttcgtctgttaaaaacaaaacaaaagaaaagaaaaaccaaagtaaggttaagagaagttggctatgtcacacagtatgttctatttggaattttgtgacttttgagtaacataacctaaaggccgtgtggcacagtggaaaggctttgtagccagcagactttgagtttgaattctgaccctgccttactatgtctgtggtcttgtgcaagtgcttttacatccttgggtctgttcccacatctgtaaaatgggcataacaacatttatccaacagaaaggattcatacactctgtgtgtaaactgctttttgtgattaacaagactaatgataacagccaagattagatccccagtgcaggttgccttactttctatcaggtgagaaggagagaaaattcttatttcccaaagaacttacagtgacggggctcttcagctgctctttatccaacagacttagaatagagacaacaccgggcatacttgcaattttttaggatgtgcaggaagcaaaagaattattttcagtgaaacaggagtctgcaaaaggtgccttaggaaacaactgccacacagtacatcccaatatagactcctcccagcttctctagggcagccatctgcctgacaggccccacccagataagcccagctttcttctcccaagagtttaaggaagatttcctgatgtatgtgtgcgtgtgtgtgggggtggtatggggttgtgttgggcgggggtcaagaggggtgttaatttgggatgggtagtcactggcttttggtggcataactggaaggtaacactccctgtggctgaatcctgatccctgtggggatcagcgcatggttcatccagacatcttcctcagtgggtcctggcctctgctcatactatgtcttctactggggattcccgtctccacctccaatatacgtatgttgaaatcttcatcttacgtcaaagctcaacttggaggtcatgtcttatgtaaatccatcacagacctctcctccaccccatctgggcagcggtcatctgctccaccctccggagcactctgtacatattccatcacacttcagttacttatgtaattgtctagtcagcagaagatactcctctccaaagggcaaggttctgctaaccgctgtgaagcctggctttgagtttatgaggggtgattcttttcagtttataatttcttggcacaggagggtcacagtgttgttggtaaccgtagcatctgtcctgggaggctctgtatgctcttcattgttcatacatccatttatttcttcactcagccacatgaggcatgtgggatgtatgttatctctgcttgatacatgaggaaactgattctggttaaaggacttgtgcctgtcatacaggcagctaagagtgcctatagtcctttgtattgccttttcagccaacagtcccatcccagcccaaaggaggaaacatttggggagcatatactggtgagaacatcttccctattctgtggcgttctcttagccttatgcctggcacagaggaaggctctgggaatgtttgggccggatggatctgggagcctcttttgcatgccaagctgcatacttatccctagcaaatgctggtctccttgatggatatgtgacatgggtggctgaatttacatggcacctggtggcttctcacactcctccgccacgcctctggggactaggataggacagatggccacagacaggattctcagctctgcaaatcacatttgggaaaaagttaagtttgtgcaataacacaattttggtaacatggtttcatgctgctggtaaattctataacactctctggataaatcacacttcagcagaactcacttgggaacagagtttaatttcactgtaggtggctgtgattcccacccaccagtcttcacacccccgctaatatatctaggctgataaggtgaatgctgtgctaagcaggctatttctgggcccaggatagaattacattgtggtttttaaagaatttttttctgtatatttttctattcacagaccctttgaaagaagaattacattatgttaatcatccgtttccccatcagcacctttaattccttctccccagagtataaccacttgtccttaaaatgacagaggtggaaaagatcttgatagttcagcctcctgtatgtatatatgaagaggttgaggcccagagagactgggcagcctactcagttgtcagatggctggtgaagacctgcatccggatccgttgacttctctcctgtgcagggcccttgttttttgccctgccctactgcttaaccttgtcttctgtcttacaactaggggagagtctatggcatgttcagtttgaaatgaataaaagtgaatacttgttcattgttaaaggaccccaacacagaactaatttcctgttaacccttacattttctcttgacatatctttggtgaggaccattaaag

SEQ ID NO: 80176 - DNA, 1039 bp, Homo sapiens
aaattctcatccatttctgtattgtaggcatttttttttttcttttggttttagtgtttattgtatacctcacactgggttagactcaagtttgggggatacttccagcttaattgagggtatgagcatgtaattgcaaggcattgtgacacatgctctaactctggtgtgtgatacagcacaggctatgggaactcaaagggtgagtgactaacgctgtcttgaggagtgaaggactgtatccccaaagcagggatctgggcctgtcttggggtttttgggtcttctgttttgttcttatttttttcttcttcttcttttttttttttttttcctgtaaccttatttatggtgaagggacttttttttttttaattgtttacacttgcccttttgatatcctctgcattcgtggctcttatcatcatcttagacttgtgaacctgcctcaggtctctgttaggagtttctggcctatctggtcagccatatactgagtagctccacacgtagagcctgcaggttatctccaactcaccttttccaaaaaatagatttataatcctcttgtcgcctgtgatgacctctcatgctaactacccagagtcaggcagacctcataggttaaacacacagtcctctgtaagactgcccttcataagactgttacaatctaaggggtttcctgaccacacacacttctgttgaactagctacaaattggggttttcactatcctctcaggttccatagtttgctagagcaattcacagaactcaggaatgcactgtacttctgattacaattttattatagcaaaaagggtacaaatcaggagcagccaaaagaagaggcatatagggtaaggcctgggagggtcccagatgtaaagcttctggtgtcttcacctcttggaatcagggcacagtcactctcctagtacattgatgtgtaacaatatgcacagagtattattaaccagggaagctcccctgagcttcagtgtccagagtttttactggggccccattacataggc

SEQ ID NO: 80177 - DNA, 2174 bp, Homo sapiens
tgtaaaatgagaattggataagttggtcttcaaggtccctccctgagatacattttatgctgctgcttgatttaaaccactgagccacaaatgaaaggttccagttgcaacagtgtaattaggcttagcagatgggtgagatgaaaggaaggacatgttcttgcccataggattatcctttcccacccatttccttgcacctcactggtgtttccaaaaagcaaatgacaacccttgtttttctctgcattcccattcaaacctttaatcttcttttatcttgatgaacttgtatttaccgttagacagccatgatgcagaattcacattacagtgtgtggttctaactctgccatggtgaatgtgatggaggttggagccgatcacagctggtccctggagagagggctgtgtgtgtcagatttattgtgctgcagctccagttttgttttggtttagtttttaaatccccagtgtcagttttgctgatttcagttaaaactaaagattgtgaagggagacagagacaggttcatgccctctgagttttagagattggtgatatagtcgttgggtgagggccctctgtcttatatcctttgcttaaaacatttcaccttggaaaggcagaaattagccttgttgaacttcaactccctctgcaagaggaagaaatactgaatactgtttcattattgatatctttttaatgagtactgaaagccactacaggatctttgtttcaccttcagataaaatgtttcatctttcattctctgaaaaaaaaaattgagtattttaagaataattaaaggaaaggcagtagtttctggatcctgccgttgctgccttggcctctcctgccttttctccacttccactcctctccctctatattagtgtagaaatgtgtcaaaaatttcttgcttcttccattagtttctattttgacccaccccagtgaatgaaataagcatagaattgttacttctattttacagaagagaaattcttatttttttgttgtttttatttttaagttcaggggcacatgtgcaggatgtgcagatttgttaacataggtggacctgtgccatggtagttttctgcacagatcatcccatcacctaggttttaaggccagcatctattagctattcttcctgatgctctctctcctcccccactgacaggccccagtgtgtgttgttcccgcccctgtgcccctgtgttctcaccattcagttcccacttactagtgagaacatgcggtatttggttttgtatacctgcgttagtttgctgagaataatgacctccagctccacccatgttcccgcaaaggacgtgatctcgttcctttttatgtctgcatagtattccatgatatatagaggagaaatctgaaatgtggcaaggttaagtgacttgtccatggtcacacagctggttgatgaacaatttgtgataagaatccaggactcttgaatactagtgatttgtcaacacgattccatctccagtcctcatccatacacacctgccattaggaaagtctttaccaccccagcctatagtctttgtcatttctctcactggccagcttctgaaagtacaggtcagaagccagttcattagctggtagggtgggtggttaaacggcaaggcataggaggtagaggagggagaaaggaagcacaaagctcaggcttagtttttcctccagaaggtgtaagaattacttatttcaaagagtcagaaaagtgaacagagtcagcattcccttttcctttgcaaattgattgaatttctatggcgagtattagctgcaaggcagtgttaatctgctccagcagatccatcatcagattgatgtgcaggggagacaggattgtctctggtgcaaaggcctttttgtgtagggcacaccatctttatgtatgattgaggcctggtgtgttaaatgcctcacactgggatcttacccatgtttgtcagttgcctcccttgaaagtattgagctttttgaagataatatagcatcatggttaaggtaagacattcgttctctctgcctgaatttgaaacgtggctgtgccacttaccagctctttgacctttgacatcttagttcacctgtctgtgcttgagtttgctcatctgttctaattagg

SEQ ID NO: 80178 - DNA, 1038 bp, Homo sapiens
tgttctgggttcccacaccttagggactggggacactgcaagacatagccgaaccttggatgaaaatattgagtagctgcctcagtttgcttggactgctatgataacatatcatagactaagtagcttagacaacaatagtttattttcccactgttctggaggctgaaagtctaagagcagggtgccagcatggttgggttttggcaagagccctcttcctggcttgcagatagctgccttcctactgtgtgcttgcatggcctttctttgatgtgtgcagcaggtggggtggggggaaaatcagtgaggaaaatcagtaacctcggccttgcatcttctttggtcccatgcatgatgttatttgtaaggcagtgtcagatctcctcatacatggagaggcattaagtcttcatttccctgtcttctagaggtttgggatagagggtgtgaaggaagagcagattatgcttactctatcttttaagctcagaactggggtgtgtgtgttggcaggaacaccaacatgatgatgtataatgaaggcctatcttgtcacctgtgtcacttcagccaccccacacaattgtcactgacatgcttcacctcccgggacttcaatttgaaacccaatgaaatccagtgaaacacagtggaaactcttaccaccttcctgttaaccaactcacaggagtgatgaacacttttcagttccctggatgaaacactcttgagcaatgcccacagcatgctgaatgcactgcaggcaggctgctctctgccatacccactcgcttcagcacccactggctgaattatgtgcttaccaagagccagcttgttcccaaacccatttgttcagctgtagctggtattgtagttaagtaatgtatttaggtatcagataaactgatgaaatgtagctgcaaatgaagtgatttttttcccctatgaacactagttaaaagctgtggaaagacttataagtccaagtcactaaaacacattactgtcaaactagatgaacattaagattgg

SEQ ID NO: 80179 - DNA, 1050 bp, Homo sapiens
ttgcgtatggtaaaaacaataaaaccaacagtagtggggctttttaaactggggttttaaagcaaattaaggtggctcattctggattttagtaggttcttttgttcctctcattgacttgcagcatactgagtgagaaagacctaattttttcactttataaatgaggaaattgaagccctgagaggtaaagcatgttggtgatagtcatcccgggtggctggagtgaagtgggcagagccacagtgggagggggcctcctctctagcctcccactttgattatctgtctggccccagacctggagctttctttccatgataggagtacttctttgggttgacttctctggtgacagtattgacttgtgctccccactttggaacaggaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaaggtgagtttgccttgattaacaggtaattggattatttctcagggtacttagaagcctggggaccagggtagaaggaagactgattttactcaatacctttttgtgctgtttgaatttttttttttttttaagacggagtttcattcttgttgcccaggctggtgtgcaacctccatctcctgggttcaaacgattctcctgcctcagcctcctgagtagctgggattacaggcatgcgccaccatgcatggctaatttttttgtatttttagtagagacagggtttctccatgttggtcaagctgatctcgaactcctgacctcaggtgatacgcccgcctcagccccacaaagtgctgggattacaggtgtgagccactgtgcccagccgtgctgtttgaattttgaatgcttgttatctatattagattatggataaacacactaatga

SEQ ID NO: 80180 - DNA, 1071 bp, Homo sapiens
tgcagtgagccatgatcatattactgcactccagccaaaaaaaagagtgctgtcagggaatctgggattcataagcatttcccttgactgctcttctttcctttcttttattatacctctcttctctctgtaccccctataccttttgctctggcttttgttacatcctgtattaaaattttagataatttatgttatttttcttttttgagacaaagtctcgctctgtcacccaggctggagtgcagtggtgcaatctcagctcactgcaacctctgcttcccgggttcaatgagttctcatgcctcagcctcctgagtagctgggactaccggtgcacaccaccatgcctggataattttttttggtatttttagtagagacagagttttgccacattgcccaggctgatcttgaactcctggcctctagcaattcacccgccctagcctcctgatgtgctgggattacaggcctgagccaccatgcccggcctaaaaatttagataatttattggaatgttgtgtgccaatgaaaagcaaatcctaagctcctgcaacatcatctcatgtttaattgtcagggtttgtgggccctctgggtcaggggatgagcagtgaattggcagagaggggtgtagggagggtagagaaggagagcatttcaaaactaatgaggcttggaagggaaggaagaaaagaaacttaaaatgcagtttctgggcttggttgtaaaaatcttgaaagtgagggagataaaaatagttgcttgttaggacctggcaggcatgctctggaggctccctgtttgaattcagttgctaatcaggaggtgggaaacaacctctggttcctgctgttagcacctttcttgcagttggccttgtcaagaaggataatgggctggagctgagaaagaagcatcgtgctcactcgctaaactggagtggagaactattctctccttactgaatttcagggatttcagcctgccccaagtcaaatccttgttcccagaaataaagctcattacatctgtaatgtgaatgattccttccccggccacagctc

SEQ ID NO: 80181 - DNA, 1039 bp, Homo sapiens
tcccagtgtgaacacatcctcattccttcttgctggcacctaccccccactgtgactccagccactgtcaacatcactcacctggcactgacccacatccccacccctcccctccagtgacccacagtggaactctctttctctgtcatctcctcattgcttcttccctaaatgtctaataactgagcagctggcatcctgggccatttgactgccaactctcaagttcaaaatccattaacaggccctgggagttactaatcaagggtttaatggttggggtttttgtggttatatggtcagttacgaaatagtccagtgttggagttagtgaaaaatgctactggagaagttaatgtctacgtgaatatactatgggcagaataaagattttttcggtagggttcttgaaatacatgtgctatttcaaataatgctcattaaaaataatgcttttgtatagcactgtatactttttttctctttggcttttcccaccaatatcaaccaatatttgtattgcattttacaacatttgacatacattttctttttttttttttttttgagacggagtctcactgtgtcacccaggctggagtgcagtggtgcaatctcggcttactgcaagccctgcctcccaggttcactccattctcctgcctcatcctcccgagtagctggaactacaggcgtgtgccaccacgcccggctaatttttttgtatttttagtagagacggggtttcaccgtgttagccaggatggtctcgatctcctgaccttgtgatccacccacctcggcctcccaaagtgctggggttacaggcatgagccaccgcgcctggctgtacattttcatttgatttgatcttcttagtaatcctaagtagagttttcttatatcattgttactgtcattttcatcatcatcagccaccacccccccccacctttttttcttccgacatggagttttcgctcttcttgcccaggctggagtgcagtggtgcgatcttggctcactgcaacctctgcct

SEQ ID NO: 80182 - DNA, 1053 bp, Homo sapiens
acaggtgtgagccactgcgtcccggcccagcagcagccccattttatagatgaggctgatattcaggatcttttagcttgtaagtcccggaattgggatttaagtctcaggcccactgaccccagatcttttgttctatgtatccacggcaccacctcactcccaacccgcattccacaagcttcatgtttcagattcagtgacaagatgagcctctcatgctgggcttcggacaggctgccctgcgtgtgcaagactgtggccaagctgggtaaagctggaaccacaggctgtagtggcagccagggcacagctgattacatgtggtctgtcaatttaggccagattataggagaaatagagcagggatgaggggttaaagccacagaagccagctaggatttggtaaacacagtgttgggggtaggcaggaggccaaattcaagaggttagtggagctcttgaaacaggatatgaactattgagaagggacagaagagaaaatgcattagcagacccaggggtccaagttaggttaggtgattatcactgtctgtctctcctgcagccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctgtgagtagcctggtgtgtccccatcttggactgttggaggggagggtcccttactttcaggggtttctggagggctgattctctgtacattctgccaagactgattctctgtccctggatgccaggctagggccaggggaagcagcaagggtctccaggtgggtgttgttactaccaacaacttcctaccatttgttgagtacgtactatgttctaggtactgcacttaggactttatacattatctaaccttttgtatttattatttttattattaagggtc

SEQ ID NO: 80183 - DNA, 1050 bp, Homo sapiens
tacccacattcaccaaaatttcactgtaattcagcctggcacaggttttgatcatcagcatacacacaaatagccccaagcacaaagccaatccacttaggggaacaataatagtaataagaataaagacagtaatattaaaaatgacaagagtagaatcttggcacatgctgtgttcttcatcctttgtcacaggtgaaatgcacatctgaacagagacaggcatgggaaggaggcccaaaagcgacatggcaaaccaccgggcaggggactcgctctttgttgcttcccaaacacttagacgccagcagcatgggttggtgtgctgggctggttaaggccgatggtggagcagagccaacctgcaaaatccacttcctcagcatcagatctcttgataaaagcatgaacctgcatgtaaggaaacgagaggacgtggtgttaaaaagaaacaaaaaaacaaaacccaccaggaaggaaaatccaagagtttcaggtctagagcttgtgctgcacttggaaagagcacctggcacctgcccctgagcaacagtggggccagctgcaggcccaaagacctgctccaccagtcacagcagctgtgaggccttgggcaagtcacctcttggagcctactcgtgcagtatggagacagtaactctgccttaaatgcctcacaggcttgttagaagggacaaagaaaatgatggacttagtgcatattatatactatatacaccgtctatggctgtccagatatttacagtattacttagctatttccactgccaccaaacgagacagcaggcggagagtgactctggaaggaggctgaatgtaagatgaggcagtcagtattagggaaaggccgcatccccatgaagggggtgggctggccttttctttcccatggccccctcaggcatttcctctggcatatgcttactcaggctgcgggggtcaccccagctttcccttaaactgatgggagagcaaaggagactggtgtttggtattctgcagccccaggctcagctggaccacagtggg

SEQ ID NO: 80184 - DNA, 1153 bp, Homo sapiens
ggagcaggtctttgggcctgcagctggccccactgttgctcaggggcaggtgccaggtgctctttccaagtgcagcacaagctctagacctgaaactcttggattttccttcctggtgggttttgtttttttgtttctttttaacaccacgtcctctcgtttccttacatgcaggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtt

SEQ ID NO: 80185 - DNA, 2880 bp, Homo sapiens
cggcttcaggaactgcgcaaggaggaggagacgctgctgcggttgaaggcagccctgcacgaccagctgaaccgcctcaaggtgaccccgcggccctctcctgcccctcctccattcctcccgagcgaccatttccccccaacctgggcctctgtggtgaccacctgctgcggccagttctccgctactcactagctgtggtggcgccaatttagaggtttacaaacaaacaggtatctgaatcacctggggagtttgctgtgcgcttcttaggccctatctttcagaatcgtgacctcgcaagtctagggtgaggctcagggatctgtgtttggcaagtgcagtcctacctgctgcttcctgtaaatgttcatcgccctcagacagcacgctgaggaagtgctccctcccgaaggctcgcctagacccctctggccaccgaccccttcctcctgagctgctgttttctagtttgttttggcgcttgaaatgctctagttttgccaagccagaaggaactcctagatcctcccatgctaccaaggaagaaactgaggccctgggagaagagacttgtcctaacgtctggagcttccggtggctcttgttactgacgccatggccttgaggaggagtcgggatttaggcccacgtgggccacttcccaaacctgtgcttaatgcagcccctcagcccgggcaatatagtgagacctcgtctctacaaaaaattgagacagggcctcactgtatcgcccaggctggagtgcagtgacatgatctcggctcactgcaacctccgccttctgggttcaagcgattctcgtgcttcaccttcccaagtagctgggattacaggtgtgcaccaccacgcccggctaatttttgtatttttagtagagacggggtttcaccatgttgcccaggctggtttcgaactcctgagctcaagcgatcagcccgcctcggccttccaaagtgctgagattacaggcgtgagccactgcggccggccttacaaaaaaaaattaaaattagctgagcgtggtggtgcgtgcctgtagtccagctacttgggaaactgaggtgggaggatggccaaagtccaggtggtcaaagctgtagagagcccagattgtgccactgcactccagcatgcaactatatggggagaccctgccttaaaaaaaaaaaaaaaagtcccagggaggttattatgctaatccctgctcagcattcttttcagaatcttttttttgagacagagtttcgctcttgttgctcagcctagagtgcggtggcgcaatcttggctcactgcaacctccgcctcccgggttcaagggattctcctgtctcagcctcccaagtagctgggattacaggcatgtgccaccacgccgggctaattttttgtatttagtagagacggggtttcaccatgttggccaaggtgttctcgaactcctgacctcaggtgatccacctgcctcttcctccctaagtgctgggattacaggcgtgagccactgggctcggccctttttcagaaactttaagtccatatgaggtgaggattaccaaagccctttgtaaaaggaaaagtattgtacacctgtgacatatcaaaatcataagcatttttccttagggaagttatacttttagtagagacggggtttcacagtgttagccaggatgttctcgatctcctgacctcatgatccgcccgcctcagcctcccaaagtgctgggattacaggcgtgagccaccgcgcccggcctccttagggaagtcataatgccctccacttatttgtgtttctatattgccacggtacccttacaagtacttaatgagtgtattgatgaccacctccaaagcccagatttccttatgcttcagcaaacacctctgttttctattcttctttccttcacgttctcattactgagtaacagcctcaggtccagggaatctctctctctgaggaatcagatgacacctggctgttttaatgacacacttgtactttgagttgctaggtctgtagaagtggaagccatgactcagccagaacacctgttcagcccaggggagaagggctagagtctttctttactcatctccttaaaagagagaaaacctaagagcctaccccctcaactttccctctagagcaacacagagatagttttcattccctctcttgatgcaaatgtttcatagtgtgcccagcagtttacccacatcagtagtccagtgaaatagtaaggaaaagtgtcctcaactcttcttttctaggttgaagaattagccctccaatcaatgatcagttctagaagaggggatgagatgctgtcttctcacactgtacctgaacagtcacatgatgtaagcttaatcaagtgcaggcctaggagagaatgcaaagtctgctctgctcccatgctgcttgggtggtgaagaactgttgtaaatcacattacctagcccaaagggctctgagaagtgctgataacagttttctggtttaataaggtggcaactctccattaaccaccttcctaccagctagttatacactaattaattaagtagttactaatgttttacctccatcctcctcgtcatccattctgtctagttactcagatgaacccgggggagagtggagatttttgtaggacgatgtcaaaactcttgattttttgtgaataagtaaccttgagattcaagagtgtggcttcaagtacaaggcacagtgctaaaagatgagctccagttctcatcatactcatctcttaccaaatgccctcaagtaagtcagcaaaatctaagtacacaatatttgagcagttctcccagattttgtgtgtta

SEQ ID NO: 80186 - DNA, 6176 bp, Homo sapiens
gtttgtccgcaaagttaaactttcgtttcaagccacccagagctatttactatgtcaatagtcttcaacttccgtctgcaataattaaaataagagcagtggttggggagaagatacctcgactcgcgagagttggcctcgccccctatggattattccgcaaaaaggagtccctattttctaagaattattattacgtttggaagaaaatagataccgtaatttcccacaaataaagaaataacactctcgtttttacttttgtagtgtggtagagagatattttttgtatccgtgttggttcttaggcggggcaaggtggggcggtcaaggggaaggtgacatatacagcgggagtggtaagcacttccttttcctgtggcagcagccgggctgagaggagcgtggctgtctcctctctccgccatggtgagtggaagttctcttggctggccttaccccgtatctcggggccagtaaggaaggatttggggttcggagcatagaatctgtaggagatagagcgaggagagggagatgaggaccaaaggcgtctttttctggtgtggaactgggatgtgcggcgatacggcagccatcttagaggcaacgtggggttcccagcacaggacgcgccgggaagcagtagtggaaagcactgggtcgttctcaggagcagtgggaccttctgttagaatatttgcttatttagcctttttctggatgcttgtctctgcctagcttgggaatcatttctattaaaagctttctggttctcttcgcctaaaaattgttcggtgttatcaaaatctttgaatccttagccaactcgtaataagaccagtgttatatgtgtactgcttttccacaaatagtgttcgtatatactatgtagtgttgtgtgccgggggagttaagcgaacaaaacagacactgtcctgactgggatggtagttgcgttggactaaatacgtagtaatattctatggtagtaagagatgaaaacatagggaataggagtggtttggctttaaacagtgatcagagaaagcttaaagtggcctgaaggatgtgagaaagctggcaaagaggagctttagagtgaacacttggaaagtctgaggcaagtgctgggtggtcctgagaccgaaaaatatctggaagagtgtatgggagttgagatcagaagtagagaagatggtgtaggtcagcctcaggattttcagtttactcacagttgggaagacttggaggtttaaacaaaaagtaatatcaccagtctttccactggtgagctttggaaacacgtgtttagtagagggtgagggtgagtgggacagggatggaagttgggatgagtagagcccgggtagacaggatttgctgattaattggcattaaacagcatctccaaaccttacaatatggttttgatttagctattgtgctttataaggcttgctttgaaagttttatgataaacaattctttttgaaaataaaattgtgcagtagaggttgagattctaagggttctagtcatttactgctattttggtttaagggttgtttgcctcaccataccagtctcttctgcaattgagtatttaatggtattgttggcgtatgagaagagtttgcttcaaacattacttgtcaataaaaataatccttgtctttttctttaggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtatggatttatatcttctgcagatattttagggactgctttacagtagtgatgaaattccacttcattggtccgtgtttctgaaccacatgattttctcggatgttctgatgctgtttgctaccatgcataatagtcatgggttggtatgtatgatgaagcagctacaacttttatctcttctcaattttaggtcatcagactagtgctgagtcttggggtactggcagagctgtggctcgaattcccagagttcgaggtggtgggactcaccgctctggccagggtgcttttggaaacgtatcctttgtttcactacctaagactggtcatctctgatggaatttagcggcctgggtctggtttattgatgataatacggtgtaaaaatattacttttttttgtcttgaagagaaggggcttcatttatatggggttattttgcttgcaatgatgtcgtaatttgcgtcttactctgttctcagcgacagttgcctgctgtcagtaagctggtacagaaggttgacgaaaattcttactgagcaagaaataaccttgttgtaattactaaaatttgagaaatgtgattcttgactggaaaaatagatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtttgtaatactttatataagagagtttgatagaagaaataagacacctactatttgatcattagggtgatttttattcacagtaacccatttcaagatggctagaagagaataatttgaatgtttttagcataaaatattttagttcatggatattccagttacactgatttgatcttgacaaatgagtgcattcagttatcaaatgtactccagaaatacatgttacataccggtttaaaaattttttaatcaaaaatatttcgtatcagtgatacaaaatgccccactttttctttcacgtgaacctttgttaaaattgcacattcttttcattctgaagtgtctgattaaattttaatcctttactaaatactaggtctgactacttaaatctgacaaatcaatcagggaatactagcgtaactggggaactattcaagtagtagtttagtatatccttagaaaacttccaacttaaacttgcctgttgcgtacccatcgcatttttatttaactgtcaaaatgatgagattccacttaattggtccgtgtttctgaaacacatgatatttgtggaaattctgacttggcaaacggaataccattttgcttttattggttgtataaaatgtttgattttttttttttctccaaaagtttcaggataaccaagtaagtgtcattggtttttgttaggtcatcgtattgaggaagttcctgaacttcctttggtagttgaagataaagttgaaggctacaagaagaccaaggaagctgttttgctccttaagaaacttaaagcctggaatgatatcaaaaaggtccgttcaatgagcacatttacagtttggtactccttgttcacagtttgtcactttgaatttcagaagataagggcagtatagctaatccttaatgtgtgagagaacaagaacctcagagcccgattacttgggtttgaatcctaactgctgtttatggctctgtgtaaccttggcaagttattgtgcccagtttaatcatctgtaaaaaggaattaaaactctgaagatctattgcagagattctatcttaatcagaatactaaaactgctcactttgtaggtctatgcctctcagcgaatgagagctggcaaaggcaaaatgagaaaccgtcgccgtatccagcgcaggggcccgtgcatcatctataatgaggataatggtatcatcaaggccttcagaaacatccctggtaattaaactgcttacatatattgactaggtatactctgcaagtctactcagcttttgttatgatgagattccacttaaggtccgtgtttctgaaacaaatgattttgtggaagttctgatttatggctgaaagagttgcaccattgatggttgaaacttcataattaataagttctcaggtaccttttatagctcttaagccataaagatgatttgtgtttcttttgttggaatacaggctccctaatttttctttccctttaaaaggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaagtaagtatctttcatatactaagcacagatgtttatattgtggatattaacattcagaattggcttacatgttttctaaatttattcccatttccccttatgtgcagcaacagtatgccaaaatgagactcacctggtctatatttttggttttttgttttgtttttgagacagagttgttctgtctcacccacgctggagtgtagtggtgtgatcgtggcttactgcagcctccgcctcccgggttcaagcagttctcctgtctcagcctcccaagtacctgggactacaggcttgtgccaccacacccggctaattgtagagttggggttttaccatgttggccaggctggtctggaactcctgaccttaggtgatccacccgcctcggcctccccaagtgctgggattataggggtgagccaccacacccggcctggtccatgtttatgagaagtgatagtgtagtagatattttggagagcatagtggctaaaaataaagcttcagttgagcttcctgttctttggttgattacttttacatgtacatgtcaatcttttccctttcagtcttcccatgcacaagatgattaatacagatcttagcagaatcttgaaaagcccagagatccaaagagcccttcgagcaccacggtaaagtgatacttagagtgtaattctcgccccaaccctatactattggttgtttcaaaaatttgtatgtgtataatgttaagtaaaatgttgatacagtatctgcttttttatagcaagaagatccatcgcagagtcctaaagaagaacccactgaaaaacttgagaatcatgttgaagctaaacccatatgcaaagaccatgcgccggaacaccattcttcgccaggccaggaatgtgagtggagtttttgtttgtttgtttgtttttgagtcggaatctcgctctgtcacccaggctggagtgcaatggcgtgatctcagctcactgcaacctccacctaccaagttcaagcagttcttctgtctcagcctcccaagtagctggcactacaggcgcacgccaccatgtccggctaatttttgtattttcagtagagacggggtgtcactatattgttaggctggtctcaaactcctgacctcaggtgattcacctgcctcggcctcccaaagtgctgggattacaggcgtgagccaccgtgcccggctggtttgttttgtttttgtttttctcttcctgatacattaagttcttacagggatttgattcttactgttttctgcctaatttgttgcagcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaacatgacttggtgtgctctgtaaagcttggttagaatttttttaaagtgacattttgttggccataatttagactgttacattttatatagtgtggtataaaatggggcatggatttatactaagtccatggagttcagtggaaggggaatgatttaaaaaaagttgtggttttctaaataatgtggcttgaaaaataggtgtaacaggacttggtcagaaacgcagaggctgttcaagtttagctccccaccagatggaaaataggttaaattctgtaa

SEQ ID NO: 80187 - DNA, 1060 bp, Homo sapiens
ctcctctcagcccggctgctgccacaggaaaaggaagtgcttaccactcccgctgtatatgtcaccttccccttgaccgccccaccttgccccgcctaagaaccaacacggatacaaaaaatatctctctaccacactacaaaagtaaaaacgagagtgttatttctttatttgtgggaaattacggtatctattttcttccaaacgtaataataattcttagaaaatagggactcctttttgcggaataatccatagggggcgaggccaactctcgcgagtcgaggtatcttctccccaaccactgctcttattttaattattgcagacggaagttgaagactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagtgagtctagtctcttcttttggctggggtcctgggacagcacttctttccctgggtgtctggatccccgccctaagcctcttgccactctggggatcagcgctttgccagctttcctggggtccaggagttggggagaggccggttctcggctccggtgtggggttgaccgtgtgggagcttgcttgtctcaggagaaaacgtgtacgtcatcaaacgagatggaaggtggcaagtgttccaagaggcgatttattctttctgctgatggacacacttgccataagtagaggcaccacccgggatacggaaaactaggtgttggcatccttcccctgtttaaagccttgttgactcctaagaatgaaatgtggtgttagtctgttaatctctattattcgaggtagttgccacatcagctacaattgtaatgatagcagattggtgtgttgcattttgaaaacacctttattttttcactg

SEQ ID NO: 80188 - DNA, 1053 bp, Homo sapiens
ctgagcacttaccaccatggaactgtggtttacttgttggaatccagtcaggactgtgaaccagggactatgcttttgtttgatattctcagcatctagcaggagtgactggcctctattaaacatgctggagacattattgcaagactgattaagtgcatggtgaaaccccatctctactaaaaatacaaaaagaaaattaacccggcgtggtggcaggctcctgtagtcctagctactctggaggctgaggcaggagaatggcgtgaacccgggaggcagagcttgcagtgagcggagatcacgccactgtactccaactccagcctgggccacagagcgagactgcatctcaaaaaaaaaaaaaaaaagactgattaaataacatccctgagttatacgtaagacataaacatctgtaagaataaatcacgatctttcacaatatggcaaaagtgaatcagtcataggcctagctcttctgtttctatttcaggaagtcatatagtattagatcaaatatagatataaatggtttcttgaaacagttctgttgggttccttcaatgactaaagatttcttttcagtgtagatcaggctggtgtgtattttggtatgttaatggattacagtttaagtgctttagattcactattttaaaactttcttgaattaaaggataataattaaatgatatcctggagtttcatgcttacattttgaaaaggaaatggtcaacataatcaaatttactgactttgagtaacaagttataaaaatggaggacagatgcttccattttagccatagaaatctaaggcctaggacccttaagtaacttctctgtggttacccactgattcagtaacagatcagaatccaatcatttttactttgaaaggtcatgtggcaagttacattttaattttaactggtgatgtgtttgaaaagacacacagtagaagcaggcaacccaatttcctgctgcctctgagaatcagttgtacccaattgagggcaacagtctattaatctctgtcacagttttcttt

SEQ ID NO: 80189 - DNA, 1104 bp, Homo sapiens
ccagcctgggcaacatagtgagactctgtctctttttttttttttgaaacagagtctcactctgtcccccaggctggagtgcagtggcacgatctcggctcactgcaagccccgcctcccgggttcacaccattctcctgcctcagcctcctgagcagctgggactacaggcgcccgccaccacgcctggctaattttttgtatttttagtagagatggagtttcaccgtgttagccaggatggtctcaatctcctgacctcgtgatccacctgcctgggcctcccgaagtgctgggattacaggcgtgagccaccgtgcccggccgagactctgtctcttaaggaaattttccattgacttgcatagaactggtctttatgtgtttagatagtagaaatatataagtgtatgtataatgttgctcgatacctgttttaacaggctgatgtccaagtgcagttgatcagcaaaggccaaccaaaccctttgaaaaatattctaaatgaaaatgacatagtattcatagtggaaaaagtggtaagtactggtttgactttgtggttgtttaattctccataaccaaatttggtttcttgggaataatctaacgtacacgttttaaaatcagcatcggtgaaaatgagttctcattcttttaggagtaagtgtagtgctgtccagtacaaataaatatgaaccacatatgcaatttaacattttcttgtagcctcattaagaaataatcgataaaattcacttatttctttttttttttttgagatggagtctcgctccgtcactcaggctggagtgcagtggcacgatctcagctcactgcaaccttcacctcccaagttcaagcgattcccctgcctcagcctcccgagtagctgggattacaggcgcctgccaccacgcctggctaattttttgtgtgtatttttagtagagaaagggtttcaccatattagccaggatggtctcaatcttctgacatcgtgatccactcacctcggcctcccaaagtgctgggattacaggggtgagccaccacgccctgctgacttacttcttttgttgttcagttccatgaattttaaca

SEQ ID NO: 80190 - DNA, 1067 bp, Homo sapiens
ttaactgggaccacaggtgcatgccaccaccctggctgattttttttttcttttctttttttggtagtcacaggtctccctgtgttgccttggtttgtctcgacctcttgggcttaagtgattctcctcctcagtctcccagaatgctgggattacaggcatgcgacaccatgtcctgccgagcacttccttttctaaaagcatcagttgcttcctttgctattagcaactaaggtcaatatctttttataggacagttgaaatgctcctgatggcaagattttttggtaccaagctagtttgtggctattcttgccaaaacccaatcatttgtgcttaagggtataaaaataagtacattatgttctacttgtcattattctgtagcatagtaaagagtcagctgctatcctatatgctcttttgtctggttaaataattaagaacatttttaaagcctttagaaaaggaagaaacaagtcatattgaagaacttcaatctgaagaaactgccatatctgatttctctactggcgaaaatgttggaccacttgctttaccagttgggaaggcaaggtaggttttctcttatgctgagtaggggtggcaactaggatttaaattgaaacattcttataaacgttgggaaaaataggcctctagcccttatatcttccttcatctcccccaccccctgataagtatacccaactaaggatagttctacttgaatatttgataggtatcccaaatgtgaccaagaatactgcacttatcttccctttctctacacctctataccaatttattgttgtttctcaattgttttccttatgtgtaatctggttcccctccagtctttcttcctcaaatgaaagcctgaccaagcttctttcctgcttaaaatcctttagaggttcttcattggcttcatgataaaacccaaattccttaagaatgacacacaggaactttcattgtctagccccactggtcctccaccaggggtggtaccatacccagagggaattggaaatataggggagtattttggtttgtcacagtga

SEQ ID NO: 80191 - DNA, 1157 bp, Homo sapiens
caaaacataaaaataagcctgatgcagtggcttgtatctgtagtcccagctatttgggaggctgagacaggaggatcacttgagccaaggaggccaaggctgtagtgagctatgatcgcaccactgcattccagcctgggcaacagagtgagaccctgtctctcagaaattaaagaaattcttgaattggaaatctctatctataatttgtccttactcttgttttaaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaaggtgagtgctctctctagagagtgtgtgtgtgtatttattcatttgtatagttattgtttcatgtttttttacgaaaattgatattgttatgatgaaagtgcacaaggtagaacttgcattaatcaccataaatctactctggtgtgtaacttgcagcatgtgggaggtattccagaaacaccagaaacagatctccaaaagtctggacaggaggtttacacttctttgatttgggtttcattttatttctatgtgtatattattgaaaaatttcattggaagatacaaactgacaatatgtttccaatcgtagacatttaattgtatttttggtagtagtattgaccttcattccactttattttttatttgtgtttatttacttatttattttgagacggagtcttgctctgtcgcccaggtgggagtgcagtggcgcgatctcggctcactgcaacctccgcctcctgggttcaagcagttctctgcctcagcttccggagtagctgggattacaggcacctgccaccacgcccggctaatttttttgtatttttaatagagacggggttacaccatattggtcaggctggtctttagtagagacgggggttcaccatattggtcaggctcctgatctcaagatccacccccctcggcctcccgaagtgctgggattacaggcatgagccaccgtgcccaacttccactttattttttatttact

SEQ ID NO: 80192 - DNA, 1022 bp, Homo sapiens
aacctaaaaaatttacacaagaaaagacatcacttgtctactgtaagtgttttgcttctactcatattattttcttcaaattgttgtcaacctgccttcctagtttacaggttttttttcactcctaagatgactagatatttttctgtagtatgaaaatgtttatgtttattttcatatcagctaatgaccaaaattaaaatgccttcatgccttttagccaatctttgtggtttcaaagaattgtcttacttttctatttgggatatatggaaagtatatatcccaaaaatatatggaaagtatatatcccaaaagtatggcgtgtgtgctcttttttcttttgggacaaggatcaaaataatttgggtaatggactcttggccatgtggaagcacagctaaatgatctgctgggtacactcttttcaggtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctggtaagagtgggccctatttccttttcgggttcatgagactcctaaatgttggcttacttggttgttgctggtgctccatgcctctagccttggcacttgctgagtgtgagcttggacaactctgaaaggcccaccttgccactaacgtctcaccagggcagccagtgaaggttttgtcaggtgatctgatctatcagttgccctcagccctataataatataacttaagaattttctagtgatgaataaagtttttgagtggtggctcaagtgaatccgtgtttttgtttgtttgtttgttttgttttgagacagagtcttactctgtcacccaggctggagtaaagtggcacgatcactgctcactgcagcctcgaactcctgtgctcaagcagtcctcccgcctcagcctcctgagtagctaggactacaggc

SEQ ID NO: 80193 - DNA, 1026 bp, Homo sapiens
aagatagtttgaaatgcaagtataacacttatgtagagaaggtaggattagcactagaaaactgacagactttggaaactttttagaatattaaagtggaatcaggagagcccagaggtcctttgaatcatctctacagagaactgaaatttcttcttgtgagtatccttctagaattcctttccttaaatctatgtttttataaacatgtgtgctattgttgtttttacttaggtttgtgttactcaaaacttcttcagatgttatgtatccattagaagctctgacagtttgggcagttaaattttacttctgtggtagttgtccttacaattaacgggagcattaggtcgttaatagctagatttctctcaccctttgtgttgttttatttttttaattaatttatttatttttccattgtgtgtggatataccacattttgttcattcatcagtcgattgacatcttagttgtttctactttgtggctattatgaataatgcctccatgaacatttacatgcaagtttttgtgtagacatgttttcacatgtcttgggtggagttactagatcatatggtaactgtatatttaccttttgaggaactgccaaaatataactgttgtccaaagtagttatgttattttatatttctttcagtagtatatgagggttctgatttctttacatctttgtgaacacttgatattgtctgttttttaattatagctatcctagtggtagtgaagtggtatctctttgtagttttgatttcatgtgcttattggctcctgcttatttctttagcttaatctcacactttacttccattcccactgaacccccaaccctcatcataccaagctccttgcttgtagctcggatcctgtcatactctatcatcttctggtgtgtgcatcttgatctacctggtatgcacttctcccacctctttgctaggtgagctctctgtgatggttgcattgatctcacagaatggcttgtgttgctgtagaactcca

SEQ ID NO: 80194 - DNA, 2943 bp, Homo sapiens
ctctttgaaaaccccccatttctgtctgtggtcccatcgttccttcaatttcctacgctagaaatctcatatttcactttagtaagaactgttatttctatcaccactacgtactactatagctagaagctgccactctgctgtgtgccacccatggtgctggctggttcagttattttgcctgaaggtgacaacaaactggtaaatggaagagctggcacaagttcatttaaatgtgtgtttgtctaattcaagtctcccttaaaaagtcacagaatcttagatatacatgtggccatagtctgtctgtgttcaaccccctatattttataaatggataggattttttcttttattccacatataccttgctacccttccccccatacatatacaattcttttcctcctttgaagtctctttcactgtgctcatcttagttaaaatctttaccatcttcttctgggaccatgctaatgatgattcattgtttctcaacaggggcactattggcatttgggcaggaacattgtttgtgatttgggaccatggtacacacaccaagatgtttaacatccctggcccccaccaaactccatgccccaagttcgcctatgctcctaatcatttatgacaacaaaaattatattcacatttttctttttttttttttttttttttttgagacggagtctcactctgtcacccagcctggagtgcagtggtgtagtcttggctcactacagcctcctcctcctagattcaagtgatttacctgcctcagcctccccagtagctgggattacaggtgcccaccaccatgccctgctaatttttttgtgtttttagttcaagaggggtttcgccacgttggccaggctggtcttgaactcctgacctcaagtgatccacctgtctcggccacccaaagtgctgggattacaggcatgagccaccatgcccaaccatcttcacatttttctaaagacctccccccgggagtgggagatgatagcatttcaactgggaaatgttgtattttctctttcctaggaatccatccttgatacttctgatagagaaattcttaactagatcatgtcattttcctgccaaaaaaatcaacattggctgttttctgccatatgaagttaaaaaacttttgaagatcccttgatggtttagctactatttcttctaatcctatttcccgctgcttcatagtcgctttttctaccctggttgggatcacaccaccctcttcatcttatttcatgccgttttcctgccagcctatggttcccacatttgagttgcaactgaagttacaagttgtttcactggcttttgcggcctaacttgactgctttttctttcttttttttttgagtcttgctctgtcgcccaggctgcaatgcagtggcaccatcttggctcactgcaagctccacctcctgggttcacgccattctcctgcctcagcctcccgagtagctgggactaaaggcacccgccaccatgcccagctgatttttttgtatttttatagtagagacggggtttcaccgtgttagccaggatggtctcgatctcctgacctcatgatccacccatctcggcctcccaaagtgctgggattacaggtgtgagccacggcgcccggcacttgactgctttttcttaagtccattgagatattgtatgtatgtgcatacatatttatattattttaatataaacttccactttttacatttattcatccccagactacttcatttgtcttatccgtctatctttgccaaagttgcaagcatctccagggcaaacccagtatcctcagtcttaagtcctctgtagcacctatgcacgtggcatcattgttcagagtaccatctttgggatcagaccactgggtatatatcctgagactatcagttactaattgtgtgaccatgagcaagttactgaacctctcttagcctcaataagatgagaataatagtaatatctaccatagagttttgttaggattaaataacatgtactatacataaagcaccacagcagtacctgggatgtgataaacactcaagaaatgttactgcaattaatattattattacatacatccttattgattaaacagtgttttctgctaacaagtttttggggtttttaaatctcctgtaggttttggctgatggtttgaggactggtgtcactgaatggctcgagcccctggaagcaaaatctgctgttgaacttgttcaggaatttctgaatggtgtattacttgttttattaattgagaatttatacttgctatgtttaaatataagtttctctttaagcttgatactcttttttgattggaatatatacaaagctatgagatctgttatggtcagagggacagcttttgttctgaattgctaatggtagagatctaagtaatcctaagaattaataagatttaatttatatttgagattgaaggaaaaaagagatgaatcagtagcctttgaatacctaccatgtgcctgatgccatgtgtcaggggcttttctgttacctccgttcatcctcacacccccacctgatggatatctattataatctccaccagagttcagtgatttgctaaaatccttagttagacttctactgtccccatttaccatttgaaaataggattaggatggaaataatttggaaagcagaaaaatcaagagctaataaacttttgccactttctagacttaaataagctggatggatttggtgattctacaaaaaaagacactgaggttgaggtaagtgattattatcagttagaaatatacacagaaatagcttttaaaattcggttatgctgacatctttcatgttgtaccatcgcaaatggatttgggatatcaaggcagcatttaaggggaattt

SEQ ID NO: 80195 - DNA, 1504 bp, Homo sapiens
tcagctctgctactttctagctgtgtaaagttcggcaggttcctttacttttcttgtgccccaacatcctcatctgtaaagtaaaggtaagaatagtatctacctcgtagtgttccaggattgattaatgttatccatgtaatgcacctagtgcctggctcatacttaagggcccagtgtgtgtaaactactaatattgtcattgttaagtgttgctgtgaatgagtattctcatatactactgatgagaatgcaagttgagatattctctaaaaagcaattttggtaatgtattgagatcctcacaatgtgtcatggcctttgaaccaataattcttttgttaagatgtaccctaagctcatacacataaatatgtatcaagactttatgtatcagaatagtcatctcagcctcatttatattggcataaaaatttaaaggacctaaatttctcttgctaatggaatggctaagtaaataatgatatagctacatatggcacatgtaatagttgctgaaaaaatgatgctgataaatgatatggagaaatgcttacaatatttgataaaaaggaatatacacaattgtatatgaagttaacttttggagagaaaaatctggaaacaaatatgctaaaaatcttaatagcagtcacctctggtggaagggttacaaatgactttttccagtcaggcgtggtgactcaggcctgtaattccaactctttgggaggctgaggctggcagatcacttgaggtcaggagctcgagaccagcctggccaatatggtaaaaccctgcctctactgaaaatcaaaaaaattagccaggcatggtggcaggcacctgtaatctgagatactcaggaggctgaggcaggagaattgcttgaacccaggaggcagaggtggcagtgagctgagattgcaccactccactccagcctgggcaacagagtaagactccgtctcataaaaaacaagtttttccaactgtgttatatttctactttatgaattttccacagtgaacttgtgccacttttatagtcaagaaaaagctaagtaaaaagttaaaaagatttttaataggaattattttaggtaatatgactaccaattcatcattataaaagttataaacttttatgggtgtgaacaaggtacattccagagtaaaggcatgcaagctctgcttaattgggcattagtgattctaggcattttagttttagccgttgaatttttctcttgagagtttctgtgttcatgagatgtttacaagtataaccttactaaccttaccatgtactattagtgcaaacaaagtgaaactatgtgtatattgtaaaaagaccttgcaaagattatgatgaaagttaaagtagagaaatagaaagtagtggggaaatgacattttatgagtacctaaaatgaatcatttaacatttggaacacaaattaaattgtaaactcacagctctttttaatttacaaattatcaa

SEQ ID NO: 80196 - DNA, 1883 bp, Homo sapiens
gcctgtaatcccagcactttgggagtccgacgcgggcggatcacgagatcaggactttgagagcagcctggccaacatggtgaaaccccatctctactaaaaatataaaaattagccaggtgcagtggcatgctcctttagacccagctactcaggaggctaaggcaggagaattgcttgaacctgggaggtagaggttgctgtgagccgagatcgtgccactgcactccagcctgggtgacagagcaagactctgtctcaaaacaaaaaactgatgttaataacttggggggttttgttcaaacaatttatagtgttaggagactaggaatgcaagcttataatttttagtttgtagctactgtaatttgcttctcttttacttgttgggtttatttatatatttattcatggttttataaaattttcctgatttctagctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtaagtatctttcctggctcaaaaaattaaaaaacacatcacagttatcagtcacagatattctcggattttctgtttctgcttgtccctcatcgtctgtagtccttcctggctttgtacctggttcactatgagatgagcatttcccttctctgggccttagtttccccccaataaagatatcaaatgcattatatccatagttcttgataatttatttgtttttagttcaaacatttgcggttctataaagttagtattttaaataaaaaaatccttttatgagatgctgttttaataccctacacttggttgtttttaatgagagagaagctgtgatcatttttagaataaatattagtatatatttatggtataatatgccaggaaacttggccttttgtgaggaactacttagcttgacaatctctttcatataggaactataaaaaatttatatagattccttaatatgtaatttaagaatttaagaatttaaatagaaatttaaattaatttctattaatatgtaatagaaaatacctgaagtgtttttgcatgtatgtgttttttcttaataggtcaggaacttgcatctttgaatcatttggtgagtttatttttttattctaaaattggtttttcttttattcagtcattctgtgtgcagttattaactgccaataatatgctagccactgtcttaggtcctgggaaatggataaataagacagtcagtgcccgtagttattactgcctagtaagatagacaaaaaagtagcccattcaatgtcatttctcactctctataaatttgtgatacttatatatagttatatcctactgaagccagtgtactatcacacatctcatctatccagaatgcttagggaatgcctttctttgataggttctgtaaagcaatgtttgttttattttctctttattcatttatattacacttgaaagtttattttccaaataatttataatctttaatgtatacttttgggtttcagggtcatcgttatgaactttgttgtattttcctagcccattcagaaacttcagaaagttgaatagtgtctgtactgatctttgacgttcattgaaagatccttttgaaaatgaatttatagtatcaatttgtttatcatttctctcttatgaaaatacaagatagaaaaactatatctgttgtgcaaaatagactcaactggattcttctgaggtttaatttttactattcaaattttaaacattttattaagggcatatatttttag

SEQ ID NO: 80197 - DNA, 3290 bp, Homo sapiens
tgaggctctttttgaggaatagttttgttcataccaatatcacagctaacaagggaataatgcattgcactacattacagctacaaagtcactactggcgagagggatttttcagttctattgtgatcttataagaccactgtaggccgggcgcggtggtttacgcctgtaatcccagcacttggggaggctgaggcagacagatcacttgaggtcaggagtttgagaccagcctgggcaacgtggtgaattcctgtctctaataaaaatatgaaaattagctgggtgtggtggtgcatgcctgtaatcccagctactcaggaggctaaggcgggagaatcacttgaatccaggaggtggaggttgcagtgagccaagatcacgccacggcactccagcctgtgtggcagagtgagaccctgtctcaaaaaaaaaaaaaaagaccactgtaatatgtgtgatccattgttgactcaaacactgttgtatggtgcatgactataatttagtttgaataatagtattgaaaggtgagaaattctatctagcttcttctggtcttttttttttttaatgcctgttatcaagcatccaaatgtaggtgtagaaggcatacctatattctttacaaaggttacacaggtgctttaaatctctattttgcttatattttttcattccaggaatacttcattgctccatcagtagatatacaagaacaggtttatcgtgtccaaaaactccaccatattctagaaatattagtcagttgcatgcctttcattaaatctcaacatgaactcctcttttctttaacacagtaagtacatctgtattcttcacttatatagaaatgtatttcttttgaaatagttacagcctaaatatgtacagtttttattaccagttaggatagaacctcttcatcctgtctttacagtagcatgcatgagtctaagtcagtgccataggcaggaaaggctttggattcaaaaggaatcagatttgacattggctgcatcacttcctaacttccttaggaagtttccatcactgaatcctgtttcctcatctgtaaaaaggatctaataacctcatgtattcgtaaatactagttccttctcttctttatatccctgtcaatttgggtcaaaatagccttgccagccatctaaatgataacaatggaatcaaatagtactactagacctctgtcagtagcattgctgtaattgtagagactgctgtaatttgagattccaattagtttgactagaggttatttggaaaaattctcagacacggactgctggtatcttatgtgtatttgaggcctcaaactaggaagtgaactgtccagtggaaggactgggtttcttttccctctggaaggaaatgtaccattacattttccaaaattacaatttgcctcagttgtagaggggaaagtttgaaattgttattgtttatagaatctccaagttttgttttttttttccccattatagatcagtggaatgaatgagttaactgtaattccttggactctgaaaaccatggaagctgtacttttgtttctcttctgcctcttttttttgtattgtttctctctttctgtaacctctttctccccacgaagcctttctttggcctcaaatttattttatatttatgagaaatatgtctattaattttttaaaagtgaatgagatttgttttcaaagaaaaaaacataacctaagttttgtttgtagggttgttgtgtttgtttgtttacttttgtggctctaaaagtgttcgctgatgttttagttagtagtactcaataaaatgtttcccttacgagctttagactaccagaaaaacgttatgtcaaatggctcttttttccaaaagaggttccattttgttttttcaggatctgcataaagtattacaaacaaaatcctcttgatgagcaacacatttttcagctgccagtcagaccaactgctgtaaagaacttatatcaaaggtaagcaatttttgctaggcatggtggctcatgcctgtaatcctagcactatgggaggctgaggtgggaggataacttgagctcaggagttcgagaccagcctgggcaacataatgagaccctgtctctattaaaaaataataatagctgggcgtggtggctcacacctgtaatcctagcactttgggaggccgaggcgggtggatccccagaggtcaggagttcgagaccagcctggccaaaatggtgaaaccccatctctactaaaaatacaaaaattagctgggcatggtggcatgcacctataatcccagctactcgggaggctgaggcaggagaatcgcttaaacctgggaggcagaggttgcagtgagccgagatcatgccattgcactccagcctgggcaacaagagtgaaactccgtctcaaaaaataataataataatgataataaataagcattttaatttattatcttaagtccacccatgatcctaggcaatttcagtgttcatattcagtagggacctcatgacccagagcttcgtcacctctgaaaccttaatcatctgtgaccatagtctgagagagttctccctcttccttctctcagacctctctctagactgttgggcctctagtctttcatttttctctgtatttgttattccttcagagaagagtggaaagtatagccagaaaggaaatgatggattaggagaaaaatgaccaggatagtgataacagggtctagggtatgactgtgggagtgagagaagggtttgggattagaggaagtagggaactgtgaggctgagatgatagattgttcatccacatggacactgaggttgcctccaatgagggtctccttgactcttctctcagcatatgatatacttgaaatttctctcatactatagccactctatttatgtcctccctgtatttagttctttcttagccaaactctcatcactccccctgaaattgctctggcaaaggtcaccaatgaccttctaattgtcaaatccagtggatgcttttcagtaaaagattgttttctatctagctcattgtgtaattggttggcccacccagtcttcctacttcagtaagcacttttttttttttttagacagagtttcgctcttatttcccaggctggagtgcagtggcgcaatctcagctcactgcaaccacagccttctggtttcaagcaattctcctgcctcagcctccggagtagctgggattacaggcgcccaccaccac

SEQ ID NO: 80198 - DNA, 2116 bp, Homo sapiens
gctgggattacaggtgtgagccactgtgcccagccagattgattttatctatcaggtatgggacagtgctgagatggcaatcatttgaacattaaagtaatatttctggacagattttagagtgataaacaatcaagtcacaacagtttgtatactatgatgccatttttgtaaataattcataatatacattcattatatacagcaaaatcttaacattaactttaggaggggtgagattacaagtgtttttttttttaatttctgcttatttttattttctaattcttaaatcccagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggatttgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctgggtactctggttactgagataaataaggcactggacatcctcacgtggagttcacaggctcatcagtgaattctgtaccacatttcaaccttgtttattttagtttaatggaatatacattcttagtattgcctgattatttaaatttgttgagggggattgcatgttgctttattggcctgtaaaaatagctagtttggtaagatttggtctcgcaccttccatctttgctaccacattaaagatgagcttgttaaaaaggaaagcatatttctctgattgcccttatggagaaataaagataaaattcaaagaaacaaataatatgtgttggcatttcttgatgcatagttgcatctttgttattcgacatctctgatccttttagaccccattacataggaaatgatgtcttctatgaagacagggaccttgttttgttcctggctatatctcatgacttaaacattccctggcaaatagtgagtgcttaataattgcttgccgaatgaacaaatataagatctcaagtattcttttttccttcatcccagttggtatagtggttggcttttcctctccttgcccaagcccactataacaaaaatagtaggtatataaatttataggtatgattctgaaagaataaaacttgaatggataaaatggataaaatgtttatctttcatggtagattaaatgctttaaaatgcttataaatagaaatttgacattgcttcaaagaaacctgattttaatcataagtagttttggaagattgacttcaagtagagccacattttgagattttgaaaatgatatgtataattatttagtttaattattaaaggaaaacattgaaatatactgactcacctgcagcaagcatctgattgttgatagagcaagtttccaaagctttgaggtaccaactttccacctaataaaaacccacttgataagtaatgttgtcttagactaattttttgctgtttcaaatcat

SEQ ID NO: 80199 - DNA, 1036 bp, Homo sapiens
tgtgcctttgcatactttcgacaaagctttgcagggtaacccctctctggagtaaagagcaccctctttattccccacataatatcattccccacatcccttgggtgtcaagtgccagggtcttccatagtccttctcaagttttgtgttcagcttttgtatagagtttagggtcttggaggcatccgtgagtagatgaagaagccagatactggattacctctgagaactgccccccttctttgttctcctcttgggatttcctgcacacgccccaccctcagccttgcttacctggccaggccctggtgctcaggtgcagacaggcagaggccccagcaggtcaggaggctccagcaggccaggagcttgcagctgccttgctctgacctctgtcttgtggggaacacacactttagcctgtagctagcctctgagggatgtatgggaatccattagctggcactggggttttgcaggggtgggactggcagggagtcacaggctcttgagcctgggagggctctgaatccctccattctggcttccctggggagagtcagcacccaggctgggagcacagagagggtcaggttgtaggtctcctgactctgtgtggaaggggaaagtgggtctaggatggtgcatttgtcctaggtgttttgtttgagtgtggagtagtgtctggagaggaaaggaagtttcccctcagtgatgattcctgcatagagggcattgatgggggcaggtggggaggggaagtgttgatgaggcaccctactcccctcatggtcactccagtcccaatttaggagctatgagcagcccctgatctgtggctcatgccaggctttctatgtactcttttccccttactgacagctttccctggaagtgactttctcccctctgccaactgactccccactgcctctggggaaggagaccagtatttatggttgtcttgttcctggtgatttttttttttttaaagtaggtcccttccactctcgtagaagcccctggcaggtgtatt

SEQ ID NO: 80200 - DNA, 1101 bp, Homo sapiens
ggagattcctgaagttgattcctcaggctggatgtccaagggggttggagtttctgatgtctttctgtctccctctcttttctttctctccctaccaggtccacttctttcagaggggcctgcggtgctctaaaagttctcctgttaaagtttagagcaaattggttattattttaaaatcaataaaacttttaaaagtactaagacaacttctaagaggggagtggacagagggcctggtggcagctcacagtttcttttctgacctttggtctcacccaccaagtgtcccacctgagtgcccaccttgcccacctgaggtaatgccctggggctccaccagtccagatccacagggcgcagccatgtgggagtggcggctgattgttacccagtagtgttgatagcacattattcataacagccaaagagaggaagcaacccaaatgtccattagctgataaatggataaatgaaatatggtacgtccgaagaatggaatatcattcacccatgaaaaagaacgaagtccagcaccaaaacgtgctacaacatggatgaacttcgatgactttgtgccacatgaaagaagaagccagccacaaaaggccatatattgtatgaaatgaaatgtccagaatgggcaaacccatagagacacaaagtaagttagtggttgcccagggttttggggttggggtctagaaagtgactgccaatggggatggtgtttctttttgcgataaaaaaaatgtcttgtgtttagatggtggttgatggttgcacaacactgtgaatatactcaaaaaccactgaatggtatatttttaaaaaggatgaatcttagggtatgtgaattatatctcaatttttggaaagggtcacctgatattggtctgtaactggcctcccctgtaacacctgcagctaccttcatgtgtggccttgggcaggtccttcagcaagtgggaccttagtttcatatcagtgaaaagaaggaattgagttgggtgaaccccaaggcctcttctgtctttgacactctaaatccttgtgttgtggggtggagtctaaagccttcatacttttttagttgcctac

SEQ ID NO: 80201 - DNA, 1053 bp, Homo sapiens
gtaagttgcttgaggtcacacagccaaaggtggcagagctgggattgagcccatatctgtctgtgccccaagcctgcggctttaactgttgaggggatttgggcagcagaggaggtgggacaaagggagggcttcctggaggctgagtttattatttgggaaaccagtaattaaaagcatgtagaacctgaggtgtgagctccccaaccctggcagtgacatgctgtctcctgtcttccagaatctccgccacctccctactctcggctgtctcctcgcgacgagtacaagccactgggtaagtgtgccctccttcctacccttgcagaggtgtgtcccgaactgggtcctcttcagcccagtgtctgtccagcctcagggctggagggctggagggctggaggggaggggtgaaagccggactggttgctgtgaaatggggtgaagttgtacaaacactcccacagttgggccaaagcagacccagcttctgcagcaggctatttacatctcgaaattccgcggctcatcattaacctctctgtgacctttttaaacatgggcctgtcgaagatgaatgggttttgacttatgcatctcaccggaggtgggttggcatttctgtgtctctttcctctctcttgggccccccagccttgggttattctcctttagagtgtattaattagtagtatgacaaataggttgggcatgaagtctttgttgagaggagctgtacattttccccctttttaagccaagatgttcacttgagcagaaacaacaattggagtgttaaaaaggaatgtatattggtacacaaagcccctggcatggactgtcccctaggtgagcttagtggagttggtaattttagacaactcccattcagaggcagaacatgttttctgtaaaaccttgagcctagatgatcagcccatattctggggtagatgtaagtggtttcaaaagtagagattgttggctcacgcctgtaatcccagcactttgggaggccaaggaggacagatcacttgaggttaggaggttgag

SEQ ID NO: 80202 - DNA, 1042 bp, Homo sapiens
tgacttgttaaaacagtttccccagccctagcgggagggaggaaggaaggaaggaagaaaggaaggaaggaagcaagaaggaacaacttcaagaattttaatggttgtaattaagtacagcaactatgaattgtttaggggcttaatttaaccttacccacggaggctccaagttgctacttgctcggtcccctgaacttgggttatttctgtggtcagggcaatggcagcgttttcaggtaccagcttcaccacagtcagcactttccagaagagttcctgggctggctggtctggtctggggtgatcctgagatggggttacagggtgacatcagaaagttgggagggacatgctgccctttgcaagcacacacatccacacacgtgcacatgtacagagatgcatgagaaagaagaaaaaagagagcgctgccccacggccaactaagttctctttttctttcctcccacagatctgtccgattccacattgtcttacactgaaacggaggctaccaactccctcatcactgctccgggtgaattctcaggtcagcattttttcttgtgcattgctgttgtgttgaaatttatcgaaggggacagctgcggagggggcttggtggaagactttttgacttcccctcttctttttgtttcccttttcctccaatccttggatgggaaggttgccaatgtttcagtccctggtgtttttggggttaagaacagtctgtatgagtgaaacctgaagataacttttaaagcacctgtctaccacgttttaaccagttgtctctctcttgtctcacttggaaatgataaaagctcagcacagctctccctttcgtgtttagaaagagatcctcttcccccagctgcgagaggcagcaaagtggatgtggtatacatttgtcttcctcctgtcctcactccaggggagggaccaatgtgaagggtcagaagattgggggaattggagccggttgaatgagcttgcagggaggatctggcaagtgaggagtttggcaaagccagtg

SEQ ID NO: 80203 - DNA, 1068 bp, Homo sapiens
agggggcaagtggcttcaccaaggtcactggggaggggggtggtggagggaggctagaatgcagagctttaagcagatctggagaccttacacctggagtctttgatgggatttgggaagaatggaaagcctagaacttttggggtaccttcagaactttggcactctggtttcctcgcctaattcagggcgtggggtgctgtcacctgactgtccaaggcccctgtcaggctgtcctcttctctgctgtatttcctttcctcttccatttgcttgatttcagtttagtttggggaggaaaggaagagaagctagttaaataaattcatactaaggtgtgagtggctggtaggcaaacttttttttttttttcaactttaaagtagaacatgccataattctcagaattgcaggatgaagaaatggcagttccgagaaaggctggtggcagagggcagggttctctcagcatctctgactccagcctagaaaaacaatgaacatgtcataaggagctttaagccctgggtgagggaaggagccctggccaggccgggctgggtgagctctgagtcacttagcgggagcctgaagtggcagggctgcttaagcacccgggcctgcctgactccatgctgtggggctggaggcggcacactgggcaagcttctttaggaccagtagctcccctctgctgtcttattctagtgcctgtaagataaccattcaagtgctttattaagcatcctgtccctccattttctcacttgtaaaatgaggatgataataacaacaaacatatccttaatggtgagggttaaatgagatactttacccctgccagggtctagcacggggaaggggatggggacgcttgttatggaacactgggcagggccctcagggtgggagctgggcagtcactgtccagctatgtgtaaggcatggtctaagctgcccatcactgggatcgcgcagtccttgctggaaccttggccctctgtgcctggtatctcagtcctcacagcatgtgggtttctttagagctgtgttagtgagagcaggccc

SEQ ID NO: 80204 - DNA, 1009 bp, Homo sapiens
tgcctggctctgggtgtcactgcctggggaatgggcaggctcttcctgtgctgcagaagactggaccgagctttgcggtattcaggggttcatacttgcatcttctaaacagcctcctccgaccaccttccacttgcacgtggacatacactgttcacccaggtcccttgtgtgaattacagccagtggtaccgggcaggagctcagtgaatgcgtgtgcccattttattttctgtccctcagcattgatactatgcggtggataggattcatttattctcattttcataccatttagtgatttctctgagtgccttctatgctgggctttgtagggttatgcagaatgaatgcctactagctgttcagcacagagttgggcattttacgtagagtgtctcccagaatccttataaccatcctgaggatgggatatgattaattataatccccattttacagatggattcactgcagctcagaggaaagttaccccaacagggtgggagctaaaagtccatttaaggcaacagtgaaaaggacagaatgaggctttgtggctcctagcagaggtagcagaggggtgctaggtaaggggaggctgtgtgggctgggggtgctaatgtgtctcagctcaccaagcagataagattccagtaggggctgagggataggctgctttattcttatctgtaatcccctcctctactgcttatttgctgtgtgaccttaggcaaacaccttaccttctctgggcctgtaaattactgcacactctcatacggtccatatttgttttttttctagaaactagcagcagatcagttgtgtgcagaaaaaaagctgtttattggttccagtgctgtctttacccttcaaagccttcctaagggtatgggggtgatggggaggagtcatggcccactacgaagggccactgccgtgttgaagaatcaccaccagtttgaggatccagcagaaatttctgtttgttcacaggacggtgcca

SEQ ID NO: 80205 - DNA, 1039 bp, Homo sapiens
atgcattctcctgcatctgggaggaggctggctggccagaaaggggatttaactacattaattctgtgactttcagttcacagcccctccttggcatgatcccatccctattccagctgtccccaggatgctgggtctgtaatggcagggagagaattccctggctctgctcactcacgggatgggagaatgtcccagcagctgcctccatacccgagaccagacatgccatattcagggcatctgacaggaatgtggctgcctgggagaaacaggccctgacccaacaccccgggcctgtgtgtattggctgaggttcacaaagacgctggccttcagtccggcagattgaaaatatttttcaatgaagccccagtatttgactggagaaacaataatattccttctctggatgtcaaacatccggataaacagaagccctttttttccgcctcctctcttccccaagtgttacaaaggatgctctgacatagggttttggaagagaattcacccagccagggtgagggccaacctgagccacaaagagtgcttatttttttaaaaaagggggaaatatgtggcccattgcaggtttgctcaaatggcctggtttcttcaggagcaagagtgcgagacctgcctcttgagatcggatgactcagagtggtgtggtggctgccactgccacttgtggcctgggggtccaagccctatccccagcagaaggctgggacgtgggagaggttatcttacccagaggtagggttgtggtgcagccagaggcagggtgcgtatggggtcaggagtagagagggaggtggaaggcagacattaattgaagaactcctattatttgcattgagctggaacccaaggattaccaagccacagaaagtcaatctcacccaacagatggacaaatccagtggatgcggctaagcccagaggttaaatgaaggcattcctaacaagtcctttacgaaatagaacacattcaggagatccattggagaatttctgggaaagaaaggagagg

SEQ ID NO: 80206 - DNA, 1059 bp, Homo sapiens
tctgagatcaaccacattctagctgcgtgacattgggccaataacttaacctcactaagcctcagtttcctcatctataaaatagtaattataagactttcctcactaggtgattttgaaaattaaaggtaatgtatattgacagtcagacccaatgcctggcactaaatagatctcttcatttatgctaaaaacacatattgaaagcatccatgggctggacctgagctggggtctaggggccacacaggacctgcactcaaggaggataccagttagaggctctgtaaattgcagctattcatagtaatggaactactagtagtattaataaacaaaatgttaggaaattctctagccagagtgaatgagccaagccctgtggaagcccgcctgggaaaaccaaggacatgagaaaagggaacacagtgtgaagcaaaatacaggagcaagggtgtgttttactataaattgtcctttgatctttttttcatgggtggcttcgattttccatttaaccgaattcaagaatcctctgacgaaagttttcattcatagaatggatatttacgtgtaggttgctttcagcagaaggaggttcagaggtgactgcaacatgctctctgccctcaagaaacttataggggaacaagacacacacaaaaatccaatcacaagtcaaacctaaaagacacacaggtgaaggggatggagattcagaggtgggagccacaggcttcatggcatgtggcatttgagtagactgtaggacacacaggaagagagagtgtggcaatgggagaggtttgggatatggaatcggatgacctagcttaaaatttacccttagaaaatccacagtttctctgagccttggttttctcacctgtaaaatgtgaataataatagtaataaaacttctctgcattgttatgattattttatgtcatcatcatcatacacacacacacacacacacacacacacactcacacactaagatttcctgagaaatgtcagagccatgggactgagaaacatctcttgagattctggtga

SEQ ID NO: 80207 - DNA, 1973 bp, Homo sapiens
ctccatccttggccacctgcttggggcagttgtacaggggctgccaggcgagtcaggcaggcacaaagcaacatctgtccacgggaaccgagggcaggcctcccctggaaataaatgccacatatggtgggagtgcggacttaaattttttttaactgggtggatccagtcaataaagggggagggaaggcggtgtgctgtctggggaagtctctgggcgtgtgatcgggagccagaattgacttcagaggaggtggtgtgatgtgatggtcagagagacctgggatttggttccagctctggttgttaattcttctgtattccttccgtgggggtggctagggtagagtgggtgagtatgctacttctctttctggggaggggtctgccaaacctaccttctccttatctgcctgggtgcattgaagacaagtgctttatgtattgaaacagaagaaaaaaagtggtatcaattgtaaaacaggcagctgtgaaaagtgtttcacagtttacaaagcactttcacatggttttctgaggtcctcaaaaaaagacagaaagcaagcaagcaaccagccatggaaagtagataaggttgttaggcttaagattatcacatttttaaagcagaggaaaccttaaaagagagaggtgaaaaggcttgagtcatagacatggggttctgcctgaatgtgctctttctgctgccccatgctgctttatactttgaagatcctgaatacattctttgctgaatgctaaagctgtgttagcttggggagggccctgtggatctttgtatgtgcggttgcttctttaatctttgggctggtgatagcttggcagagaggccttgctttcccttgccttggtaggagtttgtcctctgtggggccatacctttggcctgccttttcctcttccaaagtcctgctgagactttggaagcctaagacgtgtgaacgctttggatgattctgagagttcaagccaacctgccctgtggccttctcgtgactttgttaggactgaggcatcttctgcctgcctggataggactgaatacaaaagtagattttttttttcatcttttttttcagttagggaaacccagttgcttgggtggatccagacaaaatggattttcatccttggattttgtgcccacgcctctgggtcaccttgtgtcccttggcaacagctgctgctgttttggtcgtgggcagaaaactaaaggccacgtcttggggaggtggctggtttggccctgtgctggtgatatcaatgtgtctgctaagccccatagattgcagtgttgcttgtcaaattgtctgctttcaccacaactgccttttagtttggaaagtagagaaaggaaaatgtttaacttagtcattccccctgtgtgtggggggttggtcactgggtgcttaaaaacactctgcaagatctggactccggggtttaaggagccctcagtctaaggagattaagccaagtgtgttttggctaatatataatcatgagcagcaacagcaacatttggcaattagagctgtatactagggacttccagaccacaggcttgcttctctgtgacaccagctctgacttgtttcaattatcaggggagctggcgtgatacacacttatcgacataaagaaggtgaaagagattggtgccaaggaagtggtaagagcttcatttagatacaccaacaaaggggctgtcaggatactctgaggtctggcaggattggcagaatttacacaagttttataacagcctctcatgcctcacctgcttgagtacctgagtaaagctgcaggtatcttccttgccagtttataagaatggaatcaaagcatttgccgctgaatgagagttggtgtgtgagcgttatatgaggaataaggagctcggcacacttaaaacttagttttctggtagacactggtagcttgtacttcca

SEQ ID NO: 80208 - DNA, 1610 bp, Homo sapiens
aaaacttaaagactccattccctcccccaaatccccatctcatagtgttggttggctggcaagagaactgcccaagaaggctgctcatgatggcagcctgctgaatgtgcagggggtggaagttcaccagccatgtgcagacgtgaatggctggtgcagtgttggatgggactaactcctccctaaggaggggtatgaccttctgttggcctctgacaagtccctgagccatggagccttcagtcttcccatcttcaagcacaatggttcctggaaacagtgggaagttgccatcctaagcccaccctacagaagtttggtttctaattttactgtgttctaagctttagaaccgagacaattccaagagaacttgtccagttcatttttatgccttcctttaatgccgtaccaggtgctaatttctgtgccagataatgcggacaaaatagtgaataaggcagatactgtccctggtgccttctgtagcttctagtccactggctgtgaaacacaggttctttggagttgtaagaatgctgtatgtgttcactctttagctaatttgtaaatactgtttttttggtgccaaaccacatcccccaagctctgcagtttattgacttgacaaggatctctctctctctttctctttctctctgtataacataatcctttgtttcgacttaacagtttgagaaataaacaaatctatagcatactatccactgttggttatctaagacccttcctataaacagcagcctgccacagtggcaactgctgtagaatgttttggcagagactcagtttaaaatgaaaacacagtagaagcctattaattaagaagtttggctaattctggactaggcaaaagtttgtttagcaggcctttttgccccataaatgctgtcaaagaaaaattaataaacaagagtttggggattattttggaggtaggagtcagcagaccttggtaggttctagacgtggctctgtttctgattagctgtgtgacctgggacaagtcaccttctttgggcctcgaatgttctcaactggaaaataggctagataaactctattggagggcctttctaacttggaattggtattcatacaagcattttattttattttattttattttttgagatggagtttcgctcttgttgcccaggctaaagtgcaatggcgcggtcttgcctcactgcaacctccgcttcccaggttcaagtgattgtcctgcctcagccttctgagtagctgggattacaggcatgtgccaccacacccggctaattttgtatttttatcagagaccagtttcgccatgttggccaggctggtctccaactcctggcctcaagtgatctgcccgcctcggcctcccaaagtgctgggattccaggcctgagccaccgcgcccggccacatacaaacattttaaaagctcccagttgcacgcatctagttgatcagtgaatgacagatctttcttaattattgatgttccaagactctatcagcctggtgtcaattaatttacataagtaaaaataataaaattgtaattcagcctttaattttggtgatttccctccctcttc

SEQ ID NO: 80209 - DNA, 1012 bp, Homo sapiens
accatgcccagctaatttttgtatttttagtagagatggggtaggactccagtattaagaaacactgtgtatggctttgcctttgaaacctacagagttatgaatctggtcccttttgctgctaagtgttgcatcacaaactgccaagccaagttgtaactctgaggtgtcaccattttttttttcttttcaactggacatttgaaaatagtaatgctttttgggtgtgtgttttttaaaggtctgtttttacgctgtcactgctcaaaaatgccaaaaggcattttttccttaaaaaatcacctctgggctaagcccaaatgtggagtaatgaatccagaaaggactttttgagtagttacaagtggctgaaagcaggcactggtgatggaaattgggtttttccttttgcttcaaatcttcctggttgtaaactttttcttacccttattgaagtcagactcaaggtgggtctaatttctcccagcccatgggaaggcagagtgaattactgcttgttgtgccaaccctttacattttgtgtgtggctgtttgtctctacccagacaggttcttcacatattacctggggagcaggagagggggaggacaggaagagcacagttgggcagaaagagcaaagcctctcaagtctgatgggtttgggtttgagtctgacagttattagctatgtggtgaccttgggtactttgcttcaacttattgagccccagtttctgcatctgtaaaatgaggatgaaactacctacttcatagaaatcaacccaagtggccgggcacggtggctcatgcctataatcccagcactttgggaggccaaggtggatggatcacctgaggtcaagagtttgagaccagcctgaccaatatggtgaaacctcggctctactaaaaatataaaaattagccgggcatggtagcgggcgcctgtaatttcagctactcaggaggctgagacaggagaattgcttgaacctgggagccagagctt

SEQ ID NO: 80210 - DNA, 1012 bp, Homo sapiens
tgtaatcccagcactttgggagccgaggtgggcgaatcacgaggtcaggagttcgagaccagcccgaccaatatggtgaaaccctgcctctactaaaaatacaaaaatgagccaggtgtggtggcgggtgcctgtagtcccagctactcaggaggctgaggcaggagaatcacttgaacccaggaggcagaggttgcagtgagctgagatcacgccactgcacttgagcctgggcaacagagccagactctgtcttaaaaaaaagggggtgctggagagcatgtggggtggatagggctgactagagacctttgtcagggtgacctttctccagagagcccagtaggctcagaaggaaggtccctcagcaccctggcccacacagttccagggagaccccaaataaagcatttgcacaaacagtcctgagtggagcacacctagccgccttctcttgcaaagtgggcctttaaaaaaggggtgtatggctgcttagttctgaagaggccaggctaggagaccccagagggacacccagaaatcccagatatacctcctccatctgctctgcctgccagatgacccttgctactttactgttttttctttgagcctcttggtgatcttgaatagcagaaaaatgagccaaatttccttcaatctatgccagtcttcgtcctcagcctcccggtggggtgatgagtcacaccagtgggaaagtgcactgtatacttggtcatgtgcagagcaccttcccattggtttatctttacaactgccctgggtggagacatggcaaggtggtcctatccctattttgcaggtgatcaggcacaacttacagttagcgcaggaacagggactgaggccagccctcagttctttgacagagttctttgtctacactgtgttgcctcagaaaaaaatgcccatggggagtgtgtgtgcgtgggcatgtgtgctctcctcgtgtccctcagaaaagaatgaattcttttccaactgatgtcac

SEQ ID NO: 80211 - DNA, 1118 bp, Homo sapiens
gataggacctgcctccacggtaacaaatggctgaaggcggtttggggtgttgccagtagcctgcccttccgcagtggctaaggatccggtgttgcggtgatacatgatgtgacctcttcaaccagtgagtcactcacccccagataaccacccggtactttcaggggaaaccgttgtatcattgtggctgtggccatggtttctccaaaataaggtgtttttagaaatgaaagtacagggattggtttccttagattcattgtcatggattcatagttccccaacctttttcacgtaaagactcacctctgtttcctcttaaattgtacatttggtgtctgttttatatattaataataactgacactcttctaaagttttttggggaaagaaaacataagtttaccaagctctcaattctagaaggtaatagccttctagaattgtccatttgcataagcatttttatgcttattgctgtaatcagtgtgtcagtcaaacgggaaggaggaactacatcaggtatttagcacaaagggaatttaatacgggaccttggttacacaggtgataaagcagctgagaagccacaatgggaaggtgaggtgacccagaacttggaggaagccgctgcctttaggctggagggacaaagggaacaggtggtgttcccagagcccagggttggggtcaccagtgggcctgtctagagcagttgcagctgcttctaaaattgccgacccaaggtagaaaaggagagaggggagaaacactgtggcctctccctccctcctacccactacttgctgtgagagcctcctattatttaaaccctgctggaggcctcctgatctggagcctggaaagtcagggctcagccccagggaggacacagcagagcacaggaagatgagggatggatcagagggcaaactggacttggaccagcacagggtgcaagcctgatgctctaattttatattttatcagcattttcttatatgtggctttcataattacacatattttatcaagtagatgaaccgcatttaaccattccccagctgttaggtgaacactttaaattactataaatcagcagttctcaaagtgtggcc

SEQ ID NO: 80212 - DNA, 2357 bp, Homo sapiens
aacaattcctgtgggtgctaggaccaaaagtagtatcctctaggaatcctggccttcaaggtctaacttccaagattctgtgagtacgattctagggagcctctgcctcagacttctaagtagttcttcaggctgtgctctagaagttactggaatgaaagaaaaattgtagtgtttgaaggtcttcaaggatcctggtcctctcacactgtcactcttagtcacatgacctttgactgtccattccctactaagccttggtttacgcatctgtcaaatggagcattcgtgggtgtgcctgccttagaggatgagacccagctgagatgacatatggagaaatcgtttataaacttaagtactggtgttaggaagagctaacacggtgagtcttcagtgtttctttaagtgctgctcactactgtcctgagagactccaagaagcagttactttgtttgggcctcagttcatcatctgtgagatgagaggattgggctttgtgcctaaactgcccccccaccccaccacccaagacagattaaaaaagaaggaaggagggagggagggagggagggagggagagagcgagcgagcaagcaagcaagcaagccagcaggatttggaatcgtcccctaattggaaccacaatcgcaggtttcagggactcaggaaagggtgcagcccagcttgtggttgagaaatgaatgtcagatgttaggaagaaaaaggcctatctcaacatagcaggggtttcttactgcccctgcctcctcagccccggtagcctgtcactccctggcgaacagcttggcagcacagaggcaaaccacagagtacatttgaggcccagatctgcttatttcgagggtggggccgcgtttttctcctgccacagtgagctaattaaagaaaacaagcttcgggagttgggagagaactgtccacaggacacttggggaggcttgctttggttgtggaggcctccacagcccccggaaggcaggtggaagtgggcatggagggtcctacgcatccccagcgggggtctgagggcccactgttgctcagctgggggatttggggacggtgggagggcatacatggatgggagggtggactccgttcctgagggggccagtgtggaggagggtcaggcagcccatggagatgggacagtgttctgaaatgcttcacaaatgtggacttttgccccaaactgtggacagagcgtatgtcctgagcgaggatcaactctgtgagtacccatgataattctcctttctgtggttgccgccctgttgattcatgtgtcagccttagagaaagtggctgtgacttctgcattcctgggaatacactgacatgagaagaagtagccgctcttgttcacagtcacagggctggaaagtgggataaggactaaggacttctgtctctggattcagcatgctgattatggggaaaagcagacatcaattcctcatgtcttgtaagcatcactgtcctccaaagttggagcccagctcagacagctgcatagtattttatagagaaggtgtgttgttgaaatgttgattatgcaaattgaattgtgttttaagactactgggaaaaccatttaaaggaatcctgttgtaagtcattttgaaaaatggagaattacaccacctccccaaggattttctgttttggtaaatttcatgtggcaagattacttgaagaagggttccagtgttttgctagcttataatggttactgcataaggaaggtttactcgccagaggtccgcatacattggagaactgggggaatatgtaatacttgtgcagaaatgttttgattcatgtactcagaagatgggatctggatgacacctccagcctattgattcccaagtaaggtgtgatgacaccaccaccagcgaggtgtgctatgaggaatttttgttgatgatgaaaagtgaatgctaactgattgcacaccacgtgccccataccttacatagattatcttatttaattgttgctaataatagtactacagtctgtgaatgatttacttagcaattaattcaaaagcatattccactctacaatggaatattttttgagccaagaaatgaagtacgtggccgggcgcagtggcttgcgcctgtaatcccagcactttgggagaccaaggtgggtgggtcatttgaggtcaggagttcaagaccatcctgaccaacatggtgaaaccccatctctactaaaaatacaaaattagccgggcatggtgccacatgcctgtaatcccagctacttgggaggctgaggcaggagaattgcttgaacccaggaggcagaggttgcagtg

SEQ ID NO: 80213 - DNA, 1121 bp, Homo sapiens
gaggcacctgatctgtttaaggctgtgtgagtagaaccaggtcctgccttccggaagttcatggttaaattgtgttttcatgggtcacctggaaggcgagcttgttcagaatgaggataattgacccagtgaatccttcctgcctcgaggcccaccatgttattcagatcagtcttgggggaaatgctgtgaaagtgtgtgtgtgtgtgtgtgtgcggtgtgtgtgtgcatgctcgcgtgcatgagtttgtgttgagagaaagaaaaaagccaggagagtaggatgagtcagatttaaccactgttttttcccttttgaaacttgttatgttcatacacatacagcagtcatgcacttgctcagaaatgtgtgaaaaccacttaaaatgtgtgaaatgcagccctttagaaagtgtgccttccaccacattcttttgagcagtggagtggatttgtgagtgttcatatctgtcctcatctgtgggaattgtatgtccaaggtgctaattcagggccatactgggatgacctgtgtgtatagacttgtcctgggtgagatgggagcaagaccatccaatgtatgatggggaattctgttaaacaggtagaattctgaacctcttggtggtcctggctggtcagttgcagggagtgacgttgaatggactgggaagatctggatataccatgtttctgtaggcatgatacgtggtcccttagcttggtatttaaagttctttggaagtgaccgctttctggatttacctctgtgcagcccctctgctcctcccaggtgaggctcatcatagctcctcttcaatgtgctttgtccacaactgctgccatgttttagctccccattacgtttcctgggatgctctcctagactcctctgtacctttcttctttcaaacccaaaacaggtcccatctccttagtcttaactgtctatgaatggtctgttgcctcacttcccagctctggtatgtagtacgtgctcagtacacatttttgaatgcattaatttggctcttttctgtgaaggcagcttgtctgtgtgtcattcatctgcccaaatttgattgtcaacttcctttgtatggagctgtactgttcttttt

SEQ ID NO: 80214 - DNA, 1042 bp, Homo sapiens
gtagccactgagcactggctcttcctggcttcactctctggcatcaaaacttatcagtcctacatctcagtcttttgcaaggtgacacttatctgattacctaattcacacgaaggtgttaatggtggtaatggcatagtatttattaccccaggggacccagaacggtggtatcaaaacatatcattccccagtggtttaaaactctggtagctttccagggagtccaagtggagtccagtctccttagctgagttcacagggccccgtctgcacgacttggcttctgtcggcttccctagccctgacttcccaagccttagtcatcaccctctctcccacccagggctcagcacagtacctggaacagtcaagccctcaataaatgtttactgagtgcattaaaaaaaaaaaaaagattttaatgagtcatgctttaactgaagattttagtgtagtcagtcattgggccttggatgccaaaggaatgacaaatggtgggaatttcaggcacagtgactgtgatagccccaaggaaaccaagagagaagtagctttatctgggtggaggggagtgggcctttcagagcctcgaaatcttcccacctgctgcgccactcccaccacataagcaccccacccttcttcccagggtgagatttctcagctctgctttctggggtgccagacaaggggagagccttgttgccatgccctcctgccctcctgccctcctgatgcagtctgtggtcacctgcaggcagagacagatgaagtccgtcattcggctgcgagtaatttctgatgggagaggggcttcccccggcccttcccgcctctctgagccttgccacggtcacttggtttgcccagcctaagtcactgcctgtcgctgtggttattgcatggacagggcctccctctgtccctccacttcccttccctgccccatactgttgccctcacccaccccaaagcctcacccttcccttccatagggatatggcctgatagaggaggagccatttgattttgactattg

SEQ ID NO: 80215 - DNA, 1281 bp, Homo sapiens
gattacgggcatagccaccgcacctggccttccatttgtatatcttgtttggaggaacatctacaaatcctttagccatttctttttttttctttccttttttttttttgagacagagttttgctcttgttgcccaggctggagtgcaatggcgccatctcagctcactgcaacctccgccacctaggttcaagcaattctcctgccttagcctcccaagtagctgggattacaggcgcccgccaccactcctggctaattttttgtatttttttttttttttagtagagatgaggtttcaccgtgttggtcaagctggtcttgaactcctgacctcaggtgatccacacgccttggcctcccaaagtgctgggatgataggcgtgagccaccacacccggctagccatttctaattgggttgtctttctactgttgaattataagagttccttatatattctggatataaattcctttatcagatacatggtttgcaaatattttcttccattttatttctttcaattctgtgggttgttttttcactctcttgatggtgttttttgaagcacaaaagtttttaattctgatgaagctaaatttgttttactttcgtcacttttgctttttgtgttgtatctaagaaactgttgcttaatccagggtcacaaaaatttactcccttgcattcttctaagagttttataattttagctcttatatttaggtctttgatccatcttgacctgatttttgtataagatgtgaggtaggggttcaacttcattcttttgcatgtgaatatccagatgtccatgcactgtttgttgagaagaatgtgctttccccagtgaattgtcttggcacccttgtagaaaatcatttgactgtaaatgtaaaggtttctttttggactcttaagattctcttttattgatccatacatctatcctcatgacagtcttgactactatagctttgtagtattaatcaacttttaaaatatatatatatgtgtatatatatatatatatatttttttgagacagagtcttgctctgtcacccaggctggagtgcagtagtgcgatcttggctcactgcaaactctgcctcccgggttcacgtcattctcctgcctcagcagcctcccgagtagctgggactacaggcgcctgccaccacgcccggccaattttttttttgtatttttagtagagacgaggtttcaccgtgttagccaggatggtctcgatctcttgacctcgtgatccacccat

SEQ ID NO: 80216 - DNA, 1002 bp, Homo sapiens
cctttagagcaagcttgtccaccctctggcccgtgggccgcatgtagcccaggagagctttgaatgcagcccaacacaaattcataaactttctgaaaacattgtaagattttttttttgcgattattttttagctcatcagctatcgttagttagcgtattttatgtgtggcccaagatgacgactcttccatcgtggcccagggaagccaaaacaccggacacccctgcttagagaaagtgcgttttctgttataaaaggaccttgaatccccatctcatatgttgggactttgtcttgcatgttttcaggcagggcatgattgtatctgtaacataataatatgtaagaatgtgtacttcttagcctttgcagagaggcgggaggcctgtttcctgcagcccccgccctgtcctggctgaggggtgggaggcagcttgctggccagccccgctgagtcaccctccggcgtggagcccagtggggatttccacgcggccccagtgttctcttctcctcgtttcctgttgggctgtgacgcaggctggctgccagcgggtgccggtgggcactcctgacacaggccactgccagccggccttgtgggtcctgagggcatcgtgggtggctctccccccacgagtgactgtgcctggcagggtgtgccccacatgtcagttgcactccgttctgggtgggcagctcccagaggccccggggagggctgcagatgggcggggggtggctgcctgggaggacgggaggttttgttgaagagagagcttgctcttggggcagtttgtactgggcgtttagggttataaaaacctagatttgctgaaaacggctctcttttatcttctgacaagaacatttgtgaagaaaacaaaacagaccttcagccatttagtctatacaccgagagaatggtttctacagtatgcctgatttctctgggtctttctaacacatccatgtatgtgcttgtcagcttctagtgc

SEQ ID NO: 80217 - DNA, 1075 bp, Homo sapiens
ttcatcagtcttggagtcagggctcctgtctcttagcaaaaagctaaagcatacatcaagcatatttattgacaagcgtaaccactgtgaggttataaccagggtgctctgtctgcttatgggcaccccacccgaccagccaaatggtcagagagctgggtgggtcggggaaagggagggagggagtcatgggaagcagttgtgttgaatggctacaggccctggtggctgggtgcatccccgtatgccatccaggcccacccactgctgggccggaccttcccctctggacagttcttgcttgggcactgactgggtttgctgctgaacctcctggcctggcagctctggttgctgatccacccgcttctttctttatagagattaagagcggctccagtgtgtgtacggagagcctctttgaagcgctgttgcctttctgtggctagatccacgatcttctctctgggatcaccccataggacatttgctttccaccttctccagtcccagtgaatgcatggacctctgtcctcattgttactggctgagccagatgtcagtcctgtgacctggcctcaggaccactcttgtagcccaccgtgggtggatgaagccggtgggaacagaatgataggagttaaccactttttaggcgttattgggccttttcactttaatagcttaacagagacatctgtgatggcttgcatccagagtgcgtggtgtttatttttgatttgaaatatgaaaagcatttttttaagacaactgactcctctgagtcatgcccaggggagcaaacggcctgaaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacg

SEQ ID NO: 80218 - DNA, 1089 bp, Homo sapiens
tgaagctagggatttcagtcccagcctctctctcgagagccctaacttagccactatacctcactgcctctctgtgaccagggttgagtcctggtcctcaaatgaagcccgatttgccagaaccttcttttgaggccttacctggtcttcagttttaccacgtgttaattgggggcagggcagccagtccatcctcttctgcagaaatcaccctgtccaggagatgggtgcttcttcaggacactacctggctaagaacactgcattaacaggagatagagatccagtgtgtgtgaaccttgtgaaaacatctctgtctgttcctccaatctcccccttctgtcttatcatgcagggcaagctcaggttgttgtcctgtctctgttgggaggacccttgagtggtatctcctatgcccaagcagacctgcagagaaccctgtccaaactgatggtcatctgagacatggaacttcatgataggaaggtgtcttggaggataactagcaagtctttcactttatagagggggaaactgagtcctcagcgatcagccacatagattctgtgttgtagagacctgaggatgtgtctcatctccttatctgaacagcaagttcccatgctgcgaacgtctcaccctgaccctcaccgtattttttaggaagtgaatggggctttgagaaggacaacctcactgttttgcccatttctgagatggaaaatcaaggaacattgccccatctccaccccgggaatctatatgcccctcccataggcaagatggaagctagaccagaatgtgcagcttgtgcttcttgcgggaatggtgaggacagatgagggcagggagacagcattcctaaacccagccttttgacccaagaggcagggactccaaggctgtagaatgggaggaattgtgggaggaaaagcactgggcagaaggtctcagtcaaatgcacctgcagttattagctatgtgacttgggcataatgccacctgtgagcccccattttcctcactaggacagtgaactcaccaataggtttgagttgttgccctcccagaactgttgcatgaattgaa

SEQ ID NO: 80219 - DNA, 1053 bp, Homo sapiens
ggagagaagaatgagccttttccttctgttagagcctgtagctgcctcttcagggtcagactttaaggtgtatggggacaaagttgggtcagtgtttgtagaaaaaaggctctttctccatttctccctcctgcttaatccaaggagcagagaacaccagggaaactcggaagtagcggggttgatttgggagctagatggggcctgacatatgaagctgctacctggttacagccaggcagagttgaaagggtgtcctttggcggggtgagaagagagcagcctccaaagattcccctgcaccccgccaggccctgccaggggcccctcccacagttctttgctccttccacggagcctgtttgagaattcagtgattcacttcccgtcgtcaactcttgtttaacgttcccctccattgttaccaaacaatccaggccccagtgatgtgtggtgttctgagagtagaggagggaagagagagagagagccagaactgtttacagagcccgggagatgggcccaggcttgacagccgggccgacttgaaagacaggctgcagtggactgtggccccaacagctgggtgtgtgcagggtgggaaatgccaggcacagccgctcctccacagaaaccactctgttctttctgctcttgatggaagctcctgccctttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctct

SEQ ID NO: 80220 - DNA, 1041 bp, Homo sapiens
gttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggattttttttttttaagtttccaaatcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtc

SEQ ID NO: 80221 - DNA, 1029 bp, Homo sapiens
gtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggc

SEQ ID NO: 80222 - DNA, 1033 bp, Homo sapiens
gtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttt

SEQ ID NO: 80223 - DNA, 1061 bp, Homo sapiens
attagcagtttttctgtctaaccaattagctgtgttgagaaagagtctgaggctgaggatggacccaacccggtgacgagtggtttttgccatggatagaaatagagaagaggggaattttgccatatatttgctatccctggactgcagagacacagattagaattttggaatagctgtgatagcaggtaatcaggaactatattccttcagtcatatataaggacttgctgtaagcactgtggaaatgtatataaaatatactgctaagatagaatttactagatatggacactgattcatttactcggcaaaaatatgtggtggccaaaaagaagccagggataagagaataaaatgtaaactctgctctcaaggaactcacagcctagagaggggactgtggcaacagagatagatgtttatgagaggcttcctggaggagatgtctgaatggaggcacaaagcattagtaaaagttagccaggcgaactggtggtgtgctggggagcaggggctgggccagggagaagttgatgttctaagcacaagcagccatgaagacaaggatgatccatgaggactgcaagttgccggattgtagaggttaaggcagggagcagtgaatgctaggtaagggcaaaggagggccaaatgctccagggcaaagaccttagaatgtgtgcagtggactaggggaagcatctatggtcagattggttactgggggcagtatgaagggtgcctttataggaaagccatctggaggctaggagacctgttatgatgctggtgcagttgtccaggcactagaagacctgcagtttagggcggtgcaagtgggactagagcagagagattggagaagcgggactgtgtggaggtggggagcagaggactggtggactgctgtggcttctgtggatgtaggttgggtcaatggtcatgtctaaaacagggctgaaggccagaggatggttttaagagaaaccatgaattctgtttatttgattgtgagtttgaggtacttgtggcccctccgtgtgccagcagccagcagt

SEQ ID NO: 80224 - DNA, 2001 bp, Homo sapiens
aaatccttatttgtttttgtagactttgtaatgcatatcattagccctcactgtgatcattactgctgtggctctgaactggcacatagtacagtggatggaaggtgcccgcacaccagctgagaactggttctggcctaggtgggctctagaaccatttacacagcatgaaagaaacaggttgggttaggagcagaaagaaataaggctcacacccctccagacactaccttataagcactgcagaacctgaaacagatggcagaaggaatggaatgctacaggggccagcaggagtgaccacagggaggggacagctcagtgactggagcattcaggaagaggctttccagggaacactggacattgcttagtgaccttttgttcctttttttttttttttcttttactgttctgaaagactttgagtctgtggttcaccaccagcccatcagtgtttctttgaggtgattgcattagggaagttggctctgggattgcaaaaaaaaaaaaaaggtggaacatgttttccttaaaagatggaaggttttagaaaatatactaggccatctggttagaaaaaacagaccagactagaaaaagctgtgaatttgattttgtagattaaacaaagccagatgattaaaatgtgatttatttataaactgtgctaatgtctattattatgattttgtggttttttattagggggtatgagtgagggaagccctatatccttcattggattagacatatatagtgaatagtggaagagtctgtcaagctcactattttagaatttaccctgcatatgtaatgtcatgtttttaagacctcagctatgcagggatattggcctcttctagggacatatgggatgaaggtctctagtgaaatctactaaaagcccatgttagaatagtgatcatgagctaacactacagtaatagctgcagtctatctaaagtgacctatgttcatgctaccacaagttgttacagaattgccagctggaatttaaaataagagacttggtttttggttgttttttccttaaacatttcttgatttgcataacatagtgtttggcacatagtgtttggcacatagtaggcccttagttttggttgtaaagtatggtttgtgtttgatgaatatgatcacaaagtttgaaggtccatacataagtgctggaaggtaagggaagacaagaataaacatttttcccctgagaaaatcatgtgttatgtaataattttagagtgatgaagacatagatatttttataattttaaaatatgccatcttgccagagtatgagaagattgacagaaccagtttgcttgctctctatttatagaacttggccacgtctaattcagagaagctagagattcagggaagctagacttagatggttgagtaatatgggatgtggttcaaggaccatagagcatgttaggccattcctgcaaactacttctaacacgtgaaatgtgatatatggctaatttcctggtcccactgtggagaggtcgggatcaacatttttgccatggcttgtcagattcatttaaccttgggccagtctcttaacaatgggcgttgagagagcatgtggaatgccccttgccttgccttggcctgccatggaaaagcagtcttagaagaatcactgtctaagggtaagatgagagctctgtaaactattctgagcttcagcgtttgccgatacaaagctaaatttagcaaacgtgtccagtgtggtcagaggttctgattcattaggggttctgattcattgaacgttctgattgatggagacaagagtttcagtgaatgttctaatgcattagatttgctcttcactctctgctgcccctgttaattttacaatagacaatttagctacagcattatgtcattaagtaccaaatcttattagaggactataggtggagtaagtgtaaaaaaatctggtcatgtgtactgaacccagta

SEQ ID NO: 80225 - DNA, 1037 bp, Homo sapiens
agtcactgagctgtcccctccctgtggtcactcctgctggcccctgtagcattccattccttctgccatctgtttcaggttctgcagtgcttataaggtagtgtctggaggggtgtgagccttatttctttctgctcctaacccaacctgtttctttcatgctgtgtaaatggttctagagcccacctaggccagaaccagttctcagctggtgtgcgggcaccttccatccactgtactatgtgccagttcagagccacagcagtaatgatcacagtgagggctaatgatatgcattacaaagtctacaaaaacaaataaggatttttatttgcagtactttccactcttcctttaaaaacttgccatttgcttatcagttcctctggggctgacccactcaaacaagacaaaggataaagaacaaaagatagtcctccgaggttacaggcttggaagggcagagaggagctacgaaccttggaagaaaaacaaggtgctcaggaattcatcgcctaacatttcacttccccacccaccccttagtgctcccactttggcagtgatctctctttggctttaaagagaaagggggaaatgtgccttgttttgcaggtgtgcaacaacacagctctggcatctcaagcagcaggggagaactctaagacagaagaatttcttcatgaaaatcacggtatgttatcacatactgtctccatggcccatacaaggactccttaaggttctctctaacatacaacatatcccccacaactcagtagagaggttttcttcccactggaatagaaatcctttgcctcatttattacagtctaaaaatccacactggctttttgattctttctagcatgagctcagacactatacttcaaaagaatgcccagaggcattttcttaggtagagacttagctgcgggctgagacttcggccccacatagctcacatcaattctgcagctgcctcctttcctcccaataaaagcatcatagctcagagctacaagctccttgaatgg

SEQ ID NO: 80226 - DNA, 1016 bp, Homo sapiens
gcaatcgggggagacagagatgaaattgaaggcctttcatctgatgaagagcactgaattattcatactagggtttgaccaacaaagatgctagctgtctctgagatacctctctactcagcccagtcatattttgccaaaattgcccttatcatgttggctgcctgacttgtttatagggtccccttaattttagtttttagtaggaggttaaggagaaatcttttttttcctcagtatattgtaagagagtgaggaatacagtgatagtaatgagtgaggatttcttaaatatactttttttttgttctaggaatgagggtaggataaatctcagaggtctgtgtgatttactcaagttgaagacaacctccaggccattcctggtcaaccttttaagtagcatttccagcattcacacttgatactgcacatcaggagttgtgtcacctttcctgggtgatttgggttttctccattcaaggagcttgtagctctgagctatgatgcttttattgggaggaaaggaggcagctgcagaattgatgtgagctatgtggggccgaagtctcagcccgcagctaagtctctacctaagaaaatgcctctgggcattcttttgaagtatagtgtctgagctcatgctagaaagaatcaaaaagccagtgtggatttttagactgtaataaatgaggcaaaggatttctattccagtgggaagaaaacctctctactgagttgtgggggatatgttgtatgttagagagaaccttaaggagtccttgtatgggccatggagacagtatgtgataacataccgtgattttcatgaagaaattcttctgtcttagagttctcccctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcac

SEQ ID NO: 80227 - DNA, 3256 bp, Homo sapiens
acattatacaaaataactgacatacaagtgttaaagtcgtgaaagactgaggaactgtcacaaattggagaagactaaggagatttgacaactaaattccatgtaggatcttggaacagaaaaaggatattagtggaaaaaccgatgaagtctatggcatggttaatggcattataccaatattaacttcttgatttttataattgtaccatggtcataaacgatgttaacactaggggaaagtgggtgaagagcatatagaaactctgtgtactatttttgcaagtttttttttaagagtaaattaagaaaaagatttaaggcaaaaccaaatcaacaaaaaccaaacatttccacatcttcctccttatctctttactaaacttgtttccattcctcacctcccatttgctcctcacctcactcatgtctgtcttttgcccctggtatgccactacaacagctctgtgcaaaggccagcaatgacctccatgccgctaaatcgggtagatattttccagtcctcatcttgacctcgtggcagcattcagtgttacagatcaattcctctttgaaacattttcttcccatgcctcacccaacacggtgtcgcctggttttcttcctacttctctgattattccttctctttctttggtagatacccttctttacccagcctttaaatattgtcattcttcattgctgcatttaaactcttccaaatctatatttaggcatggagtgattctgtctacattaacagctcaattactatgtatacacagataaatcacaaacttttatcttcagccctatataccaacttcctacatgacatgtccattgaacgaaagcaaatatattaaccaagatgcgtttttaacaccaaattgtctatatggcattgtgatagatgcaaataattataagtcatcatcctatcttcatggagcttagtctaaaaatatagagataggacctataatgtaatggttaaggtcatagtcattggagtcctgtacagctgggttcaaatcatggctttatcgctagtaatggccttaccttgaataaattaacctctgttggcattagtttcctcttctgtaaaataacggtgataaatctttcctcatagggctgttgcaaagatgcagtggaaccatgtaagttaaagcattcagtggtgcagatccaaagcaaattctctcttatggtagtagtacttattaaagtagtggtggagaaatgttagaatacaaggtaatatatgcaagtgctaagacagttctggaaacaataagtgtagaaagaattctaaggaaggagacctgtgaaagtgggatgggcagggaagacattctaaacatagtgggcctggagtggagaaggagttaaaattctgattaaaaacaaactttaataaagaagcagtgtgccaaggtagaaacagtaaaagatttgtagtaagaaaatatgaatttaaatcagctctacctctgaatagctgtaattttagatgagttcatttttagatacaggtttttttttcatatcatttctgttattctcagataatgttatctgttctaatcaccttttatagtggttgtcggtaatagatgtgaaaatatttgttgtacagtaaaatatggcataaactttagtcattattggtgaatcagtgtaccttagtggagtgagtatgctttccgagttggaaacacctgcgtctgaatcaacttactagctgtcacctcggcaagtcacttcaactctgagatgtggttttctcatctttaaaatggaaatagtactccttacctcatgacgatgttgtgaggataaaatagttactcttcatttgtgagggcccactagcagccaagcagggtgagccatgagctgtaaagctggtatacactgggccttcgatcattggtgacttcatcaaggttagcatttgccttaggattctctgagtgtagcacatatgcaaataacgtgacagataatgtgacaaatccctatttcagatcccatgttagatctggatattcaagaattagccagtcttaccactggaggaggagatgtggagaattttgaaagactcttttcaaagttaaaggaaatgaaaggtaatcagatccattgtgtctaatatgttcccatgttgatgcttgtctgttttacgtagtagcattttattttgttaactgctggattggattccttgttctggtctcagctgtcttgagaaacttagctactcctgggacttggtaaaaaaaaaaaattccctggggaaaatttttccatcttcgttctctttctttttacttttcctgcttttgccttgtttctttcaatgtgttacataaggtggaaactgtaagatccctaccaatttactcacatcattcccatctggaaaatttggaagacttaaaaacttcctaatacatgtaatgactacatcataaacatgtctttgaaacccgtctcccatcttctagtgttattcatatactccaggttatcctgtgctattagacaaatttcttaagatatattttccccctagacaaggctgcgacgcttcctcatgagcaaagaaaagtgcatgcagaaaaggtgagacaatcagccaggtatttattgaatacctataaaaggtccagtgctattattataattatatatcacacttgtgtatttctgaagggtcttagtgtgagcttttcattgaatattaacttctaactaattaaatatttatacagtaatagtatagttgctgcagtcaaaccaagatttttcacctggatggtgagtgatgtggaacctttattgagactcaggatgtttgcctttctaactattgggccagaaaactcttagttgttttgttttattattaccaacacaacacatgctattggcaggaaacttgtatggttgatggtgttccctgatatgtgtcataatttatcctgttcccttttggacatttaggtcatgtgcattttttgcttctataaataacaaagctgtgcatgtctttacacatcatctttgtatacaactctaaatatatccttggtataaatttctagatgtggcgatcatgggtcaaatggtattcaagggttctgatatgtgttgccagaggactggagggcaaagtgcagaattttaggtctcagtcagtttaaggtatgacatatgaaacaagctgaaatgtagctgt

SEQ ID NO: 80228 - DNA, 1024 bp, Homo sapiens
tttcatatatttcaagtttttttaacttcttattgttaaaaaaaatcatcccaaggcttaagaatttccaatttaaaatctttattctagaggctatagttttgtttctgacactttctggaagaatctatgctaatgaccagcaccgccagattttttcatgatattttcatttttatccatgcatccactggtgtcaacttactagagtactaaaactgaatcagatgtttttaggaccacagtttaacatactaattgtgccttccagaataatttattttacatcacttaacagctgcccctttctgcatccctgaagttccataagaatcagctgaggaggtgaattttatttattctttcctagtctagagttttgtggcatcaataaaaccatagatgctagagccagtttcagcaactacctgctaaaggcataaatccttcttaatagggatgacatttccatgccctgaatcctggggagaaaaatctagcaagcacgaaaagatttatgtaattcttttctatgagaagaatagttgtacagtgagtgcatgtggatggaattttaataaacattgaaccaggcagaacagaatttttttaaaagccataggtatataaaatatcatctaagttttttgagcaatgttaatatgcgagcagtctactttgggtaaacaaaaatgaattgtttttctcgttgtgtcaatttgtatgtttctaagttccttaaaatataagcagcggaacataatgaactctcttgttagttgactaaattcttcattgtttataatatgagcaaaagtccttctggcttattataattagcctgaaacctgattgtaaactcttagtcaattgtgaacctgattaatttgtctaaggtcatacaggtaggcagagccaggaatgaaagacaagttttctgaccactagttcagttttcttcctactattttgactttttcataattttatccattctaattggggcattaatttttttttcaaa

SEQ ID NO: 80229 - DNA, 1021 bp, Homo sapiens
cttcatgtttctggaccccagtttcctaacctctaggatgggtagaactctaggataatgtagaattatattaacattactttctatgaaattgagttccttgagtcagacttacttgcttctctttttaacccaggacctaatattgtagagccaaaaaaatggatactctgacagttgtctaaatgtgaatgttgtggtcaaaaattaaataaatatgtgttgatctctatctgtgtgtgtgggtgtatgtgtgtatagaaggcataatttgatggaggagattgtcttgtaagagaaaaaggggaagaggaaaaaaataaggaataagagtatgagaaaaatgatgagactttgttttaaaagttcacccttaaaattaactgtaagcaaatgaatcatgggaaatctcttcaaattagttaccctggaggcactgctcttctgccatcttgccatcttgaaaaaacttttttagtactttctttggaattatttttagacctgggtatgaaccacttaagtcatctttatttttttttttcatggtaaagtcttgtactggttctgaacgatttttgatttgattctgaacattccttttaggattttcaagagtgtgcttaaggttctggagataggactttacaatggaactattattggaattagaataaagctttcctttacaacattggagaggatagcactcactctgatgtttagttcagtttattaagaatttgtgtgtatgtgtgcatagggaaaaaaaaaaacaacaactaggaagacaaaataccagagtattgattcgtatctttggtgatttaattttcttcttgttttttttttttttttttttttttttcaagagtgagtcttgctctgtcacccaggctggagtacagtggcatgatcttggctcactgcaacctccacctcccgggttcaagcagttctcctgcgtcagcctccccagtagctgggactacaggcacacgccaccacgcccagctaattt

SEQ ID NO: 80230 - DNA, 1332 bp, Homo sapiens
gtctgttattttgaaaagcaatcatgtttttcttcccagtatttatctatataatatttttactaggtcctctactagttaggttcacccagattacatgttcttgtgttttatgaaacttaataaggagcattattttgtttggcatgatagtgtatgtgattagcctgatgaaagcatttagaacatagaatctccatgcatgcatctggtttggcttcttccttttacaggtggggaaaaacaggacccaaagaggaagagtaacatgctcatattcacacagtgagtttgtagccaacgtgagaccacatgataggtctcctgattaagactgttatatgtttttccatgacagtgtgttggtttatattactgggcagttggagaaatgagcacagagtgttaatttacctaagttgcatgggaaatcactggccaagccagatgagttcattggctacagaactcccttagcctaggtgctctctgacgtgagtaagattttaatgagactgtgtggaaatgatgatgatagctgagattttgggctttctggcttatttcttttaaatagatctttttaaataatttagatcatctggaatgatggagatgctttatcccacggtctttgcacttaacaaagtacagctaaggatagatagttaatttaaaactcgtgcattccttataaatgaaagataatttatatttatttttaattattttccttggagtcacaacaggttattattctcttcggtttgaattttaattcttatttgtaagaatagtaggtgctgttaatgtctttttgttacttaatatcagatttaaggcaaacaggttaaattacagtactataactatagtataggcaaattattattctagaaagagatttttaaattttcctgatagatataacttctatattaacttagaacttagttttatatccttggctccaccagtgtcttgtttcattaagccaaagtgtgcatttaaaaaaatttttatttttattttagaattgggggtacatgtacaggaagtctaattattccattgccccatagatcgtttttcaatccttgcccccctccctcccactttgaagtctcagtgtctactgttccaatctttttgtccatgtgcactcagtgtttagctcccacttgtgagaacatatcgtgtttggttttctgttcctgccttaattcacttaggataatggcctccagctgcacccatgctgctgtaaaggacatgattttgttcttttttatggctgtgtagtattccatggtgtacatgtaccatgttttc

SEQ ID NO: 80231 - DNA, 1053 bp, Homo sapiens
acttcacacttactaggatggctagggtcagaaagataataacaaatgttggtgaggatatggagaaattagaaaccttgtgcactgatggtgggaatataaaatggtgctgcagccactttagagagtttagtagttgctcaaaaagttaaacatagaattaccatatgacccagcagttccactcctagctatataccgaagagaactggaaacatgggcacacaaaatagtgtgtataagtgttcatagcagtattattcataaatgccaaaaagtgagaaaaactgctgaaaacaaaatgtggtatatccatacaatggactgttattcaatcataaaaatgaagcatgaatatatgctacaatgtggatcaacttcaaaaacattatgctaagtgaaaaaagcccgacacgagaggctacatattataggatttcattcatatgaaatatccagaatagttaaattcataaagatagaaagtagattagtggttcccagggtatgggaggagaggttgctcatgggtatggtatttctttctggggtggtgaaaatgttctggaattaaatggtgatgatggttgcacaactttgtgaatatactaaaaaccactgaatcatacatttttaaaaggctggattttatgatatgtaaattaaatctcaataaaaagaaagaaaagaaggaaatgataccaccaatgatgataataatggtaatagtagaaaaggtggtggtgatgatagaaaagggagaagtggcagtgatactaatagcagctgatagtatacgtgcaaaatcttatttaatcctcacaaaagccatatgagttaggctcagtggagccaagtaatttgcccaaggtcatatagctcatcagttctcaaacgtgtttgcacattggaatcacctgggaactttagtcacctgggaagcttttaaaacctatgctacctgagcctcacccaagggagtgtcagctacagtattttttaagtgcctccgggattcaaatatacagccatggttgacaaccactgacataa

SEQ ID NO: 80232 - DNA, 1109 bp, Homo sapiens
aggggagaacggcaagtggagaaggaagcatgacatagagaataacagttctatgttctgaccagcctggacaacatggtaagagcccatctccataaaaattagctgggcatggtggtatgtgcctgtggtccctgctacttgggaaactgaggagggagaattgcttgagcccaagaagtcaaggctgcagtgagctgtggtcatgccactgcacaccagcctgggcaacagagaaagaccctgtctcaaaaaaaaaagttgtgtattctagggtcactaagagaatatcacctagcatttggagctagcttagagagaggcctgaatgccagtcaggagagttttggctttttcctgtaaaaattggtgagtcactggagatttttaaataaggggttgatgcaaagaaggtggtgtgcagggaggtttggcaattgaagaaagtcaacatagagtctgaagttaagggagaccagagcttttgcagcagttcaagagtgaggtgctggggcccggggtaatgtagtggcagtggccatgagacaaaaggctggatctggagtgcaatctgaagagggtagtgcacactggcctcttactgtctgtattggttccctagggctatggtaacaaagtaccacaaaccatatgacatagaacagcatgaatgcattgtctcatagttctgaaagccagaagtccaaaatcagggtgttggcagggccatggtccctctgaaggtgccggggaaggatctgtttcaggcctctcttctagcttctggtagttccttagcttgtggcagcataactccatccttcacatgaagttttccctgggtgcctgtctgtgtccacattttcccctttttataagcacaacagtcacattgaagtagggatctacctactgcagtatgacctcatcttaatatatctgcagtcaacctgtctccaaatagggtcacattctaagatactggaggttaggacttcagcatacgaatttggtgggggatacaattcagtccattaacacagtcttttaggaattgcttcctgtatagggtttttctgtcttacatctcttggctgcctcaacaagta

SEQ ID NO: 80233 - DNA, 1032 bp, Homo sapiens
attcttattgagagctccaagctctgtatttgatttttttccttgtatgatgtgaactaacaactaaataaacaagataacaaaaccacagtcatttgaaaatatggcttggaggatatatacgtaactttttttttttttttttgagatggagttttgctcctgttgcccaggctggaatggtgccatctcggctcaccacaacctctacctcctgggttcaagcagttctcctgcctcagcctcccgagtagctggaattacatgcatgcgccaccacgcctggctaattttgtattttttagtagagatggggtttctctatgttggtcaggctggtcttgaactcccgacctcaggtaatctgccctccttggcctcccaaagtgctgggattacaggcatgagccaccgtgcctggccacatttttgtgaatgtatatgtatatctgtgtgagtgttgcatataaatatatatatttcccctccctgattagatgacttcccagaatctacaggagtaaagcgaattgtccaagccctgaatgccaatgtgtggtccaatgtagtgatgaagaatggtaagtaacttgggactcaagtcatttttttcctcttgttccttgtaagttttaaattattgagatatatgtggaaccattagtgctatatgaaatctgtagatttgttccaatttcagttcgctgattgaaggaagcgccaaaagtagcatttctaggaatttttcatatacgtttaatagttaattcagtaagaatttagaggttgcttgtaatacacccagcattgtctttggctttgagaagtacctccaaaattataagacgtagaccctattattaaggagctcctagtccagctgtgaaattcaagcctgtacttttcaaatgccagggaactatgcaaggcaatctgtgatgagtacagatgactgatgcaggcagtaaagtgcataaaatcagaaacatggctgttgtgttaggcttaagtatagagagagagcttcaagga

SEQ ID NO: 80234 - DNA, 1239 bp, Homo sapiens
gtttatattttttgttccctctagaaatcgggccttgatagtgtctcctcatggcttccactggcaaaagcatggttacctgaggtgatgatcttggtctgcgatagagtgtctgaagatggtaaggcctgtggatgggacagtagttggtacatgcatttgccattccttgataaacagagtacatctgtttctttaacttaggacatacatcccatgtgactttatggctttatgaaaatattttcagctatttttctttggaatcttgtaatacttactttttttttaagaatggatacttcggggctgagaagtcattttctttttattattttagatgcctttagaataacattgacattaagggaaacacattgagatttgtgaagaatattgcaggaatagtcatgttttattttctttttacttatgaagattcttttgcatattattttaggtataaaccgacaaaaagctcaagaatggtgcatcaaacatggctttgaattggtagaacttagtccagaggagttgcctgaggaggatggtaagtgtttatgtgttaggagaaaatatggcacttagatatgagagattattttaattcagggaagaagaatcacagcaaaattcaagaaacttttttccccagctgtttcaaggatttaagcaaaatccattgatgtaatcttataatcttacacttagtgtaataattcatttttttggttttaccacctgttttagaacttttgaaaatgtgtgtttttcttatggataaaggtatagggctgctttctaaaatctttgtcatttccataatcctttttcctttccctactgctgaagaaggagagttagaccttcgtagtagttaaagttgatgtttcttattttgaattcatagtaacctaaggctgaattcccaagaatcgcaggggacatttcaaatccatttgaatgtcttttggacatttgaagccaaaagatagaccccaaatttaatcccccacctccaccccaggtagctctgcaatcgctgtcctccgctattgctggaccttctatttcttcccctcttctactccccttccccatttcttttctcatcttttctcctttgaagtacacctgttttggtatctaccaggataagagggtttttggttcaccaaaaccttataatctggtacaagagatgaaacttacagataattgaattaccaagtggaatgt

SEQ ID NO: 80235 - DNA, 1050 bp, Homo sapiens
gcactactactgatattaaaagtgtacttaattaccctactactgaaggagacacaaaaaatccataacagtatcaacatgcctagtttagaatgcatttgtcttttttggctgaggtggataggtgaggacataaggtaagggttgtgtgtgtgcatgtttatatatagataaaatgtgtgtgtgtgtgtgtgtgtgtgtgtgtgtaggagaacagatatttgtggtgtttggggaattcaccttgaacttcatgttgccttctaattcatgctaaagagagtatcacctgttattgattctgaaccatagaaagccagctgcctcttttctttcatttgattggttaccacatttgtactttctctgagggaaggatcattattaggatatgcagggaacagtagaaagctgattaaaaagaggaagatgttggattactgaactgaaatgttgccttggcacatggcttccttcaaagctcttgaatcttatttcctgtaacttaccatatgagattatagggaaaagaagttgaccaaggatgtgagaaagtaaatgggagttactggagaattgatggctttgtaaaaagtttctcaaatcgggatagaggtttatacttgcacttaatactgaaggaaaggtttatgtttgctactagaactgggttggcatctaacttcctttgtaaaagcactacaaattaactattgtaagctgtgaaatggagtttgtagtaacagacctggcaagtaaacacctagtgtttgtctcttaaaaaatgatgtattacagctccaccaggtggctgccaacagtgtgaatgagacaggctggcatcgaccaggaggaggggaaagctgctcttgattttctttgtgcatatcggagtctacaacataataatttagtgaaggacaaagaagggagcccactgcaggtttttctaggaagtctggcaaaaaacaaaaaaacaacaacaaaaaaacctcaagatcactgtgactcatctttgacatataaatacctgaatgtcatagacagttt

SEQ ID NO: 80236 - DNA, 1140 bp, Homo sapiens
tgtttattaaaagagggaggttgtcatcaatctaaagaggaggagaagcataaatgttcatactttctccagacccaaagggacttaaaaaaaacatgtccacattacattccagtatgtgtgtatgtgaagttaaagttcagtaaagctgtggtttcccaaagttgttcagttcccaaaagctggggagctaagattcaattccagttctatacatgtaaaatatggtcaacttagcaactagactgtgtggattcagagtgcaggtagcaagcagtaggagaaattgcagtaggtgattttactattaaaatgaaaactatggctctcaaaatcagtttacaattagtttattttttgatggtagttgaagccttagtagataaagtgtgataagttaaataataaatgaaaatgactctattggtatacagtttgtttccttacttgtagagtagagaatttgacttttcgtgcgaagttttagactagtcttttagatattgttgatgtgtgaaatgattataaggtgtcctttcattaaatggcataccgtaaatgagggggtggcggagagtaggaggagaaataccagtggaaaagtattacacatcagcccatattgtacaaaaccacttatgatacagaaaatattttatcatcctggagggttctgagcatgtttagaatcagacttttatttctggaccatttaactgctttgtttttgtatggcaaaaggtaaaaatctagaaagtatgcagtggtcatttggtttaaacaacttactgccttttctctttaggaatatgccccagtaattcctcaacaaataatgatactcaacaaataatgcaatctgatataaaatcattttttgtaaggtcaaggtgtgtctggaattggttccttccagtgggttcttggtctcattgacttcaagaatgaagccgtgaaccctcgttgtgagtgtccggagtttcttccttctggtgggttcgtggtctcgctgacttcaggagtgaagctgcagaccttcgccgtgagtgttacagctcttaaaggtggtgtgtccggagttgtttgttcctcccagtgggttcttggtcttgctgacttcaggaatgaagctgcagaccc

SEQ ID NO: 80237 - DNA, 1054 bp, Homo sapiens
cggaagggggtctaggggcggggtcaggccagcctggtcattccgagaacgccctctccggcctgtctccccctcgcgccggcggccgtggtgcagcccaaggcggaagcggctgcctgacggaaccggctcgcgagcgcagctatggctgctggcgtaccctgtgcgttagtcaccagctgctcctccgtcttctcaggagaccagctggtccaacgtgagtagataggcgcctgggccgacctccaaggcccctgagcctcagcgggcgacggacccagcaccacggcctctctgggccttgtccccgcagcgggccctgcgttcttcctccagtcagtggaggcgcccagtctccccaggtggctgcccctatctcttaatctcgtgcttttctgcccactcggccttcttcggcgttcctttcggcttcctgtgtaaagtgagactgatttcccgctctgctcagcccaggccacaggtttttgcgaggatccgttgagatgaacctgaaggctctccggaaattgcgctaggttacaggagtgtaaggtgctggaattgttgatatcgtgatgttgttatccttgctgctccgggagagagtgtttactctgaattctgaagtttattctgcgtatttactctgaagtttattctgcttcttaatgtgtacattataagacttgttagctttgtccgctccactctagttattcacgcctttcatctgaggcatgggctctccgccaacatgagtttttgggtatgattgggctagtgcttttgcttgtagaccctcataatggctgtcagacttactaactcttaaaagagagaacatgggactggataataagccaactctactaaagggctctgtgaagttgaattataggtaactcaagacttctgttttaagtgtatggcttagaatcagagcagtgacttagctgtatgatctcgagcaagtcacctaacctacctacattccttccttcttttctttttttttttttaaagagacgggaacttgctctgtcgcccgggctgg

SEQ ID NO: 80238 - DNA, 1052 bp, Homo sapiens
cctcctcctcctctcgccgctaccgccgtcgccgccgccgcagccgccgccagtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggtgagtggtaatctcagtgtccggatgccagcaagggggactcagggacttgagtagtcagcaccttgaccactggtgacctgagccagtggcaatggctactgctggcttcctgtggaggcagttttattgcttcaggcacagcattgataaattgcaaccactaaaacctggcaaatgtctaggaccctggggagatagatcaatctgactgaacccctgccctcagagagctcatggcccgggctgggacacacatatagacacaaccacgcaaatgcaaactgct

SEQ ID NO: 80239 - DNA, 1037 bp, Homo sapiens
aaatagctacacatttgttgaatgcccatcaaacaaagtgttcattgtgagatcatgatgataattattgttatttttagagacaggatcttgccttggtgcctagactggaatgctgtggcatgatagctcactgtaaccttgaactcctgggcttacacaatcctcccacctcagcctcccaagtaactgggactacacgcatgcaccactatgcttggctaatttttaaattttatgtggagatggggtcttgctatgttgtccaggctagtcttgaactccttgcctcaagtgagcctcctgccttgacctccctaagtgttgggattatagatgtcagccactgtgcctggcccactgtgggattatttatttattttggagatagggtctcactcttttgcccaagctggagtgcagtagtgagatcacagcttgctgtagccttgacctcctggctcaggcttgtgggattattttcaatagcaaaaaattagaggtaaactaaatgcctattataatggattaataaattactatttgtctataattcaaagcattcaacagtgactaaaaagaatgagttaggattttttacatttgtacggaaagatatctgtgaaatattgttgaataaacaaataatgcatatagtatgatcccattttgtaaaatatccaaccacgcttccccaactttatgtgtgtattgaaagataggatctgaagagtgcctactacagtactttccagtgacttaccctgtaaagtggacttggggcctgaggcttgggttggtgggggcgggagggggtggatgaatgatcacactttttactttgtatgtttctctattgtttgaacatttttcaacaatcattgcctgtttttaaaagctataatgagtagaactcaatgtaattagtattttattagtcacattgaactctgtactatagaaaaatagtacatctgtctgaaatacatactagtgttgcaagctttattcagactctttgcagtaactccttgcag

SEQ ID NO: 80240 - DNA, 1069 bp, Homo sapiens
cacattgtagtctcctcatgacaggagcaatgagttattgaggagtcagagcctgaagccaggtaagtaaatgtagctattaatttgatattcaaaatagattggcttcatatgttatttttgaccactggggcagttgtgtgctctgtgagaggtcagcatcataaaggaaaagcctcttaatgtaaagtatgagaaataattgaaagaaggtgtaactaatgacacatctgagtagcgttataattgaatttgtagccatttgatagagttaagattgttgagttcttcactgggaaaactaacaaattaactatggactgcaaatagttggttagtttattgattattgctgtaattactgactgagctacatataatagggtatgcttgcagtattgacaacaggaatttgaaaattttatcattagtatgaaaaaaacagcatgagtattccttataagtgaaatactgtaccaattatgttgtctgttaggcatgctaaggagagatttgagaaactctcctgttacagatgtatggaagaataataagtaggcctggtatctcctctgtacgtgagacttgctgctgaataagttggaaggtatgaccaatgagagtcgttactatgtctatatcagttcctctctggattcttcctgtaaacatttgtgccctgtctgtaatgtgctaggcactatatggcagtgatttctcaggtttttgaaggcatagtcctttttgaaaatctgtaggaagttgtttatttttttcccccagaaaattcacataatgcagcatttcaccagcttcaaggatctcctaaagcccatatagatcccaggttaatacctctggcataagaggaaataaaatatacaaggcatggttcctgcccttgttgagcttccaaaagagaaacagtgttccccacaatacctgtttactttattatttatagtactgtagtaattgaggggaagggaggggatactgactcaacctcaataaaccagttaaattctaccactgtactttgtccagatatctcagtcgccttgtttta

SEQ ID NO: 80241 - DNA, 1060 bp, Homo sapiens
ctcaaaatttgaataatggtgaacaagaacagtttaattatataaaccattaagtctttcacccgttatacattgccccacttggaatccatgttttctaactaatggaacagataaggaaattctctaagtaacccttctagaaataacttaattgaaataattaaaagttaaacttaccttcgttaactgatactgtacaaataatcatggtatgagttttccaattaaacattctagactttcattacctgtaactctctgaagtttgaatggctcaattaaccagtaggctcctatttgcactgataaagtctccaaaggcagctgtcttggccaacccacaagaagatctgggttcaagaataatactgctcttccagcatatgtgtgggcagcagaatcaggagtgcttagtatattactagtaacttattgaagtgctaagtaagtacagttgggctatttaaggccagtgatagtccaaaacaaggattgtgattaatccacttctgttgtacttgaagattaagcaccaaaacagaaaaaaagaaatgttgctatttctgtttattagtccaatgattaggatgtagatgatttcttttttttttttttttttttcgagacagagtctcgctctgccaccaggctggagtgcagtggtgcaatctcagctcaccgcaacctctgactccctggttcaagtgattctcctgcctcagcctcctgagtagctgggattacaggctcgtgtcaccacacccagctaatttttgtatttttagcagagacagggttttaccatgttggccaggatggtcttgatctcctgacctcatgatccactcccctcggcctcccaaagtgctgggattacaggcgtgagccaccacgcccagccaggaggcagattatttcttaatgtttgcagtgactggagaatttgggcaagtttcaaaattctttcttcacaaggagtagtattttacaaactgaaaatttccattaatttctctattgacattatagctctgccatagaaaaccctaattgcagt

SEQ ID NO: 80242 - DNA, 1387 bp, Homo sapiens
aagattctttctttacttataggtgaatactcgggccggaccctctcaacacagcagcccagcagtctcagattcacttccaagcaataggtgcgagcgagcaagtaaagtgtgcccttgatgtgatttatctacagagttggggtggggtggggaagaagctagaaagaaatttgaccagttagataacctagctacgtattgaccaaagagaaaggacctcatatggaaagatgaatgtttagatttagactgggtgctgagaaggctctctggggagagtgacgtttctgttttgacctgaagaagcagagaagggcgtttcagacggagggaagagggtaggtgaaggccctgaggtggagaaggagctcagcatgtttgtgagtaggccagtttggcacagggaggggtgctgggttggggaagggatttggagagaggagatgagagagcaataggagtgataggagctaaggaggtagacaggacttatcatgcggggcctcgtaggccctgtaatgtttgaattttccttttggtgcactggctagcagttagagggcttttagtaggagagggacatggccagccctgtgtttttaaaagatcctctgcctgtggtgtggcgaatgagcagaagctcccatctaatcctgccctcctttaatgtttgacttcctactccttgccaaatggtcatcaaatctcttactgaacatccctgtcggaggaatgcactttatcagccaacgcagctccttcccttttttacttggctacatctcagaaggctcttttttgtgagctgagatttgtctttctatagcgcccactcataacgttttagttaagccctcagaacgtggttgttccctcttccaggtcaacagctcttccagttgtcttccctccaaacacagttctagattttctgtctcagtaaattctcccacatccagtccattgctaactccagataacttgtcagtcctccttcactgcttcctaggcctccctcagtgccacaccctgtcagtccccacacttgtgggttctaccttctgagtagctctgcgtctttctactcgccagcatccctgctgctgtgtgggtggttccagctctccagatcactgccacagcctcctgagagtctactccctccgttcttggcccattcagcccctcctccaccctgcagctggagccatcttgccagtgtacagtcctgagctgcagtcattccctgctttaaaaccttcactgctcttcatgctttcaagatgaagtgtaacctccatagcaggtgagcagtgaagagcccttcacatatgggtgctctgtgtactccagcttgctggcccacctctgtaccccatcccac

SEQ ID NO: 80243 - DNA, 1049 bp, Homo sapiens
ctttaaatgtttttaaaagtgatttttggatagcttaggtcaccgtgaacatgcagatgaatgaaatattgagtaaagtgagtcacagagaaattgccaggatacaattttttcttttttttttctttttaaccagacaaagttgatagccagatactagcataatgaatgaaacagtattttcctctattactctcaaagcatgggttgttttttcttttgccttaggtgaataactgtttattaaactgggtttactaatgcacatggtgttcctaggccataattactgaattcaagtcccattgccaaggcaaggcctttcctaaactacttagctttctccttctgtaaattaggatgattaaactttccatctatctactgctggtgttagaaagattgatgaagctgtattaggaatcacgttttatttcttggatgaaaggcattctataaatgcaatgaatcaaaatgttattaattcaagtttataacataatggaatatctatgtagaaaccttgcctgggctttgtttggttatttgcatctttacaataattggaactatcaactgggagtcatttgtgggaaaactaggatctgaatgtttcccagaaaaaaatgtgtgtgtgtgtatgtgtgtgtgtgtgtgtgtgtgtgtgtgtgtgtataagagatagatggacttcgagcaagatctgtaccttagaggtctgtattttagtatcctttataaattagggataataactatacctaaagtatagttattataaggattaaattaggataataagcatttagcacaatgcctagcacatggtcatcacttgataaatagcagctgctattattatgttaactggactgattttaggcagctgtgtattttttccatatatgtttcagctttcatcctattctacaaaattgttaattgccactttagtgcatcgattcttagatgtggtgggacattaaagtcaagaacccttggatgaagacatgctttataaaatctaggaaaatagggactcagtctcc

SEQ ID NO: 80244 - DNA, 1037 bp, Homo sapiens
aaacactttaatacttcctaaataactctgggagctgagtctcatacccataggaaaggaaaaccagctaaaatttattaattttatttgtaaaaacacacctgctatggacaagacacagtgctagattttttgtaatatttaatttttctggttaccctataaaattggtattttccccattttacagaaagaggaaattgaggttcagagaggataagtaacttgtcccagatcacacagctagtgaataccaggatttatttgtactacatatttgcttcccaggaagctgaattataacttttaactgtgtaagagaccaggacttaaattatctattttgtcttttgaagttctataatctttatttgctgtgaatattagtgcttagcagatgacattgtccacatgaaattgcctctgaaaggctatctaaaggcagtagaactaatgaccataaaaatgtcactgaagtagttcataagatattgtagcttcatcttgactgtaggcttctttattgcttttgattactaacagggttttagtctctttatttgataccttttgcatttggccagttacttttgaaaaaaatttacattgggagaaggatgtgaagaatatgctcaatccctatatgtaaaagcaaaggtgtatttcagtctggaattttcagtggtgttcagaggtgttgatgatcttgccactaaaaattatctttccttttcagcttaaagaagtcttctgctgaactgaaaaaaatactagccaatggccaggtaggtattattatatattaagattttcacataataataacatattaccgtccagtttttgtatccataagcttattaaacagataaagagtctgtgagtttcctgtcataaatgaataacatggcttaatttgattggcagaacaatttgcagcccgtttttcaaactgtgctaatgggtttcactcccagcagattgaagtaccatgcacacaccctgctgccatctcagtttttaaaaagttaatcagt

SEQ ID NO: 80245 - DNA, 1123 bp, Homo sapiens
ttcaggccagttatttcttactaattttgattcaagtaaatggacacatctgaaatagtagagtgcttttaaacatacactggtaaattaagctacctacagggtcctcgattcttcagtagcaacataaatgcgttttaatgtttgttatagtggaagccctttgatagccttggaggcaggcgcctgtccattgcgatcaagcctgcctattaggctgtattgactgagacatctgtgtcactgcaaataaaagactcttattgattttcttaactgctgttcacttcccgtccatgtttcgaaggctgaaatcttaattatctcagatgcttattcagtgccttcacacactgacctctccaagcctcactggcatttcatgaatcaagtacttgtagtggagcatgtcaagaagacaaagccaggtcctcatgcctgtcctttaatatcacctgtaacattgtggcctaatagatgtgcatgccttaaaacagtgctgtatggtagtgcttctggaggccttgcttatttagcacacaattccttgaatacagttagaagaaatgaagttgatctgcttctgacatctgattgccatccagagtatgtgaattctagtccttaaatatcctatatacagctaaggagaatctagtgtggtgtatgtataatctttgtagtctcaacattttagatagtatttatcgaatacctttaactttcagcagccaaaggtttgtttagattgaggtccacatctgtatcacctcagtgccttatattttgttagaaccagcatatataaacaaaatctgactaaaagcaaaaatattgagcctaggatatttatgtatcttcaacatgcttgcattctagttactaattgtaatttatgtatgagtcactgtgttcttcagctggaaaatatatttcaaaattgacataaattaagaagctttaactacatttgtccagcccagacaatggaaaataacctgtcatagactcttctttcaaaaatgaaaaacagttttttccactgcaaaaaataagcattttcataatgttttgacaaaaataagcagtctcataatgttttgacagtaagcctagtaccata

SEQ ID NO: 80246 - DNA, 1044 bp, Homo sapiens
agctttctgcctgggttcattgatataggttatgtgatataaatatttatttcttttctgtcactcagagtaaatgccaccaattgattcagcattgatatagtgtcaacagttcataagaaacatttgactggcctgtgttttccgattagtctctgctctataaagtgggatttactaaatctctccaattgtctgctcatagagtgtgactgctttctgaaaccattattgcttcgatttgtgaagcaaaggtctagtgatgggactagtttctgtcagacctttacatataaaataaggattaattgagcatttttattttaatgatttataagcgataggtactgattcttcttaacacagacaataaacaaagaatattttctgtgttgatccataattgaattccatttcattttttccattaatttcattaatatattaaatcaagcactttaaaaaaagtttaacacttagtctttggaatggagacattgttttcctgttatcactttatgttggagtaattccatttttccagcttaaaaaaataaatcagaagatatttttggcaagttttattgagagctataaatcagtctcactgatgtgttttctggatttgtttttcctacttcagttatagtgtggcatcatctgtttaacattggcccttgatttgaaactcattagaaatagcccaaagtgtcaatttgaagaatttaaaaagtgcacagttactccaaagatatgtgagtttggcctttgcatctctaaagttattttttctttttttttttttgttttttagattttataggagagggtggcagtattttcctattcctgataaatcaagtataaatctactcagatcagatctagaactaattctggtccagctgcatcttttggctgttattttgataacttcaaaaagcctctagaaaaactttttgtatttggctgggcgtggtggctcatgcctgtaatcccagcactttaggaggcccacttgaggccaggagtttgagaccagcc

SEQ ID NO: 80247 - DNA, 1080 bp, Homo sapiens
attcctggtaaataattacattttggctctaagaggagctagaataaacagaatatatgcaaacctaagaatttctgccagcaatctctagcagatatacttcagctgtactttgaatttttattttgtgcaccaggcacatgtatcttgtagatgaccaatatgaacaaacagctgtctcccttcctccctccttccttggaacgtgtaatctctgaataactgattagctcaatgtcagaaatgtttgtgctgatctctgaacctcagtcagttcaacacatgactccctggaaattttatctttggttttcttttttttttttttttttcactgccatgattttgtgagttagtttatgagtgtatttaaatcatttctggaatctaaatattttggacttgctggtctttataaggaagttagtttccctcctctcacatagacctctttctgctttctcctatctatcatattttaagagtatatgtgacaccgttaagttttaatcttctaaatggattggagaataacaccttcccttgactaacctcaaaggatttttaaaaacagaatgttgcctaatttttgagggagaatgttctaacacagtttatatatttttgtaactcaacaaaggtatctcataaagaacattggtggaattgggttttaaagtccaaatactttccttctgttgtccagaacatagctcctcaacctagaggcatagtgtcatgtgcagtgaagtcactcaaattccttcttattattggtttgaagatgactgtccctggatggtataagatatgatggtagtttgtgtcgttcagtttttacgttaaaggaaaaagtctctcctggtttcttttgaccctagtcatgatatgcccatttcatgaagtcttttatgcacaaaagtgcacaaaatgaagataaagtgcctctctccagcctgacaaaagccatttctttgcagaatggtagctgcagcgaaagtaaataaatgaatggacagcaatcacagcctagttgatgaaactgttcaattaaagcacaggcatttacatggtgtaatt

SEQ ID NO: 80248 - DNA, 1066 bp, Homo sapiens
ggattatagaagagagatttttgctcctcttcagctccctagggaagcttctccatactcattttatctagtgtggacaatttcttgagtttttaatggaaacgggttaatatttttgtcataggggacatattacatctgatattacggggaagaagggaagaaatggctcacttttcagaggtgcatttactctttgacccactagggtactatttagtgttctagaagaggtaatttagtaaattgtaccccagtggcctgaaaaagttaatgcaactctgaaaagtgagccattcaatcgattttccctattgcttttaaaaaatcaacactgaccatatccagagaatgttgaagacaactgaaattagaggatctagaagcaaccagtttattttcacacaaagcttgttgggacatgcactggatttggcttcagaggacccagatctacttcccactccagtacttacagataggaatcgtgaagcattcagtaacctcaccaagccttggtttccttgtctataaagtggtgataataataatatttacctcacaaatttttgtggaaatcaaatagctttactatatgtaaaatgttttataaactataaagcacaatagaatattaattattagaataaggaggttttctgaagtagccatttatgtatctgattttggaaagtaatttattgttagttttcccagaaactgtgagcaaagattagatggttatcacgttgtttcaagagagagtttcctagctagtcaatcctcagggtatttctattttcccccacatatattgcctaacaattccagttctttcattccttctcatcattaggctttatatctcttgcttctctgtttgcccactacattatttcagaatccttgatcaagagatcagaatgactgtagtttccttgatctcagaggtatttagaccatatattaaaagacattactctagttgatgtggagagtgttaaaagcttgaatcaggccacatcaacttgtggaagaaatatggaggtagtgatgaccacattaa

SEQ ID NO: 80249 - DNA, 1044 bp, Homo sapiens
attggcttcagagttgttcagccttataatcttttgggaaaatgtaatacaatcaactctcagattccttgttttaagtaggagacttatagtctcatgtgggtatctcctaatagtttaaccccctcgatttctaccatcttctttctttttgttttagttttcctttgtgccaatgctataaagtctttgaaatggaaacttctaagttgaggaaagacttgtatcttgttattctaaatttacataaaagcaggggcttttttggttaataaataaaatgtcacacagagcaaagaagcatcatctgtaagaatagaagcatcatctgtaagtatagaaactgatgatcctacagtatattagctttaaccaatgccatgttttaataaggaagtagatttaataattgaacctgagtgagaccaactcttaactttctgtgccaatgaggagaattaagaattgcgttttagacaatgatttatttgtcttgtctcgatcaaactttttcataatgaatcagatctcagagagctttcttttcctttgtctttttacctctgccatgtctctgatggacgtcctataaatccctagggcattcagagaatagagaatcagggaatacaggatatctcacaagctgtgaaatctttgcatggaaaacaaagaactgatgttattatttgagagagtgaactatctctgcaatgagctaataacaaatacatttgtaacttttatttattttaaaatagcctttgttcaccgtttttcttgtcttctacctgttctctgagagacatagggagcaaaataaccatcactttctttcttgcttacctagaataagaccatctctttttaattactggttatttcttgagccaaatcctaaccattgctttcactattttagtgactggattattttcttaggtttcctatccatttggagaacctttcaacaattgataacactctataaataattcacagagtaattgtgtccctcttttcactaaccttctttgaagtacg

SEQ ID NO: 80250 - DNA, 1077 bp, Homo sapiens
tccctgtagtccctacagggggactatagaggactacaggcacgcaccacgatgccaggtaattattttattttttttaaaagacagtgtctccctatgttgcccaggctggtcttgatctcctgggttcaagtgatcctcctgcgttggcttcccaaagtgctgagattacaggaatgagccactgtgcccaacctgattaaagttttataagtagtatttagaaataaccaatgaggttgttatttgagaatatctttagacactttcaaaggttaaataattctttggtaaagtaaacagttgtcacccggtttttgtaatcttgctttttctttaaatgaaatatacttgaatttctgtataattaattgatataataaaagttaagtttaccttccatgactggcttgacctttgtccactcaagtaggaaaagcaaaatgagtaagttcttataacactcatatatttggataagtatatacatatgctttatatatgtagtttcctagtcttgcctgaatttgtaacattttacttgtaaacgatattacaaatacctatatgctcttaataactaaatcatttctataagtcagtcaccttcaaaaaactcttgtcagtgattgttcaactctgtaaatttactaaaaagtagaatgtacccttaaaacaagtgaatgttatcatatgtaaattatatctcaataaagctgttaaaaaattttgtcagtcctttctgctcgtggacgccacagaggaaacatcattaaagtctctgttctccctgctgtcatgtctaagtcagagtctcctaaagagcctgaacagctgaggaagctcttcattggagggctgaactttgaaacaaccgatgagagcctgaggagccattttaagcaatggggaacactcacagactgtggtaatgagagatccaagcaccaagtgctcctggggctttgggtttgtcacatatgcccctgtggaggcagtggatgcagccatgaatgcaaggccacgcaaggtggacggaagagctgtgggaacaaagagagctgtctcaagaggaga

SEQ ID NO: 80251 - DNA, 1065 bp, Homo sapiens
acgagaccagcctgggaaacgtggcaaaaccctgtctctacaaaaaataaaaaataaaaaataaattagctgggcatggtggtgtgtgcctgtagtcccagctacttgggaggctaaggtgggaggatcgctgagctgaggaagttgagacttcagtgagccatgattgcaccactgcattctagtctgggtgacagagtaagacctcatctcaaaaaaaaaaaaaaaaaaaaaaaaaaaaaaaaaaaaaaaaaagaatgtataatccactgtatagggtattgtataatgtcaattagatcaagttggctgatagtgttattcagatatttgttattagatatttgatttttatctagtactatcaattactgaaagaggggtgttgaaatactcaacaataattgtggcctacagttctgttattttttacttaatgttttttgaagatatattcttaggtgcatttatgtttgttatgtcctcttgataaatcggcctcattgacattatgaagtaaccttctttgtctgtgatcatattctttgctctgaaatttatagtctgatattaaattctaggcttcattttgacaagtgttagcatgatatttttttttttacttttaacctattgtgtcattatttttgaaatgtatttcatgtaggcagcatacagttgggtcttattttttaatccagttggatgatctctgctttttaagtgagagtattgagactatttacatttcatatgattattgatatgtttggattcaaatctgtcattttgctctttgttttctatttgttctgcctgtatgcccccttttttaagtgattgctttagaattcataacttaacatagtcttcctatgtaaatagtattgtaccactttatagtctacaaatcttacagtggtgtattttcatttccctcatcccagcctttgttttattatcatccattttacatcatcatatgcgataaaccccaaaatgcattgtcactacttttgctttagatatttatctttttttttttttttgagacagagtctcgct

SEQ ID NO: 80252 - DNA, 1058 bp, Homo sapiens
ggggctttcaggccttcagctacagactgaaggctgcactgttggcttccctacttttgaggttttcagacttggactggcttccttgctcctcagcttgcagatggcctattgtgggacttcaccttgtcatcctgtgagtcaatactccttaataaattccccttcatatatacatctatcctattagttctgtccctctagagaaccctgactaatacagagatggtatttagttacttttgaataatttgattctttcaaggcttgcttttaagttttattagacagtaccagcccagtggttagtctagaactaattttccccgtgcagcagaggtagtactcttctgagtactctacctggtgccttgcaaattgcaaggtttttccacactgactggtgggaatacaaacttttcttgcccagtattaatctggagatcgtttcttctgagcctttctagtggttctctccctggcctcaggtgatctcctgacatctatgtacagatcattcattactcagctgaagactccaggaccccctcggcagacctctggagctctctccctcaggtcctctgccagctctctgccctctgcttctctagcttccttggcctcctcagactctcagttttgtcttctcatcttagggagatggcttatctctgcctggtttcccctccctgcactgaggcctgggaactctctggtcagcaagctgggcaatcatagggctcatctcatttgttttccatctttcagggatcactgccccattctggctaatgtccaatgtctggaagcctgttgatgtgtgtgtgagtgtgtgtgtatgtgtgttttagtacctcttcctttcttttttttaatttaacttttaacttttttaacttttaatttaactttttttaacttttttttacttttaattttttaaaaattaaaaaagttaatttttttaacttttaatttaacttttttaatttaacttttaaggggtacatgtgcaggtttgttatataagtatacttgtgccatgggggtttgtt

SEQ ID NO: 80253 - DNA, 1020 bp, Homo sapiens
accaccatctcagctaaaattaaattctgtcaatttgcatcatagtagtatcacattgcatgagactttttaaactgcaaaaagttcacatgtgattctcaagccatatatgtcacgtcatggggaaaccttttaattttttttttttttttgagacagggtcttactctgtcacccaggatgtagtgcagtggcgcagtctctgctcactgcaaccttcacctcccgggttcaagcaattctcctgcctcagcctcctgagtagccgggactacagagtagtgtacaccactttgcccatctaatttttatatttttggtagagatggggttttgccgtgtctcctaggctggtctcaaactcctgacctcaagtgatcctccctccttggcctcccaaagtgctgggattacaggtgtgagccatcgtgcctggccaccttttaaatctttaacttctgaaacttcaaaggttcaggtcctctctgagctctgccatcagctgactcatggctttagctagaacattcacatcactgggactgtttttcccacctgtcaagtaaagttgctggactgatctttaatgtcctttcctgccctaatgtttgataggtctaacagttgccatttttgatagatctgtagaatagaaatgataataaaagagaaaaattaaaccaaccccttctgccatttttaacctgataagaattactgaattgcagaaaaagaactcatcaaacttaacaggaactcttaatcctgagtggatctgctacatcattttttcacctatgacgtttatctctaacggacatgaaaaggacaaaatgaatcagtgatggcacagagccagctgtgtaaagatttagccatatggatagttaaggaaagcgggtctaactgaggttaaaaaccagtgaaccacctcaaaattagattcctttttggcttcttctactgataatggtggtaaggtaatctttgttttttaggtttagcttgttgaaaccattg

SEQ ID NO: 80254 - DNA, 1067 bp, Homo sapiens
tgtctagtaacagaacacatgagagaataatcagatgagtgttgaatattgcaaaaggaatctccttttgtttttttaatgttcccaaaatatctgaattcatttggagcaaattattaagtgagaaagagactataacaaagcaacttcaaggcctagtgttactaacagtgctgtttaattttacacatctgctcatcttagctgtatgtacatttggggaatggaacagcatacacattagatgtgactaaaggaaagttttttcttttaaggatataaactgtgagatggagaaaacaactgatattttcaactgtgatgtcatatctgtcactaagggttgttttcttttgtggtggttttaatatcctagtgattccacatttcttctgaaatcctcctttttaatgagggtatctagattttgacaaatcaaatagtcaggtttttgaaggtatttaactgactaaatggaatcataaactagatttatttttaaagccagtccactccatttctagagtatagttggtgcgaaaggtaggtgtagggagagtgagttttgttagtgttactttctctgagtataaataagtgtgtaaacaaatttggtggatgaaaaaaaattgaacatttttgactaccaagagtaagagataacagtattcaacatgatataacttatattgtttctattccctgtactcctacctccgcacacccagctaccggtaaagtggtgatagccattttaataagaattaacccaatggtcagttctcaaaattttattgattctttaaaaaatggacatctatccatttgacaaaagaactaaaggaaaaacatccattcttaatagtaaagctttctttaaaagggcagtgccatggaaattcgagtgttgttagaaagtgagtgttaggatcatcctgtctctgggcatacaggttaattctggcttgtaatgaaatccctctctagctataactttgtgcaaggaatcttagtagcacaaagaactatagtggatagggaaatatgttttagttattctgccatta

SEQ ID NO: 80255 - DNA, 1084 bp, Homo sapiens
actctgactctaggttgttggtttttctccagctctgacactatccacacaaatgaacatctcgagaaattaagcctctttccccatattggtcattcattctatttaccttgggtgatcacagggtatttctgtatttgcagtatgttgtgattttcaagagatcagaaacgctacatgtcttaaaagtattcttttaaaagaatatgtgcctagaatatataaagaactctcaaaactcaatggtagaaaaacaaacaatccaattagaaaatgggcaaagacatgaagagacattccactgaagagtatacacagatggcaaataagcacatgaaaaagatgttcaatatcattaggctttagggaaatgcaaattaaaaccaccatgagatattactatatacctatcagaatggctaaaataaaaaatagtaacaatagcaaatgaggatgcagaaaattggatcactaatacattgctggtaggaatgtaaaatgatacagccccactgctgacatttaaaaaaaagagaaagaaagctagacatgccactaccgtatgacccagcaattgcattcctgggcatttatcccagagaaatgaagacttctgttcacacaaaaacctgtacgcaagtgtttattgcagctctattcatcatagccaaaaactggaaacaactcagatgtccttcaacaggtgaatggttaagcaagctgtgggcattcataccatggattactgctcagcaatagaaaggagcgaactgttgatgcccacaacctagatgaacctccagatcattatactgagtgaaaaagccagtcacaaaggttacatagtgtatgattccatttgtataatattcttgagatgacaaaattatagaaatggagagagcacattagtggttaccaggggctgagaggatgggagacagagggaatgtttacaatggagcaagatgaggaatcctcatggtgatggaaatgttctccatcttgactatcagtgtcaataccctggttgtgatactatactacagttttataagatgttaccattaggggaaactgggtg

SEQ ID NO: 80256 - DNA, 1045 bp, Homo sapiens
atttgcatgccataaaattcatctactcaattcagtgatttttagtaagtttataaagttgtgcaaccataaccataatccagttttagaacattttcatcaccccaaaaaagtgtcctcatgttcattggcaatcactccctgctcctgtcctcagccccagggaaccactgatttactttctgacttttacagatttgccttttctggacattttatataagcagaaacataccacatgaaatctttgtgcctgacttctttcacttagcatgatgtttttgagatgtgtctgtattatagcatgtgtctatagttcattcctttttattgttgaatagtattccattgtatggatatatcacattttgtctgcttatttactagtagagggatatttggcattgtatccactttgggacgattatgaataatactacttttcatacacaagtctttatgtggttctgtattttcatttctcttgagtaaatacctaggagtggaattggtatatttctttagatatttgtaaatcatagtttatcaggccatctagcacatatcagatttgagaagaaataattattttaccattggtatatattatatgattagtataatgaaccaatgtttcatactttgttaaagagtgaccacatagtgactacaaaggtcatatgatagctttatgtttaagttttaaagacactttgaggctgatttttatttacctaaaaccacctactattatccttagcatgacagaaggctcttttagtaaactcttccattctttctgctcactgatatttttctaataatcttctaagcatttcaagttattggatggaactgcatcataaccacctattatctacttgggctgtcactgctgcaactcaaagatttattgcatcatcgttaaaaagcccagcttactgtgaaatctcactgaaggagtgagacagtattgtgacaggagacacatgttgtgattggataatgttaactcgtctgtgatcccagctgaacacacttgcta

SEQ ID NO: 80257 - DNA, 1248 bp, Homo sapiens
caattcttttgttaactataacagcagccaaaaataatgtaagggaagagaaggataaatgaaacaaagactaataagcacatgcatgtacacatatatacacatcttttagataaatttctaagtattatctgaagtagcatttgccttgtaaaacatgtgaaatagcagtactacattaatttcctcatcggtttcattcaaatatgacctgttacccgtagcatatgaatgctttttccttgttgcctccctttggcattactattacttagataggaggactagcttgataattacacatatagagcaaaactcatcctttttgtgcaaattctttgcaagaagattacattttcttatctacctacttttcctgaaaaactagggataggatgatgggtgtatttactgttgttgtaagccaaggtttgatttcactgtcacttaaaataaactctttcttctgtagaaaccagaaatcgttgaacgtggaggagttaagaccttacattttaccttcggttaaaaaaaaatgcttttcattaaatttgtgatttgaatttcggattgagcagatgatgtcatttctgcaacttggtgtggtgtgcatgtgtgcttttaaagaacaaacgctgtagatacatggaattagttacatggccttttctggtccctttttagacgtgaagccctccaatatgctagtaaacacaagaggacaggttaagctgtgtgattttggagttagcactcaggtatgtctcttttcctcccagtgtactgttttctctgcaacaacccctttatattttcattctgttctctggattgaaaaatcacctagctgccagacaaacagaaactctgcatcttttcctcatctgggagtgtgttattcatttttaatctctgagcgagtttccttcatcagaatatgattgttcattgtttaatgacagtaaaaactgctgatattgtaattactacttacgaatagcaaacttcattgatatgcagctttgatatgaaagcgttttggccagacaaaagggagggcagagtgggagctgtgcctggggagcccaactggcccacaataaaaattaatattgggagcaacaatggtggagggccattacaatgtgcagcacaaattttaattaatttccattttggacctcccctgagaaacccagtgatagtgacccatgagcatgctgtgatgttgatttgaattgcagccac

SEQ ID NO: 80258 - DNA, 1004 bp, Homo sapiens
atgaatctgggtaaaggaaataggaatgtgtattgctctgatctcattttttcaaatttcctataagtttgaaattattttcaaataaaaaattaaaagaaaccctcctgttccagaccaatctatcaaaatgcaaataagtgataatatcatataatgttgtgtaatttgttactccacaacaaagaccactggatttggagggagaggatctgggttcaagtctcagctcattcactacttaggacctggcctaaattacctcactactctgagcctccattttcttcatctgtgaaatgacttccaaagtcttcctcacagggacttggtgaggattcagtaagaatatatctatatataatttctatagatcatctatatactgtatgcacaaatacatatatacacacatgtaaaattgttttgtcatccgtaaaatactatgcagatgttggtggctcctcaccttagctgagcttattttggtgtatgtgttttcctgagtagcatccgtccactcacaggctcccttctgatttcttgcagcctgaaaggatttcaggggagcagtatggaattcattctgatgtctggagcttaggaatctcttttatggaggtacgttgtttgcacatagacgcttctgtgcatatctgtactaatatattcaatcaggaaaagtgaagattttgaaagaataagctaaaataaaccttcagcatgttatatagatgtatacagagtttgaccataaagtctttgattccttgtgtggcttgtgaactgactctggaggttattttaaagcactgtttattacagatcacctgtgtaagacctgcctggagcgcttgttaaaaatacagattcttcaaccccgttcaagaccaattaaatccacacctctaagaatctgcattgttaacctgttccctgggtgattcttatacatactaaatctggagaacccgtgatgtaaaatagggactccagaaaaattc

SEQ ID NO: 80259 - DNA, 1075 bp, Homo sapiens
atattagaaggacatatggctcagtttgaattatggtagtatagaacctgtatactgaccagtgcttcaaaaattctcatttaaattgattcagataaagaaggacttgtattttctttattttttcttaatagagatagggtcttgccatattgcctgggctggtcttgaactcttgggctcaagcagtcctcctgcctggacttcccaaagtgctgggattgtaggcaggagccactgtgcctggccaggactttttataatagaaaagtagaaaggactctttaaataatatcatagatagagttgcaatcatgattttgtaacctttttttttagtcaaatactttttctgtgagttttgtaatgcatgaatgcaattgtatttgtaaggaaataatcttcaaactcaattcacctgcacagtagaaagaaagcaaaaataaagtgttgaacgtttattaaatcatattcttctgcttcttcttaaaagggaatctaagaggaaatacaatatgtatgcatcagctgagaggttagcgataatggtggtcagatctcagaactgagtctcccaacagaatccacaagggcttattctattagcctgtttcaggggaaactagtgtttttgatttgtgggactcagtattgctgttatacaatttccttttgcatattttaaattgttatcatttattttataaatgactggatatagtgtaagacaattgagaagttacatggtgtagagataagaatcctagattgggaatggaagacctggattacagttccaggtttgctactagttttttaggtgaccctgtggaagccactgttcttcactgggcctcagtttcttcatttgtaaaatattgatctctaagcccctttccagactaacattctatgactgtgctactgctcatggtgttgttttctttccttagctttcacacagcaactctagagttgtgtgactgagacagtgataaaatgacataaaatgcagaggcatggcactactataagagagcataactattagatttaagatttagagcacatataa

SEQ ID NO: 80260 - DNA, 1011 bp, Homo sapiens
ctgacctcaggtgatccacccgccttggcctcccaaagtgctgggattacaggcatgagccacggcacctggccatcttctgaagattttttgggctctattattttgacaaaaagaattgtgagttttagaattacctttaccaagttaaaaataaacccatggaataataaatacgctgttctctgtacatgtaatatcatttttcttcatctccccaagatacagtttaaataaccatccttcatgataccaactctgatatctccagctgaaggtaatatcttcttcttctgaccttcacctgcatcttccttgtggcatgtaaattgtccactttgtattacagtaatttataggcatgtcatagttccttatgacaggattcaaatatgattctctcataatcttctatgctgtttagtacaattccattgccctagtgggcactcagtaaatctttttgactcaaatttttcctacttttgtaatggtttttttaaagcagtttcagaaaataaagatcagagtttaaagtgtgatggagtctttaatataaatgcccgtaagtgtttggagaatagatcacagtgttgtgcttgtgaagaagagctttcagtttaccaaggtatcagatccagatttgaattccacttcagccagcctaagctatagaaccttcggtaaattacttaacttctctgagcctcagtttcctcctctttagatgggagatctatttcagagcttttggacaaagttcacaagggaaaaaagccattatcccctctctttaaaaggaattaccgtttgaaatgtttacatttgaatcagactgctaatttggttaaagatggtgcaagctttagcttacagtttcacctcaacctccactaaaaatagccataacgtgatttacacacgcacacacaggcgtgcacgcacacacacacacacacacacaaaaggataataccataaagagaaagggaaaagagacaacagcactca

SEQ ID NO: 80261 - DNA, 1011 bp, Homo sapiens
agaatgaagaaagacagtgtccagctgtagcagtagtttggtagcaggagaattagacgtaaaggtactaatgcctgaggggtgggtcatgaattaataattgctatgtggcggatgagccccgtcagaagagctgaaaatgaggaagttgccttgcagagcgctatcaatcactcagtgaccataacttccagtaattagtgtattttatgggcctttgcttcagtggctcgaaagcacatatgctccagtcacagctaaactttgctggagtaatattccaggatgatttatcctcctgctgcactgggatataaccctatattaggtgaagattgtgaactaagctgcaataaagtgtaagtttaggtacagtttgcccaggttgagacctcaatgtatcacgcttttcagcattcatggttaggctatagcaggcaatcatttttaacagtgaaacaaataaagcaattaaaggaacagcattaggatattgtacttgtgaattactgttgccctcttcctgtttaagtgtctactgtaataagcccatttctttttatttttttaaaaacgtactctgttagaaacatttgttcgttttttgttttttttaagttccagggtacatgtgcaggatgtgcaggtttgttaagaagtatttatctgtaatgctgtcttttctcccttattattaataatctgggacagaatgcagaaccttctgaatggtagataagtgcttgatttatttatttgtgctactgtttgggctccttaagtaagtttatatcagtggactttggtgaggacaagtagttgttgttttttgttttggttttaatattggcacccgttaaggcgcactcctgatgggaccctcacatttaggctctttctacacaaagaaaaaacattagttacaagctctcagactacttggcacttttcgtataggcataatgagttatttgctgtggctcacccactgcactagaagtctatgaggtc

SEQ ID NO: 80262 - DNA, 1030 bp, Homo sapiens
gcacaggcacacatacaaatatatttgttatttaaattataaaatccaacatattcaaatgctgctaactgaagagcattttatagattgtggttggccaagtcaaaggtcaataagatgacactaaggaacgtcctgtttttagagtgagatgttagttgtttactgctatttaagtgtatccccaactggtaacacttcagaccattctttttcagccttttacataataaacgtcccgcaagagagtcttcagcagtttgctaaatcttaagtatttggaattaaagtgtactttttaatttaacattaaatagaatcccttatctctacctccaccccctggccccaaataaataaagcttttccaaatcttttacgatgtgagctgctcccctcctgggaatgaaaaggatatgagacccatttgatgaattgctggcacttatatgtgtctacatttttcagtacactttttaaaaaaaaaaactagacttaagctgcctatattacatgcttcttttgtaaagatgataaagagagcaaagatttctattggcataggcctaatctatttgctttgttgtgattctttttttttctttcctttaactgttaacctatttataaatctaaatctacatacaaaggtcattggttggctgaacttaaaccattttactcagtaaatttaattaagaaaatacagtgcaactcataagcaaatgagttttttcctagttttaaaccaaaccaccctcttgagtgctgattgccttgcccgacccctagtgatacagaaacaggcaaaattaaaaaggacattaaagcttcattaaatctgaaacacatttagtacagtgacatatctgcaggccatttcagagaagattacatactctcttttgtaagtttcctaatttataataccttgacaataaaaactagggaaatgcaagtagattaatagaccagtaggggtaaaagatacagaatggccccaggtctgcctgtgtgtgaaatattcact

SEQ ID NO: 80263 - DNA, 1024 bp, Homo sapiens
aaactcctgattttttcttcttgttaaaggttgagagtgatcattgtgcttttcctttgtgtgacattcgggattgttttttttcctggtccaataccatgtactcattttgaggttggaggagagagccagctttttcttgatacactttttaagctcttaaattcacttaaaattttttgagttaaaagattaagacaaagggtgaaagcatctaatctaggtcattatttttgctaggcaaatatataggcccccaattttatgagtgtaattttgaacatattatttaaaaatattttgctccctcctgtctacatttgtaaggaaacaaaacagtccattatagtagcattgctgactctaatctttattaaaatttctttaagatttttattatagaagggtaccagcactaaaatagaaagctattttgtggtttgaaaatgattccccagtttgtgggggaaataagtgaaatgtctagagggatgaaaaatgaatggtttgactgttttcctctggttgatgttcactgtttttctggcatcttggtctgtacaggccaaagtgcctagaggcatgtctgatttaaaggtggtgttggtctctgctctttaagcatctattaacttgctattattatgcaaataagtgttgtattacacatactaatttatgcatggttagattatgcagatgcatcacaaacatggttattgaataataggatggggctcattctctctaccatctttataagcagttttaagcaaattctcctggtaccaatgtggacatttaaagaccctttactcaatgaaatgtctctttcgtattcttttgctttcatagttaaagccatcagataagtggaagagaaatcgtccaagttgttaggttcaagagtgttagtctcacttttcaaattcatagacttttttgtttaaatgtaatcttttccttatagagaaaatctaaaatgcagttgcttggcatgaatgctggcatttagtgagatttt

SEQ ID NO: 80264 - DNA, 1007 bp, Homo sapiens
ctgtggtcaaatttgagaagaggctatttacctttgcagtatggttttcctgaatgtctaaatatatctttacttgatcagtcaagtggaagttggaaaattctaatactatgctgaactccctagttagcaacaacctttataccagagttggggcgggaaacaactgtattccttgaatcatgatagaatgttgtcaccaaattgttacttctatctgaaataatagaagcagctttgatgccgttaggcctatttcctaagtttttcaacagaagttggggtgcgtcgttgctagaaccactaatgacttttggtggagttggcatttattttacaggctttgtactataagctgaagattgggaaaggatactttataaatgcctttcctacccctcccttatgccctcaaaaaaagcacatgaagaaaaatgtgtatttttatagtgtcactgaggctgagttatggaataacaccttctctttggcccacgttatgtcatttgaactcctaccactctgtgaaatagcctcccctcataaattggacaaacagaatggctgatttgctcactgttaaaactgtgactggtttggtttctttgaatcccaagtgcagtaggcaggagtgaatcatagactcttagagttggaagggatcttagacatcatcaaatcaaacttctctacaatgtctctgaaaagcaaacatccacactgcttgaacacttccagtgacaagaaactcactatcttacaaagcatccacagggtcaaagcagtgttctatttatcaagctgagaactatctcatcctaagtgtcactcactagtctgatcctagaacacatgagagcctttcatatatccttaagatcacattggtttgattgttcctaggactagggacagtgccagggaattgctgctgtgaacctaaagtctaatcagggcaccagacctgagttgtcttcactagtggcaaattgagaggagtggcctat

SEQ ID NO: 80265 - DNA, 1051 bp, Homo sapiens
ttagaattagaattaggtgctaccacagtctcactgcaggtcttaattgttgctttgtaactctgaggtgtcagtttcctcatctctaaaatgaggattctaatgcctacctcttctatctgattaaaggaggtatgctgatcaaatgagactatggatatgaaaccactctgaaaagtacaaagggccacccatctggatcagatgttgggctgcagcacaaaacagaatttcccagctatcaatcataggttgtaaaaggatgttcttagcaacatgccagccacaattggagcagagtataaaatgagcagagggtaaagtggggaggaggggccggcttcaagacttgtctttcccccagctcagtgtcagtgctgctgacagcatcattagcagcccctcttcctgctggtgacacagtgtgtacccagtgaggtcgcagagagggaggagtgttgggaagatactagggacagtcagtgccctgggagcaacataaaggttaaagggctgggtttttgttgagatagccattctgtatgagtttcattgttttgtgggttgggtctttgttatttgaaagcactgttttagtttcctttaggcctttgggttgcataacttccttggcatgcagtttagggttctaaagaaaaaaaacatgaggagcacagtcttattactactgcctataacaggaaaaacaatagtgtcttggcttcacctggcacctttcccacatagggttccagtctcaggctgttacctgactcaggctgtgcattctacctgcagggacttatttccagcctctaggtgagccaactcaggctcagagaggcaaagtaccttgctttaggcaggaatgggtacagttaggtctaggacttgcagacaaataagccaactccctggctctttaacttcttaattcgtttggctattcatacccctgttctcctttccactctgccccacaacccttcttctagtttgccctctctgccctagggaggcctcttgtatagatgagaaatgctgagcattg

SEQ ID NO: 80266 - DNA, 1056 bp, Homo sapiens
atagctctgtggggagggggggcttaacagcgactgtgggcgaatctgtactcacaccttacatttggggctttgcaagggaagtgcaaacatcctaggcagtctgagtgcagagagagtaacaaatatttcatcctgccttgtcattgattagaaaagagcctttaatttcatttcaccccatgttgtgattaatttgcattctttgtcagaagttaatggagttttttatggttcactctgaaatccttgaagacatcagacttgatctgatgtttatacaaccgccagcggaattttttcgtttgattgatggcaagcttgatgttattccaaacggctttttaagctgtttttaagaattatttgaataaaatgcaagcaagatattcttgtaacgatccagtttatctgttaaaaatctgtttcaaataagatgataagtagtaaaaaaggatcaaaaagataagagaaatagtgaatagtgatgttatttgttaaaaacacataagaatggcattcaaataaattattgcagtatatggagaagatcacttttattgggaaaaaaaaataccatcatctggccaaatagaataatttggactagggtaaaaggaaggtctgaatctttgggatcagaaacttttactaccaattggctaattctcatttattctgccagcttttgccaccagtgtacaaaatagagatctactttacttaactcaaggagacagggctgtcaggcctgttagctgaacaaaatgatgacatattgcttgtctcaaagaggcattcttaaatcccaatacaagttaaacataggtagataataagtgaaaaatatgcattcttaatgatataacgactggcaccttccatagatagttcagaaatgaaaatatcctgttgttaaaaccaagatacttctgtcatccttgggtaagagaaatgtgtgttcaacccctatatactacatatcaaagtatgagaggagctgtaggtggcatttgcttcagaacctcctgctattaaccaaggaaatacgttttg

SEQ ID NO: 80267 - DNA, 1020 bp, Homo sapiens
cagattcttgctgtgctgtgactgctgctagtgagacttactcataggtcaaaaagctacttatctgagcactttcatttaaaaccgattaatttatttgctgcatctgaaagtttgctaaataattgggtagttttaattgaaattactgctttctgatccttgtattaacatgatctaaggtcctttttattatatgcaatccatattattgaccagatttgccctgttttcatttaaatgtaagcagcttgtcaaggagaaaatattttgtttaacttggcttggaaacgtgctattttaatgtgttttgtttttttcaattgacagactgtcttttaaacattcatttattttgtagtaataaattgtgctctggatagagtatgtgtttcagaatagagtagaaagcatatgttcttaaaactatttaaaaacattgagcacttttcaaatgctaatgttgaagtactagagtttttacacttaattttatttgtgttttaaaagcctttgactagtatattgttactaattctaatgttgattgtttactgatgtcttatattctatgttaaatttagaccacagatatcattatcttatttatgtttactgatcactcctggaattgcaaaatacctaaaaagtttgcactctttgaaaagaggtattagaatctatcctttgttgcataaactttttgaagtttggaacatgaaggatttaagtaaatttttaaatatacagttttttgtatgtgaggtctttaatcaaggaaaaaatagcaatgagtaatcaccccaaacttcaagtactcacctttaatttgcaagagtttaaaggggcactatgcatgcaattttttttctaaacagatgtctagcctatatgttttaattcattttacttttgtcctcactatttaggatatagacatttaaaatatcctgatatttcaagcataaaatcagatttatattccataaaatgcagagacgaaatttaagtgacatgaag

SEQ ID NO: 80268 - DNA, 1059 bp, Homo sapiens
caattcaacattatttgtcactgagcacctactctgtgcctgactaagcactaggagcacaaaaatgaaacagatgtggtctctgctctcaaaagagtgcagtccagttggaagaaaaacataaaaccaatggcagttgatataaaaggaatcctccaggagatgggatgctctgacctcaagaggaaaagggagtggtcagctcacttcaggaaaccaagagggtttcacagagtagatagctgacgcttgagccgaggctctgaggcaagaaggatgggaccatgattcctttgtaatttttaaataatcagtttagcccagaaatagaatagaaggttaaagtaatgaacttggacaccaagtcataataataaacttggtgtccagtctggctttcacgtggcagctttgctattatctctccctcctaggctctgtggtccaggaggccttctacttctctccctttgcaagaagcatgggaaaggatgtgctaggtactcaagtccaaaggaggttcatctggtaaaagataaaggtctaaaacagcatattatatttggtgttgttccggtactttaacagtactaccattgttactttcatttccctaacagcttagcaattctcctaggtaacttttaaagtcaccgtgggaaggaagtaagaaaagggaggggagcatggtagaggagggaggtaatgtgtcaggatggagatggcaagtgtagcagggaccagataaagaaattgggtttgagaattttgtacatccccttgacatgactggggctgatctgaggttggaagtcattgcattttaaggtctctgcccttgaggacagttggcacatgcccctgaggggttccctgccaccctttatgaatttggcttggtatatcacggcattttctagactgctggggaggaattgtcatgatcaaatggactaatgcctaagagagcactttgaaaaatataaggtggtaaacaagagctaggtaatattagtattatttatatttccagaaagttcttcagggatttacctatgt

SEQ ID NO: 80269 - DNA, 1980 bp, Homo sapiens
cacataaatcttccagacaagagctgcagggcaagccataatttcagagagtaaaagagaaaatgaaagctatagctggtgtcttctctaagttacataggtagattcattttagttttctgattgtgcctctgaatataatgtaaaaggggctggtagcaagatctgttttaccacttatgtaaaaagctcctctacagagagcaaagcataaagtgagacttccaaaattgctttttatcaccagagccattggctaaatagttgaggacccacaagcaaacttctacattggcaatttcctttctagcatcatttttcacagtcataagtcatgttataagaattttctaattgctaatgatggtccttgtaaggaaatatatgataaatgttactataataataccaagacctaactggtacttgtggctgccttctatgaagtcattcttccccatttaaacacataagagtctgccttacatcagaatgagacgtaactatcccctgttagtgtggttttaaatcttgaatctaacagctaatgaaagaaaaaaaaaaatctatgcccagaaaagggaagaggttcatctatcaaaatgcaactagttctagagactgattaacaaagtgtgtgactggaacaattactgttctctcattgtcccaaagtactagttagacatagaaaacactcaacacacgcaaaatgtataagcaggaatgagggcttggacaagttagttataaacagcatttcatatgttgtgaggtgcaggcagtacatcagccctaacaatattattgcgttcctctgaactctgctctcacagctaagcatttggaaggcagacccagaataaagataggcattcacaaagccaacattttatattgaggacccttggttccacttttaatgtgctataaactaggggcttcactttttcatgaactgtgtgcaaaagcagaggcaatgactggaggttgactgtttggatctgttttatggttgctgtgcctatacagtaatgtgatcttgaaaaaggtaaacaacaaagagtttagcagtgaaaaatatgcctaatataaatacagccgagtacatggcagttcagaattttaaaaatatgactgtggcattaaattttctggtggaattaacagaggaacataatacagcctttatggcaatatatctgagacagaaaaaggagataatacatctaactctatggtctatgtggcattcatataaagaaaagcacagtagctttatttaattgagaaaatgaatcaattacaatgatgttgcatcatcaaattcttgtgaaatagaagatataagtcactgcattgtgtaactgttaaaaagtaattgagtatcttaagcattttgaatcaatttcaggtactggcactgttaccttaatacaaaatttatgaagatgatttcatataatatgttgctatcaaaactgtataataaaacctgataacgtctctctttaaaaacctgggcaaaacagtatagttataagattataaaaaaagactttgatattgctgtttttctctttcttttaatgaagagcaagcataaatagtacagttttaagttgacttagactaagcttttaacctgcaaaatagggcaaactagagactttaagacctcagttcatgaggaagtttcctcccctcagttaatctgattcacacaactcatatgtttctggggacagtgtttcataatccatttctgaattcatttcaaaacctctcacttagaatgtttgctgcatgttctcctcagagaatgttgtcatccccctgactcttggaaatttgtgaaacacattctctttgatgtcagaaatggatttctgattctttattcattacaaataactccgttgttgaagcagatatatcttactaggaatgtaggggtggggggagtatcagtgtgtgctt

SEQ ID NO: 80270 - DNA, 1391 bp, Homo sapiens
gcagctcttgagaaactcacagtctaggtgagaggaaccaacatgtcaaaatggataatttatcaacaataccataccaagtataaatgtatacaaatacagttgttttcaaataactctatgatcataggcaagtgtaatacagatgctggaaggaaaggagctctggaggagccccagcaccaccacaccctggcgctgaggcctcaggcccggacactgtcctctgataggcccagctttcccatcatagaataaagatgatcatccctgccaaactcagggtggttgtacagatcaaatgagtttgtatatgggaaagaattttttaaaacacctttaaaaacatataagggattattactagtttccctgtattttaccggctggttggagcccagttatctcagaaaacagttgacccatcagtatttggttcctgaaaagttctctgttagaaaatgtagtacctggagtttcattttcattgagtttataataactgtaagctttatttttcctggatggggaggcactgaagtgtttagtactttaatgactaagtggatgttttattaatttttatgtcacgttttagtagctttgtaagaaatgcagtttatcagtgttaaatgtgtgagcagcctgccttcagaatgttgatcagaaatgcgctcttactggactctgcatttattccctaaaaatcagtgtgaaacttccatgaatttgattttcccagagagcattgctgccctggaaacaggcagaaggaactttggaaaaggtggagttgttaccccactcctaagttaggtgcaaatacttcaactacataattaaagttttcctcacaaaataggggattgtgagcagacactggcaggaatccaaaattctaatttctgactatgatttaatttcaattttaaataaatcggtttttaatttaaaaagagtgagcttcgtaacattagcaatgattgcaacattaagcccagtgttcacaatctagcaatataaaacattatttatatctgaatcgtaaacagccttttgaaatggattatggtttttctccctattctaatacaacctggagggtactaaaaagtgttgtgtgaaattaacattctgctgactttcgcctataaatgagaagcgagctattaacatttgtgtattttcattatgtaaattgtgttaacacatgcccacaaattgccaccagcaatgcaataattttctctcagtgatcataatgtgtccaagtgagtcattttgattatgacatgctaattacatattgccttttttcagattcagaaaaaccagggatctttaatggtaagctttatgagttcagaaaaaaattcacttttctttttcct

SEQ ID NO: 80271 - DNA, 1603 bp, Homo sapiens
tttgaatgttttctgcatcaaatagatattttcattccttatttaaagtaacagttattgctgttcaatttaaaatatcttacttgtttaatttgggcaaaatcatgagacttttgaaattaccatggggagatgttctatttaagggatgaagattgatgaagaacaataatgtgtaacttaaatgatatatttttcttcatagcatttctttcttagtcaagagaaaaatgtaacttagacatatattcctgtttactctaaaaccatcttccttgtggaaacttgggaaatgaacattgcctttgctaaaaccaggttgatcttggaactgagctgatattctgcaataaaagtattaggaaaggattggccagatgacctgccttagacaagatgaatcatagcatctcggaaaggaaggattggtggggtcctgtacttactgcacttgtcctatgtgtctgtcagagttctcattgctgtgatgcagtgttcctcatagggtggaccaaggactgattgcatcagaattacctaaggctcttgttgtaatgcaaattcctgagcccagatcgctgaattagactttctagggatcgtgcctagaatctactagtttctcgggtaactctctgcacattataagtttgaaaaccacttctcaaacttccctaactgcttgccagggctaagtcttcccctttagttcccacagggcaattagctagctatcttcatttgcatctgacttttagaccttttatttgtgaatgaatatgcccagttgggatttgagccgttttactgcttgggagtgggatttaccccgttgtgaagtgggtatctgttgctagtatatactatttcctgttagagaaaagtcagatcaaaaattacttcccctgagggaagttcagacaagatgggtatatttggcgtcacatacaaaatagctatcgcaaagcccagtgtaacatattttcttattatgtggattcagcttaacctgttatggcctggcaaagagtgaagatgtagtaaaacaccactaaggtgggcaagagccagtcctggaatggccaaagatgaatgttagagccactctgggagtcaggaggtggaatcatggaacaaagccagagttagctaccagatgtccaaacagaagacaccaaaaactaaataggaataagaaccatgaccatgaaactcagaccacagatcaggacctgggagggtggccaaagtaacaggagaattgagctccaatcagaaatcttggtggtccaagtaaattttggtgggtggcatttctctgaattgtcgctggctagctcaggtataagtgacagcttgaagacatcatctggtgcctcagagttgcttctcaacagaacttcttaccttaaggtccttatgtaatcaggtcctccctaagtccctgaatacctgcgttgtaaagtgctttggttctttataagtgatgtgtgtctatgtgtacctgaagccttagccatctgatatctttggggaataagtcggcccctattgtctagataactgaaatttatgactgtaagctctgacagctatgagaaat

SEQ ID NO: 80272 - DNA, 1068 bp, Homo sapiens
gaaagaggacaataacgggttttacttttgtaaatgaaatcccttcggtatgagacaagtatgttttttgctgctctgcctaagccactgaaaagggagatgtatgtggatgttagtgtgtgagtatgtgtgtactgttcatgtaggcacatctaaaaactgctgtgcactatggctgatgaccaacaagagacctaaaataaaaagagaaaaaagatgctcattggctttggaaaggaagcaattataaatacagtttaaaagattaacctattttccatttctccactcacctattttcaagaaatgtaataaaacaccaagctctttaccatatgtttacaacatttctaagtaaatataagtcttttaaatgacagacaaaaaaaaaaaaaaaaacaagcagactaaatgaagaatccattttgacattaatgacaaagatcatttctattctcttttatcccaatactgaagaacttccaaaacacttttaggagaaaaagaaaataggaaaaaaaatctctataatctcaaacttcagttacccagagacagattcctttagacctgtttgtttatattttgttttttataagccatctggtagtgatgttcacttggctaacagctggttctccttgattaaagggtttatgggtaggatgggcctttcagtggcaaaaattcaggcctttaccccgtggttccaggcccatctgagacaagttaaatgagctgctactgtcagcccagacccagtggacagaacgtcacaccaaaatgcccacacatgtaatttgtcacgcctggcagcccagagcatggggtgagccagtgtggaaattgaatcatctttcactttctctgctcaagacttgatgtggagtaggatgagtaaaaggcgggctttctgttctgcagctgagcggagttagaggctttcttctctggtatgtcatctgccagccttcctaagttcaaagcctcgctttcaccctgatgttttcccttgtaacacaccgagaagtaggtcagttctatctgcatcatgaaatcaaaaataaa

SEQ ID NO: 80273 - DNA, 1037 bp, Homo sapiens
tcccagcactttgggaggctgaagccagtggatcacgaggtcaagagatggggatcattctggccaacatggtgaaaccccgtttctattaaaaattcaaaaattagctgggtgtggtggcgcacgcctgtagtcccagctactcgggaggctaaggcaggagaatcacttgaacccagaaggcagaggttgcagtgagccaagatcgtgccactgcactccagcctggtgacagagcgagactccatctaataaaatttttttaaaaagtatagtacaatatctatactgtagatagaaaattgtcatagatacaagacacaaaccactgatcttattcagattttaccagttttacatgcacttgtatgggggcggggagttgcagggtggagggtagattaatgacacagattattctaaagccaagatacattatagtttcaaaaaaagaatattccttgaatattaaaagcatttttctcattgatgctttctgtctttggagtgtccagcttacctgcctgctctcaaggtcactaaacgtatttattggcacacttactctgtaagtgaactagtagcagctgtggttggaattggacctcttcctgccttgtctcctccaccagctctttgagtgtgcaggtacagacacacacacacattttctgctacttgcctttttttatgcctgagtaccttgctgacaagtgctaataacaaaatacccagagagagtccagttgaagttaacatacattaagcattctgaacttgtccttttgctcatagattgtgcataattaataattaaacagtttcagttgtaatgggttgaccttcttgaaccgttcattattcacaaggcaaaggcatcactcaaactttttcctattgtccttcactgttctctagcatgctgcgtgcttgtgttccagttgtttagcaaaaggggctgaccaggtagttactgaaacctctgaggcttggaaactgtcctcctcgatgaccagaattgcctactaaaatggttt

SEQ ID NO: 80274 - DNA, 1048 bp, Homo sapiens
agggggcttttagctgttaggttgtttttttttttttaacttacagaagatggaggttatgaaagtgtttgtaaactatgaagtgcgagacatacatggggcacgaggtcattcagcctctttgggtcatgattttctcatctgtctgatgttcctgggtatttccagcttgttgcctcttggaagatacatgtgtttagggaagtttaatgtgacttagaataaattatatgtatgtcggatgtttgcaattggtgtacactgaattggtagtctcttggggtggtctctgtggttgaaaatccaaacaagatgaagcacattcctccccactcactggaagccataacttttcatgtctgtcctttattattggtaaaatgtaatgagcatcttgttggagggaattattgtaaaccagttaatcaacaagtatttgttgtccaggtctgtgaggtgccatgatgggttcagaaagaatataagaaagacctatgtctcaggagcagactagacatgcccattggcaacatttagagaaggtagatgagtgccaagctgctggcttgggtggtgcgggagctcggaacagtggccgaggggccgtagtagtcagtgaggatgcctggctcgggcctgagtacagaacttggaaagtggtggtacaacagaaagccagcttctcccctccctctcccttcctctcctagctgtccatcctgcaacatgttactgaacgctctccacctctagttgcttatctacaaaaatagagtatcgcaaagcatgaaatttaagtgagataaaaatgttagacacttagcacagtgtctggcataaaataagtgttcaataaatggtaaccatttttatcgtcattgtcatcatcatcactgctaataacaagagggaagacattccagggagagaaaatggcacaggctgagaccggagggaacaaggacagtgaagaacccaccctagccaaagcaaaaaagacccttggaaatgatggggtaaagttagctgcatggggccagtgtgatct

SEQ ID NO: 80275 - DNA, 1090 bp, Homo sapiens
ttgggagctgacatccagtgcaaatcccagctctaccttggccaaatccacaaattgagggaagtaacagtaatgccatccagctgctttatggggttgttgtgacactgaaataagataatgagcttgaaagccggttgtagaatgaaaaccactactcaaatgctggtatcagtaaatataagcatttctctctccaaatcaacatattcaaactgggttgtctttaaataaatatccttacagcaaaggcagtaggagcagctattaggaagattcactgatctgttcccctcaccaccagggagaatgtcatggctgcaacaaagacttaaaatagcacaaagcatataaaagtcagggcaattcttacctcctacctcttcataacgacagagcaccaggcagaggaggggcagggccaggtctctgctcacctgcattggtgagaagagagccaatacctgctcaatgtggacagtattgcttagaacagtggtgggaggtcaggtttgcaaaaggaggttaagatcaaaggaactgtgttgaagggttgagttggtctggtggaaagaaaaaaactaggacgttgctaagaccctcctgcaaaagactggaccttctggctctaggcaaagtccccttaattgttatgagaagagtatttaaatttcaaggataattagtttttctcttaaggggtatagggttagactaaaccttttatttttagatgtgaggtctttgaaacacttggatacacctctcaggggttaaatctgtctttggggctaccaggacttgaaaaatgttgctctgtatcaagaaaaccagaagtgacaagttcatttaaaaagcctggtttgtcattgtttatctaattttcggggttgacacagaaaattaaaccagctgacactcactctctgaccgtctctctggctcatttccctggtcctttcctacctgaccttgcaactacaaaatgctccagaccctaaaatataaaacttcccactgagtttctgagtcaccctgcagtcattccaagattatgtcattggatgtcatccctaatggtattaaaaat

SEQ ID NO: 80276 - DNA, 1814 bp, Homo sapiens
tctttatcccctgtaggaattgtgcaagctgcaacacttcaagatattgccaataaaaattagattgtgagtcatacatatcaaaatgaattctctatgcacatttgtttatgaaaggtttaatttttcattaggggagtacccataaatgtcatttttaagaatgtggagggtattttgtcatctttaggaacttagaagcaggagggtgtgatggccagatgatcttggtagttaataagctgacagcttcatgaaactcctcttaaagtaatttaaaaaaaaatatgtgtttttttggagtaaaactcaaaccaagttatagtgccattttaatttacaggaagaagagtgggagagaagaagtccatcagcattttagtggagtaaataatgaaattaaatgggaagagaaaccataattataaaagttactatgagtgtgtcagtgaattctattgttattttctgcctctttattttcaagaaatagctacttaattttgatccttacgctgtaatttgtctgcttttatttcagatagagtcaagtacatctgatagtttattcatggatttgatttgaatctctataacttgcttttgtcaagtgccacatttagatggcttttgttttatgtcattatttttatcaacagtattttaaaaactctacagtatagtttataaaatactacgtatagtttctaagtatttcatatgattgttttgaaatacctccttcttttcatccaccgttttctcctgggcgatcccattgtctttttcttcaaagagtttcttgtaatccctgttgattgcggtagtgcttagtggcgagtccatagctgattaaccttgggtgtctcctggtgaactccatcagcatgctgctccagggttcttgctgaggcttttgagtttagtgtaatttgtacccttttttgctggtaaccagggataagaaaataaaatggccaatggttgtagcgggaactgggaaaaagtatccaagtctcagaaaaactgggtgtttatgatgagatgtagcctttcaaaacaacaaccaaaaacggattcattacttcatagaattgattgtggtgttttctgaagtgtttgactctggcatgaagcatcttgcttttttaatgtttgaataataatatcttacttatatagtactttgcagttcataatatattgcattatctcttttgatctttccaacagttctttgaggtaggaaaggcaagtaataactaaatcctttttatagatagagaaagtgagcccagaaagggtacgtgactattgcaaggtcatacaaataaaagtggcagggacttgagcctaggtcttgtgtagtcctccttaaaggtcctacagcagacctggagtcctctagggtgcccagttcacagatttctacttatgttgttgctgatactttcccttttggaaaagctctatgctagggtatttttggatattctagggcattttgcaagcttccttgcaaaaagtttggagtttgttagttggaatcatacacattaatttttgtaagtatcattttgcttgagaaaatttcagagaatctgagaagtaagcagaaaaataaacagtacctgtaatcccaacactcagagatatcatggttaacatctgggtatttatccacttaagactttctctctgtgagcatatgtatatgtatattcatcataaaaagatacaacactgttttttatttataatctgctattttcatgtctatccaggttagtaaatacaggtctatatgatcattt

SEQ ID NO: 80277 - DNA, 1392 bp, Homo sapiens
ctttgaaaacttgatcttttttaaaatttaaaatttacagtacagcagtgcctaatttaaaatgggacgatccctttcaccttcccactcatggtattttttataacttaaaaggaaaaataaggctgggggcagtggctcacacctgtaattccagtgctttgggggagacctaggcaggcagagtgcttaagctcaggggttccagaccagcctggacaacatggcaaaaccacatctctaccaaaaatacaaaaaattagctgggcatgttgatgcgcacctgtggttccagctgcttgggaggctgaagtggtaggattttttgatcctgggagacagaggtagcagtgaactgagatccactgcactccaactgggtgacagagtgagaccctgtctcgagaaaaaaaaaaaaaaagaaaaaatttatttctagtgatctcttacaaggcagtttgctaagcagagttatttaattaaatcctgcatctctgtaagtaatgctaaacggtagtagcttgcattgcactgaacgaatgtgcttgaagtactttttttttttttttttttttggagacagggtctccctctcttgcccaggctggagtgcagtggtatgatcatggctcactgcagcttcgaactcctgggctcaaatgatccttccacctcagcctcctgagtagctaggacttcaggtgcttgccaccatgctcagctgactaaaagcttttttttttttttttttttttttttttggagatagggtcttgctgtgttgcccaggctgctctcagactcatgtgatcctcatgcctcagcctcctaaaagtgttggaattcaaggtgttgagccactgcacctggcttgaagtacttgtaatcagtaatggtgtgggaaatatataacttaattttttcaaggttatgttttttcttttttcttttttttgagacagagtctcgctctgttgcccaggttggagtgcagtgacatgatctcggctcaccacaacctccgcctcctggattcaagcaattcttctgcttcagcctcccgagtaggatgcgcaccactgtgcccagctaatatttgtgtttttagtagagatgggctttcaccatgttggccaggctggtcttgaactgctgacctcagatcatccacctgcctcagcctcccaaagtgctgggattacaggtgtgagccaccatgcctggcctgattgctttttctgtagtaaaatataagaatcatatgaataaatgaaaaattccctaacttaatattagccaagaacttcctctccagcagagcttagctcttaccaaatatatatgattgatttgcattctacctattttgtttttttcctttcccttttgtgg

SEQ ID NO: 80278 - DNA, 1050 bp, Homo sapiens
tacagaatgtaagtaacacttgataatagctattgatatcctgcctacatctggtgtttgagatggactgtttgttgtttcatatatacttataattcttccccaagaaaacaaaatattcttgagagcacatcattacgttttgccatctacatagcactcgacattctcctggagactcagtaagtgcttgataaatacctgacagtttcatcaaaacagtggaataaagtgaggtgtggttttccctggtgtatactttatcctatatttcttataaccaagggtagaagtcaatgaatttatgaatattaattttaaatttctttggttacttaacgttaaatgattaaatttgaagtttgaaataataggattataagtgagctggcctttatttgcttaagtaaaccataagaagggggttataataaagtgtcatttaatagtgtaaattatattattggaatactaatgttttacattttgttttttctctaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctaggtaagattattgtatgatagtatttggttacttttgcaggatgaattttcgttttaggcttttactttgacccagtttattattcataatgaaattttcattt

SEQ ID NO: 80279 - DNA, 1054 bp, Homo sapiens
aataaaactcaactgttgtgacctctgatgcctttggtataatatatttaaaatatcagacttctaaatgctggtttgttggcatactacggctggcaagctaagtccagtctgtggcctgtttttatgtggttctgagctaagaaatctgaaaaatattcccaaagagttattaacaaaaaaggaaagaaacaaaaacaaagaatgtgtaacggagaccatgtgtgcctgtaaagcacaaaatatttacccgtatagtaaaagcttgtgaatccctgttacagatcattgaacatttcagtttgggggactggcaagtgttgagaacattttttgcgaatttttgagaacattttgaaaatgtttactgaaattctatctttgaaatatgaagtgtttgtttttaattatatttagcagaaattatctgaatacacgaagattataggagtcattttcaaacaacgtgagttttgtatcacattattttattttttaagtggccataataagaaaacattttttgagaatctactgtatgcttataaaactgacacatgctcattgtaaaaaatggaattgccaaagttccttccttgttagctgtttagtgtgtatgcatatatagtataagcaaattgtttcttgttttttacagaaggaatcatatacatagtattgtataacttcccttttttccccttaataatatatcatatgcatcttttcttgtctgtctgattatgtgtgtgtatatatatatatatatatatatatcccattttaaattaaaggccatatctgtatctatccatatctctgtatatggtctgtgtacatgtatgtatgtgtacatatgtgttatgtattgatcagttgatgaaaacgttgtgaccaggggcttgcaggaacctaaccctatacttcccctggtagcagtgattatatattcgcaaattcagtgtttgtggtgattttatgaacataaatgtcacaaatagcaataattgactatatttgaagtatgatttgaatgccagttttcatgaataaa

SEQ ID NO: 80280 - DNA, 1004 bp, Homo sapiens
tactctcgtcactcaggctgggtgactatatatgtatatatatttcttttttttttttttactcttcaaagttccttgagctttttattttgaaatttggtggttgggctttttacccttttttatagacttaagaaatttagcactttgtgatataagttgtgactactttttccattgtgattgtcttttgagttttttttatgattggtgttgcacattagccatcagttcttttttattgctaagtaatgattcatggtatggatatatcacaatttctctaactattcgaattatttaagagcattttggttgtttacagtttctggctatcataaataatgttatcctgagtattcatgtacaggtgcttgtatggacataagttttcttttctccaaatacatgcccaggaatggaattgctgggtcatatgtgtaagtatatgggtttttgggggttttttttttgggagaaaataccaagttgtcttcctgagtggctgtaccactttctgtttcttctggtattgtatgagaggtccagtttttctctgtctttgccagcatatttgttattgtcactttttttatttttagatgtttaagtatgtatgtagcgataactcattttggttttaatttacattttcctaatgactaatgatgttgaacatctttccacatacttatttgccatctgtcgacatacttatactctttggtgaaatgtctgtgcatatttttctcattctttaattgaattacttgtttttatattattgacttttgagagttcctttgcatattgtagatactagttttagtcagagatgtagtttgcaaatgttttcttccagtctgtagcttgtatttcttcgggaaaaaaaaaaaaaaaacaccttttgatcttgaaataattacagatttgtaggaagttgagaaatgtataggaacatcctgtgtactcttaacctagccttctccattgttaacatcttt

SEQ ID NO: 80281 - DNA, 2432 bp, Homo sapiens
ctatttacatatacttattaatagggtgaaaagtccagtttttatagttttcccttttggttgtttttaaatttaccatcttttaaatttatctatttaacaataatactaatgaagtcatcctttaataaaggaaattaaacttgtcctttattgtttaggttttgtttatcagaaaccagttgtccacaagaagatcacttcccacccaatctttgtgtgaaagtgaatacaaaaccttgcagccttccagtaagtcctaagagctgttttttaaaattcattgccaacataactatcaaataagtcatcacaactgttgttaaatcatagtttttccttaagaaaacatttttattttggatatatattcattgactgggtgaaacacttgtaccaactatgtacagttagcagcagtgacattagctttggggacataggatttggagttgggtatggtagctttagtgttgtactggattttggggcgaagttttttcaacaaaatctcagctgtgttcatgtgagtctataagcctatggtagaatggagatttgaagaatgctatgtcttaaacaggaggtaagggtgaggactgtttttggtgcccttgaaatactactactcatgtacctatctaagcttgttatgaattcatcctgatttttaaatttaagagattttgaattttcatcactaatagttttctcaggtttactataaggagagtataaggttgtttggaaaaataataacacaagaaacttgtaaatgtttgcttctctactttttaatgaaaacattcatattttctagtatgcagtttgtagggggttttttcttaaggaatggaagtcaaaatgattgtggaaataataagtataaataaattacatttcatttttagggttaccttccacctacaaaaaatggcgtggaaccaaagcgacccagccgaccaattaatatcacctcacttgtccgactgtccacaacagtaccaaacacgattgttgtttcttggactgcagaaattggaagagtaagtaaatttttgtttctaccagatttttgtattataaggaggggttaatcaccatgcctatctgaatttatatgtaaattatgtaaaatgagctgcaaaaggatttatttttgtctcacaatgaattttcaacatgtttccatttgaaaaatgggattatgaagtatccagtgttttataacctggcccttttactccacaattgatcataaatgtcctcctgtatcatcacatgttcttctgcattattttaagtgatgatatcatattccaatatgagtatgccataaatttgcctgttccctactattgagcgtgttacttgatttattgattgattcattggtatgtcaaagaacattttgaagaccatcttagtagctataactttgcatgcatatgataatttccttagggtaaattctcagaagtgggattgctgagtcaaagagcctacagaattttaagaaattttgtgtacattgacagattaccttctccaaaggtgttgtacaaatttattctctgactttcagtgttatttgcgtgctcgttaacactattatcttctttgaaatttttaccaattctgttaggtaaataatgccaccactgtgttttaattagtacttttttcattattactgagattgaatatgttttatatttgtgattacattttaaaactgtatccgtgtctgtttctctattgctgtttttgttattgattatgagatcttcatatagtaaaacttaactctgtttcatgttacaaatatttgtttccagtttgttggccttttatttttatgttatttaatatgcagaatattattaatattatttatattggctacacaaagttttcgtatagccaaaacttaaccagttatttcctttatatagtcttttctcgtctccatcatgctttgcctatctgcccttcccaagctatggaattatttgtttattttcttctagacttccaaggtttcatattttacctttaaatatttagttcatattaaatatatgtgtgatgtgaggtaaaaattgctttctttcactttttaaatagctggttctaacactgttaactaaataaatgttgattctgaagccaccattgttatatatttaacttttacatatcctgagtgtgtttctgatctttttctatgttgtttcttagtctaacattcttttttgggacaattttcatgatatgaactcatatgtatccaccagttcatttgaaatttattgaatgcttaccatgtgtcatctactatactcaaaactggcagtaccatagggagggaaaaaagttcattttcatgaggcctgtgatgtaggggcctggtggacacatacaaagaatgt

SEQ ID NO: 80282 - DNA, 1555 bp, Homo sapiens
ctagaggggtaagataggactaaaccattcagggcattgtaggtaatgttaaagttaaggattttctttttctttttctttttttgagacagagtctcactcttggccaggctggagtacagtggcacaatctcggctcattgtaacctccatcccctgggttcaagcgattctcctgccacagcctcccgagtagctgggattacaggcacctgccactgcacctggctaatttttgtatttttagtagagatggggtttcaccatcttggccaggctggtcttgaactcctgaccttgtgatccacctgccgtggcctccccaagtgtgggattacaggcatgagccactgtgcctggccaggattttctctttttaagcagaaagtttatagtgctgtatttctttttagaaaagatcactccttggagtggtaaatagtttaaatggaggccagaatcgtgcagaaggacatctcttaggagccagctcttgtggaagtattagtgaaatggtatctttgtctagagtggtggcgatagaaatggaggtaagtaggggcatctgcaggattgagtgatgaattgaaagtcgagggctaagagaaagggagatgtgactgatgagtccttggtttctgggtggggggctaggcaaatgatattgctgctgagatagaggaaacactggaaaaggactgagtgtgggtgtgttttgttttgtttttgttttgttttgttttactttgaagaatgggcattggaggacaagatggagaaaattatgaatttacttttgaaacttttgagtttgaaatgcctgtgagacatcctgaataggcagtggggcagataggcttaaaggatacatttgggctagagggaaaaaatgtgtgagtcatctgcatattggtggttattggaaccacactggcagggctgacattgattctcctgcattactttttttttttttttttttaaacattctttcttccagataaagtagaattactttatcatatttcttttcctcgctcctgtaccccatttgcacatctttctgagaatttggatgagatttctttaaagttatagattaagttagggagaatttatttacaatatttaatataaccattctaggaactgtattttcaaatcttcttttatgttcctcagcaatttaatgggtttcctacaattcctgcatattttttgctaattcccatgttggttgttattattactgctattataaaaagagatctttttttctgttatattttcaaagtatttattgttggtttacttaaaaactagttatttttaatatttatttcatagctaaattcatatattggttctattagctttttagatgatttattggtatttctatgttgacagttttgagttttaggtatgtcatataaattatattaccctaatacttttgtcatttatttcttgttctactacctagaactttgtaaacagcgttaaacaatgcaggcactagtggacatatttgacttgctccttatgttaatga

SEQ ID NO: 80283 - DNA, 1039 bp, Homo sapiens
aataagtacttctagcaaagttttagtagtcaagccagacactcttatgttcttgaaagaataaagttggtattatttagacttttcacagagaactccattctctgaatcatttgatttagtaggattttgtcttgcagtttctgcctttgtgtagagttgtcccctcacaactatgaaaaacagtcttttaccaactcttaatcaagtttctttctcctcttccttctcccttcagcagttatttcaagccttagccataatctaatcaaacactatccccctctctcagcactctgccaatgcatgaaaattggggctacaagacatgaattacctaaaccacccatttcttccttaatctcagtgccaccataattacttttttagcttatctacatttgtgcccagtcctcgctttattttgttcagtgtcaagaggaaatctccctttccctgcttattcatttattcttttcattcaagaaattgtgttaagagtctactgtgttccaggaacaggagaatataacattaaacaagacacataccatctctgcatcccccagaagtttgcagtctggtaagaaagacaggcattaaataattgcacaagtcattaatgagttaaagttttgacatgtgccttgaagaagatagacagggaactctgtagaggtacaataggggaacgtagtcctctctgatactgtgatacttaaggcaagattataagtatgaggagaagttaagctccaagatgggaacagagtatgccaggagaaaaggccagtgcagctggaatagagagagccaagaagggctgggtgcagtggctcacccttgtaatcccagcacattggaaggccgaggcgggtagatcacttgagtgaggtcaggagttcagaccagcctgaccaacatggtgaaaccctgtctctactaaaaatacaaaaaaattatcctggcatggtggcatgtgcctgtagtcccagctactcggaaggctgaggcacgagaatcgcttgaacccgggagg

SEQ ID NO: 80284 - DNA, 1004 bp, Homo sapiens
gtcacaaatgatgatctgattgctaaatttaaagtgtatattttcagttttcatcctgaatacttctgctgcatttgatatgaaccactttctccttgaaattctctcctttcttctctgaccatatcttctcaatcacctgccttcaatggattctcttaagggaagcattctaaatgtggctgttcttggagttttatcttgggtgcacttttctacgcacccttatggtttaaaactaacacccaccccaaaatacatgtcttcatctcagacctctcccctgcgtttcagacttatatagctaactaccttcacctaagcatttcactggttcctcaaattcaagtatttaaaactgaactcaccaactcctgtcaaacttactccctaaatatttctcaaatgtgccttctgtctatcatgctatcattgcccttgtttaagctctcatatcctgcttttattttaaaaaccattcttagataaaacatccctctccttgacgcctttttctatctcctctggtagcctcctaagtgatttatacagatctaaaatcttaccattctcattcccttgcatttcatggcttcttaacaccaagggaataaaaactccaagtatgttagcatgacacacaaactttccatcatgtggcacctgcttattactttccagggtcgcctgtattcactctgctttttaaactttccatgacgtggcacctgcttattactttccagggtcgcctgtatttactcttcttttcatacttcacattccattccaaaaatatggaactctttagtctttcttcagtgctttagttttgtgctctatgcctcaaaactcccctgctgccttctctgcctaatgtcattatcctttgtttcacttttttccaggagacatcccagaacccccaaaattgatgagttgacttttggttagcttcctgaacatactccatcagagtgcattagagatgatctcactgaaca

SEQ ID NO: 80285 - DNA, 1007 bp, Homo sapiens
gcagtgctcctgcttcaaccccccaagtagctgggactaccggcatgtgccaccacacccggctgatttttgcatttttttgtagagacaaggtcttgatatgttgcccaggctggtcatggactcctggcctcaagcaatcctcctgccttggcctcccttgggattacaggcgtgagccaccacacctggccagcagttcattttaaattgacatctgctttaaaaattcagattataaaacaaaacaactatatatgtatattgtgtgtgtgtgtgtgtgtgtgtatgtgtaaaatgtataattataatactttcatgggtttctatttggctaaagggataatcccttacagttattctgaaatagtaagatcatgtattttaggtatgtttttactcaaaaataaaatttaataatacctatatatcaaatttatgggataataaaagagatttgtgctctttgaaatatgtaaatatgatgtctcactgtgcattacagttgcccttgtgatgtacagagctcaaaataaatgagtttcttttgtttctgtgccatttagctaaaggcaacaaaaataattaaaaatgtttttactctttgggaattttatggttctgatttattaaaaatagaggtggaggaatctttgaaaagctgctttgtaaacccaaatacaaataacgtggaattgatagaagaaaagaagataaactctggaaatgtatttatgaaatatttattattgtgaaaaaaacttgtgaaattattctttttgttttgttttgtttttgagacagagttttgctctgtcacccaggctggagtacagtggccagatcttggctcactgcaacctccacctcccaggttcaagcaattcctctgcttcagcctcccaagtagctagaactacaggtgcacgccaccacgcctggctaattttttgtatttttagtagagatggggtttcaccatgttggccaggctggtctcaaactcc

SEQ ID NO: 80286 - DNA, 1039 bp, Homo sapiens
taatcccagctacttgggaggctgagacaggagaattgcttgtgagactgtttctcaaaaaatacaaagattaaaattgagtagaaatgcagtaagggagtctaatgaagctgtttaatactttgtgagcccagagtaaaagaatgactactaagctgaggtttgggtgggtctcctagtgtacaaagtgatttttaaagcaaatatgtttctgtactttaattaatactactgttatttattgaaaagttactatgtgtcaggtactgtgtagtaaacgtaattgaatccccacaatcatattgtgtagatcccatttttatccccattttacaaaactgagcctctgagtgattaagtaaaataacattcagaattcacacagtaggtaggtagtggggccaggattcattctaacaccagaactcatactcaggctgcactataaatgactgagtatgacctgcataccttccatgagtggtgcctcctggaattgcccatcatgcagaactgaagccttatcagtgcacaggactgtcttactgctgtatatttccaagtatgggaacaaggaaattagtccaacctgtttctagtaggaggagacacacataaataaataacaatcagttttgcatgccttaatgatagggataccttttgagaaatgcactattaggggattttgttgttattcaacaaaagcatcataggtgtgcttacacaaacctagatggtatagcttactatgtaccttggcctattgctcctagtttgcaaaactgtacagcatgttacaaaactgaatactgtaggcagttgtaacacaatgctaagtatttgtgtacctaaacatagaaaaggtacagtaaaaagtataaaagatgaaaaatggtacacctgtatggggcacttactatgaatggagcttacgggactggaagttactccaaataagtcagtgagtggtgagcaaatgtgaaggtctaggacatcactttacatcactgtagactttataaacactgtacacttt

SEQ ID NO: 80287 - DNA, 1763 bp, Homo sapiens
catgaaggtatcacccagaggtaactactgtctatatactactcacacagaattttatttttgaaatgaagctttcttttgttgacgttttctcactttttgtgaacattttcccatatgattaaaaatctttgaaaatgtcatttttcatggtcacatgatattttcttacataaatgtgacataaattaggcagctatattcctagttagtactagattttaagaataaatataacttaagttgttcaacctttatgttcatttaaaatatattctaaggatgaattgttttcttatagcttgtttatggaaatcctaaagtactgtacagactgtgatgaaatacaatttaaggaggatggcacttgggcaccgatgagatcaaaaaaggaagtacaggaagtttctgcctcttacaatggagtcgatggtgagtagttcttcacaaggaagaggcagtctccctactgctctaagtctggttttcaatattaaaatccatatatttttaaaaatcactgagcagtttgtggatagcttaataattcctattaacttattgattaaatgttcagaagtaatagaactccttttaaattcacttttttgccagctttaaaaaatttactgatataagatttcaaagtaatgtaatataattagtcatttgtaaactcatacttttgaaactgtaccctttttaaatttttaacagatttgatacagagtagtaaaggttcttttttcatttatttattttttcctggcttttagtatgtttttgctgtaaagacactatgagttttgaaaatgctatcatcgtatttaagtatgtcagatactatacagacaaaaattaatataccgtctgctctcaaattacttttcttctgaagtggacatatgacacattttgattgtttgctctaattcagtaatttattattttgaaaaataatttactattattaaataatagttttaaacttagaagaacagagccactgttggttttctactctctggctccaacaatattgtgaatctaaactgtaactgataaactgtagtgacactgagaaaagagagatgtcatagctcttcccttgccttgtattttaatcattcccatataggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaagggtaagtgctgagacatttaaaaaaaaaagtaatcatgaaaattaacttggcaaatagggattaaagacttgccaaataaaatgattcttgattgtgaaacttaacttagcaatcaaagaatagtttgaatttttcccaggtttgtaatactctggagggattggggtaatgcaccaaaagggtacttggatatagtattcttcatatcaaaagatcattctagtaccgtggttctcaaactgtggtgtacgtacatcagaattacctgagagcttaataaaatgcatacattgcgcccccatgtctgagtcaggagtagagactaagaaaatttgtctttctaggccaggcgtcatgtctcatacctgtaatcctaggactttgggaggctgaggcaggtggattgtccaagctcaggagtttgagaccagcctgggcaacatg

SEQ ID NO: 80288 - DNA, 1055 bp, Homo sapiens
agatcaatgctccagtccttacataaggccatttgattttgcaaaatgtcttagtaaatatttcagaaaccctagatactcaggctatcttaaatttagggctgtgtcccgctgaggagaaaatatattaatttggaagtataattaacatttttgtgtcttttgtttcccctccctagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgg

SEQ ID NO: 80289 - DNA, 1051 bp, Homo sapiens
actattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtc

SEQ ID NO: 80290 - DNA, 1048 bp, Homo sapiens
ttttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttcagttaatttgtcttctgtaaaataacactgctggatgttcaaggggacaatccctatgagacaagtgataatggtttgtgcttccaaagcacctttcatccagagatttcaaagcatgacaagtaactaactaattttcttgcagcatgctttgaggtaagtaatgaatatagccatcatttccctttcttgttgaaatatggctaactctttaataaatcacagcatctgtttagtatctgcagtttgaatgctaagagcaccgtggccttcttgtaaacaacactaggtgctagagaaaccagctggaatttcaggaatgagcttgaaaccaggaccaggagtaaggtaacagcccttcctcgggtagaggtttgaatcaaacacttaataggatcttagactctggaccactgaatcccttaatgagcagggagtccgtgaagaggagccccaggttctaatgaccattccacaccaactgtgtgtttttggcaagtta

SEQ ID NO: 80291 - DNA, 1428 bp, Homo sapiens
cgcttcctgctggttcttaccccggcatcctgccgcgggggtggctgccgtcgtaatggcaattgtttgttgctttctcctctagtcagtttttgttgtgtggaagtataaacttaatgtgaccagagaagccagaaatatacatttgtaggtattctgttatttaaatattggcaacaaactcaacatttaaaaaacagtaactataccagctaaatcaatatgctgcccatgggctgtggcttagagcggcatagttctctgagccctggcaccagaggactcttctgcctgcctggagggcagcctggctctcgcacacaggaagggatgccaggcaggacggggttgccacggcagctgcctcactcacccctggcctttccaggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctcta

SEQ ID NO: 80292 - DNA, 1028 bp, Homo sapiens
ccaactaccggctagccctgtcactggctcagggacacactgagcaaggctgtctgggctgcgggtctccatgtgttgagtctcatcccctgtaaaggcactgtgagctcaacctccagtgaagttgtccccgaggttgcccgggagacccagctgctgtcccaggctccaggccccggcttccagccagcatccccccagcatcgccacccccgcccagccctcagtgcccgctgtggccagcagagggcagcgagtggctttggtccttcctcgccaagcctgagccctgagggtgggggaggaggacgcgtccctgataaacaacccccagatggtgatggcagggggtgggggcacagccagggacccccacccgtgtcgggcctgctctttgggagtggaggaagctgcggggagccagctggatcaggctggggaggggcgtgctgtttgcgctcccccctcttcagaactcccagaggggcaccttttcctacctaccccgtccctcagtcgggggagacctcagaaatgtggtctcagcctcaggagatcccgggcccaggctgggaggcttcatctgttccaccctcccatcttacccaggagaaactgaggccagagggaggagggctccgaaggctgcagctgggaggtgagggccagccctggacccggctcactcctgagttggtgctcacagcacacgcaccctgcacgggcatttccagggtgtttcgggccctgcgatgtcaatcctcctggctcagctggtccagggtccctggacaggcctcctgccatctttccctggcctttgccagagcctcttcccacagaaggttggggaagggtggaggggctaggaacagagagctggagccccagcaggaagggggtgtgggtgagaagaggcaggcgggtatactggtgaaagcacaggtgggagaaagggagccggtgtgtggagaggggagagggtagtattttggggtgaggtgtctgaggtgggggtggggctgtgt

SEQ ID NO: 80293 - DNA, 1050 bp, Homo sapiens
tgctgggaccactcagaaatcagaaggtgccttcagcaggctgggccagccacccagggacacagccagggacagtgggagggctgggcctgagcctggactcctgcactgaaggctgggctgtcccctccagcctacagctcatgtgtgactttgggaaaggagttgggccctctggtctttttgctccctgggtaaagtcagcggggggtgctgctccacattccctccggggttcataggggtcacgggaggatctggaggctgggctggcctgctaaagggaccagccactttttggagtgacattccagctggaagcgtccatcccaccccaggtgtgaggggggaagcagagggtgtcacatactgtgacagaggtggggtcatgctgccaaccccactctgaaccccagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctgtaagccctaggagcacagtctgtcctgggaggctgaagaaatggcccccacccctcgccgcacctgtcctttcaccaaaggcattctgctaggtgagggcactgtcgcctgccccaagctaggatgctcaagtgttcttaggaagtggtgcacagactgcctcccacctgggcccctgtaacagaaggcgaggccccgggtagggaataaggcagtgggggaggcctgggactgggagaagggtggtcagaggggatgcttggggccccagcacctccctggactgacatcgacatcccccgactctgccctgcccgttcctccctcagatcgactcctttgagctgctctactattatgatgagtacctgggtcactgcatgtggtgagtgatgggcccatctgtctatcccagggg

SEQ ID NO: 80294 - DNA, 1940 bp, Homo sapiens
ggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccagggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggccatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtaggtacatcccaagccagcctctctccgacgcgcgcggactcgttaattcacgggccctcccctccctcaccctctcttaccctctcttcatgtaggtactcacttctcccctttttgtaccacctcctgccccactaatgcccacttcatcttccagggctaataatccatcccatgttttgctgcccgtcctcatcagcccctacccctcattccctctgtgggaagataaccacaccctcggccttgaaatctaatagtcgtcttctctactagatagtctgtgaacaagccatttggaggaggtggctgcctttccaggttttacttttagtggaactggtgatgtaactgatcagaaattaaggaggtcagcggttaacattgaagaactccgaaagagttatttgggcatccatttttactcccttcaagtgagtggttccgtaaaaccttcagtgggctgctgggctttaatgtcaaaataagcacctagaaccagcagcagctgcagcatcatgagggattgtcacgcagccagacatctcaagacatgattctgattcctccacgttgctcggtgtagatatattggctactaagatggcattggacctgatgtgggagatgatgccattcttaaattacatcttatcccgtgatgttgtggggaagcttgatcatttactgttagttgaggtgggaagtttaaaaatgcacattgttatgcctaagatttgccctttgagtttaattgtacgaatttttgggtatttgaccagaattgtcaggtttgacattatcctcttttctatgctggaggattataacacgttttacagattacaactgtataacgattttgctacatatgttttggttgacttgtggtagtacataagctattttagcattttttttttcttttgaagtcagtagggtctgagcataaaaatatatatctttagtttttggtgattagaaactgcctggctaaaactcgactgaaaaaaacatttcttctttaagatgactagggaaatgttctgtttcggttgattcttttttaggtttaaacaataaaagctttttcttctattttaga

SEQ ID NO: 80295 - DNA, 1044 bp, Homo sapiens
tatcaccattatacacattaaggagatgttttttttcatgttgaccaaagatggcaacctgattcatgtttgcttttccttactggctttcgtgtcttctctgtaactccttgcattcccgcacctagagaaggagtgaagcacagtgacctctgaacctccagtaccgttccacctgtataggcatatgaagtcattgagatatgaatttctgtaataacagctgcttgggaatactgctgctgaggcaatgtgcataagggagaatagtggggagaaaaaagagttaagaatttcgaaaggttttgcttattgccatctttttcagtcgtcaaagagatgttttgaggtggcaattaaaagaacctgaaatgactagaaatgtagcattgagcctgtgtagtggcttatcttgcccaatgttctgtactggccagagaaattaatgagttcggtaagtaaacatttattgaacacctactgcgtgctaggttctgtggtagggattggatatgcagagatgaataacatactcttttgtcttggaggatgtcagtctgggtggggggagagaaattaataacacaaatgagtatttgcagatgccatgccatttagggttgtagaaatcatttggactactgagagaaaacagggaaaggaagtgctgttttatccggggggaatctagaaaggcttcacagaggaggtgacgttcgagctgtgttttaaagaatagtagtaggacatgaagaagaggggcagcagcttggtgcccttgcagtgactagtgtttcagtgctgttgcaagaagggattcaagttggggcaattaagaaagagattgtgggagactggagagagctggagcccagattttggtgatccctgtataaagtactaagagtaagactggttaaactgcaatctcaaatgtttccatcatttaagatttcatctccttgattctgtatatcagtttagcttatggattattacaattatgaatttattagctgctatgtaaaaatagtccttattaaa

SEQ ID NO: 80296 - DNA, 1467 bp, Homo sapiens
aataaatattacaaaagttttaaaaagtctattctacctaaaaccttctataataccttaggaaactaaagtggattcatgatagagcctcgaggggaaagggaccacccacctagattaagccattgatatttgagttcttgttcactttttttttttgagacggagtctcgctctgtcgccggggctggagtgcagtggcgcgatctcggctcactgcaagctctgccttccgggttcatgccattctcctgcctcagcctcccgagtagctgggactacaggtgcccacaaccatgcctggctattttttgtatttttagtagagacggtttcaccgtgttagccaggatggtctcgatctcctgacctcgtgatccgcatgcctcggcctccctaagtgctgggattacaggcttgagccactgtgcgcggcctcttgttcacatttttaggagtaacatttgagattattttacttgtggcgtgacatgtgaataccatgttgatatagatgagtggacaagaagaaaagtcacatgagtgggaatgaaagaagatcccttagttgaataatgggaagctgtttgttaagaatgttataaaaagggaacagaacaagggggaggtgtcatatgaccatgaaacattgtgctggcctgagttctgagggtctgactgctctctgccagagtttgtggagaccacctgtccttgaaggggtttgctgatgtggatggggagaataggacctccgagaattttgaggctttttgttgagtgttgttcttttaaagtcagtgctagtactaatacttctgataaatgttgaggcggaggaaaggcatgaggggcatgccagtatttgacttcatttagaaagtcgttggcaatatatatttcaagggattacatttcatgtaatacatgatttttaaggactttggttaaaataaagtgtggatcatttatatttaatgaatttttatttccctttcaaatgcttgaaccaggcatttctatttcagattgaaccaggtaatagatgagctcagccttgtgatcagaaatgttatctcttattgtgaaaagtttccatcatctgatggatactatttgtttgaaaaggtgaatatcagattatagtttcttgatttgaagatgaatacataatagagaacttgcattgtaattttggactgggcctagaaagatcattgctttatagtgcttctcctttaggaacttagtaaatactgcattaattttattttatctttaatttctgttaaatgtatttggtattttgttttgaggcagtatagtcttacaattttagctagattttatagatggaggaatgtcataaatgttagtattgtaattctctttaatctgtttaatattttgatttagatgtagaaattctaaatttaccaaggctaatgtttctgaaggaccagtctt

SEQ ID NO: 80297 - DNA, 1150 bp, Homo sapiens
gggtttcaccatgttggccaggctcgtcttgaactcctgacctcaagtgatctgcccacttcagcctcccaaagtactgagatgataggcgtgagccaccatgccaggcctaacgcctcttgtgtgtggtccttaatttcattcacaagtggaggagccctcatgacctaatcacctcttcaagacatcacctcttaatgctattcacgtttggcaacacctgaattttggtgggaacacattcaaactatagcaccaggagcattattctcttttccacttcatgggggatataatttgaccagtgttataaggttgtatagtgagaagctcactagtgtggtttttggtgtgtatatttaattgccctagtgaatattcctttgatcaacctttcttcttaacacttccaaatgtacttattgcttctagcacagtagactgtctccagcaaaaatctacttatcaggtcttttggttagtggtaagaaatttagaaattaaggttggggaaaaattgacagtagaaaggtgggaaagatcagactctagcaatagtctaattttgtatgttaagtagtgaatctagcacatatcagatgtttagtaagtaagtgataagtatgaagccacaagtccagtcatgtcagagaagatatctgcttggttttccaaaagtgctaattatttcctgctgttagtatttttttcctgtagtggttgattgaggaacacacagacaagcagtatatgcacacacatatacatatacattttaaaacttttaaattggagcataacgtaacttagagaaaaatgcactaattataaatatataaaaatttcacaaagtgaacatatttgtttactagagtcccctttgtgctttctcccatttcactacctctccccaaaagtaaccagtatcctcacttctaacactgcagataggtatgtaaatgtaataatataatatgtgctgtgttcatctgacttcttttctcagcatcaggtttatgttatctgttcatattgtgtgtggagcagtaattatttcattctcattgctgtagtatagtactcaattagcttaggggaaacttacctgctttatttttttcttcttaaagcagtgtctaacacagcttta

SEQ ID NO: 80298 - DNA, 6621 bp, Homo sapiens
ttttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaattccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacagacagtagaattatgtgttcataaattctgcttttctttccactacccttcctcccatcccatccttccttagttctgtatttgtttttcttgcctcatggtaattgatttcagacagactttaacaaaaccacattgttttggtgtaactataaggtatttgcatattggttacctatttgtctttcttttttttaaaggaacagatataaaatgttttgtttatgtaacaagggacatttataatttcaagttgataatgttttaaacagctgcttacaaaagtatttctgttaagcctatgtcagcatgttatccatgcagcagttttgaggattttatgaagaaaaagagctaaaaaggaacattaagaggaatgggatatccaggtgttctgcacatgccaaactgctgtagatagtttacactcttccattatttatacggagtgatgcagcacattttagcattcaggaggatttttaaaaaatagctgcagattaatctggaaaatgtgctaatttaataatagttacaaatttataaatttaaatccatttgaaattgttgcattatgctgggtagtatatacaaaatggttatcatcttaaaccaacttttcagagaatcttgatggactctgcctttaggcttgaattcttcaaagtctattttaatgaaatttatctaaattgcagcagtctatttgattcagctcatagacatgtaaaaattatgaatgctgttttcttatgaaacaaattgtcacagtgtagttatacattctatttttgtccccttttccctttttctcctgtatcttttaaaatttggaaactacttttccagaaggcattatttatgcctccctaataaggtattttacttatgacagatgaaaaggaaccaggatatgtttgaattttttcactttcttagtctgtgacaagaagtagaaatatcactagtgtggtataggaacttacatgttttttatgatgaaaataattctcaatgccacttgaaaggtaattgtgtctgagagctgcaaatttttcaaccacaaaatgtcacttattcctacaggctatacagaggtctttatggtttttttgttttgttttaatggcaacattgtaactgtcaaactaaaagggtattctgtgattatcttttaagcattacagaaattcaagtgaaagttatatgcttatttctattgatgttaaaaatgataatgaaagcaaaattagctgtatctgtaattttctctctagtgccaaatgaatgccttagctactcatagtgcatggtactgtaagtgaagacctgtagctttttttttttctttaatgaaaagcattataatgatgtagcagcatcagatataaacttaaaaaaaaaggtttcaattaacattttatatatggataatgctttgtaaagtgtaagagaaaggttgcagttggatcagtataaaacaatgaccaagccaaaatcagcaccctagggccttaaataaaatagagataccccacaaaatgaaatattttgaaggatgggaggggacagaaggggggactatcccccaaggatgcaagatactttttacagttgctatcattatactttgtcttcttgcttcagttaggaaggttttgatggtaaattctgtcatggtaatagatacctattttcctaacctgagattttacaaggaaggtttttaggttggcttaaatggaggtatttatttgagtgagccctaatttgaaaattaccagacttgatcctcctggtatgaatcaaggaaatactgtaccttgctcttagcaactctcagtggcctgaaagagaaaatgcacttcttcaaggtgagtgaatcatgctttttccacagttcagatcagaccctttatttttcaaactacaaggcctgcttattggacagtctaaggaatagctttgatacttggtattcagttggttccattattaatgtatattatttttatttaaacatcaaaacttaaaatatcagataatgttgcatgttttaaaaacacatttcatccctttggctacccaggaccagcactatttaagacactgcttatttataaaatgagaataatgattatatgtacatattcagacatcaaaatttaatgacattctattttgagaagggaagacaatgctgaagaaagtaaaactgttgattgaaatgctgacagggtggagaacgaatttgaagacagtggaataaactatgaactatgctaatggtaattagattttttgtttgtttagtatagtggtaaattgtgtagtatcttgctgagaatctaattctatcttgtaaaatcaatccaaatgtgtattgtgaaacacctgtataaaatcatttttgaaataagtgatctacatgcctgtttttttaaaatgtttttggtagaattgtttgaaaatatgtttagccagacccttccccaacttaatttttttttaaaaaaggaaaataggtaagaaaatgatagttctatatctcagccctctgtgaactctaggctgtctccattttgcagccactttggtcatttgatgtttactattggtatacttatgctttgaattgtaaatcttcattgatggtattacagattcaaccaaaacttctctgtcctgttcagtaattgttatataaatctggatgagctagggaggcccaggtggatgttttcattcgcaaatcatgagaaacttaagtgggttttatgcacttgatagagttggcaaaattgaactatgaagttaactatttaactcaaggaatgggcggcaaacccatcccctcgattgataaagaaggggaacatttttacattagaactgacactgaaaacatagctttttcagtccaccctggttgctctagtagcccacagcccaatcacgttaaggttctttgctgtgggaattttaaataaaccaaaccccaaagcagaccatctgtaagctttggtctgcttgtttctgagaagggttttatttcattatactaatagtggactaataattggtaattgtgagaacttaggtatgataacattgtttgaagtaaaatatgatttgggggcagcagctttctaaataccaactctgtttgacaaatgttttgaaaattaaaatttcaagtgagcaacaccctgttaagagttttcactatagttgaggcagctactttatgaataagaccactttgggttatttaagcagaagcgtttcttttttttttttggaatggggtgggatgaggagtgagttgccagacctttgattagtttgctggtttagaaacagccagtggctgaattagtgagtaaatgaatgaaagtataaaggacttgttttttatgatagattttctgtaagaatcttaaatgttccttttcaaattagatgtgttgatgcacacatgactattctgtttttctcactgactatataacattaaaaaggggttaaagaaaacaaaactctgccttttgtgctatgaaatatttttagtccagaggttttaagctgtgtgtccattcctactctgaaaatgcatagctttgttctggatgtcatctcttgaaagtagaaaactcctatgtgtttatcacattgcagggctttcttatgtatttctggcagacttgcccaaatctttagatgggctgggttatacagcatgccctcccccaaataagggatctgaaataaatactacactattgatagtggagatatattaatttttaaaactgtaaagtaaatgtggtctctaggtttgtggtgtgtacctttgtgttaatgtgtagggaagagacagtgacttgatggttatggggagtgtatcttgatgtgtgtataggggtaagtattgctaaattatttacagcttttattcagggtgagtcatgtgatgaatggcctaatcagaaaagtgaaggagcgaagatgcaagcttgccaaatgatgaaatgaacaagattttgtatctattttttatcaggtgttgtaaaatttgtgcatggctttttgttgttgttgcttagtaactggtagaggagaaaagatgaggaaagaaactcagctttcctcacagtcttttcaaaggtacacagttggggagtaaaatctgactggcctaatcgatggaaaagaccctgtccttttcaccccatcctgcaatcctccgtgcagaggaactacactgttgtattctagtaattcactgtgatttataacaaaccggtgatgtcattctattgtgcacttttgtcaaaccatttatgtgactttaataaacatagtaaacttgctgactgcaccagaggtccattagtgatttatatattgcatgacattttctatttgagtttgacatgtagagtcatttttagtttcatggcaattgacagtcctaataactcagctaatttgaaactaacaatcttgctgtgtaaaaggaaaaaatggtgtttgtgttcagtaaatgtttgaaaaaaactactttgaggtttgtgtctttattaattattcagtgtgccttagttgcgatgttcttttgttgagtgccttaaagttgtcaaagttatatatgtgcatgggaaaaaattcacgtagtaaagaaaaattcaaatatatattttaaaagttcccttttcatctctccccgcctcctatttggactctgcagagacaatcactattaatagttttttgagtagcttcccagaatgtttctgtgcacatatgtattatttctccttttcagtttttaaaatgcaaatgaacttctacctttgcaacgctattctgtatcttatctttttcatgtaatatatcttaggcattttccatttctatatgtataggtttttaaaacaacttcatagcaattaattctgttgatggattgaaaa

SEQ ID NO: 80299 - DNA, 1089 bp, Homo sapiens
gctgaattccaggctcacaccgactgtctcctggcctgcctggcaactgtaacaggcccctaaccaagctcttaacaccccagcccccgaagcctgctctttccagctctttctcacctaagcaaatggcagcactatccctccgcgctgctcaggccagaagccatgtatccatcactgaccctaactctcacacccacacggagcccagcagcaaagtctgtccattctaccttggaaacacctggaatgtggccaccactcccacctcctgggcctgagtgccctcacatctcctctggagactacagcgctgcccgactgcctcccctctgcagtttgttcttagcatagcaactagagggatccttctaacgaggaaggcaggcttatgctctgctctgctctgctcaagctcaaagtaaaaagtgcagtcctggccctggcctgcaaggccctcccctctcgggtcccacctgtcttgctgacctcacctcctgctccctcttgctttactccagctttcagccacctggcctccagcatgcatgccatggcgtgcctgctgtaggcattgctattccctctgcctgcaagggtttccctcacgcagccacgagacactcctgtcttcctcatggtctctgtctgatgtcactttattggagaggcttttcccaactcccctgtataaaacagcaccccctggcactccacccttagatgtgtgcctttttctgggtagcccttatcaccagttgataacgtttatatttatgtttattgcctgcctggaatgtcagctgtaggagagtgggggctttgtctgttttgtccctgctctatcctcagaacctggagccgtgccgggaatgtagcaggagctcagctaacacgtggagtgaatggaccacctgcaacagcagacagagccatgtggagtgaatggaccacctgcaacagcagacagagccctcctttggccactgactcactgttcaacttgaggcaagtcactgtccctcctgcctcatctcacatgcctcggtgtgcatacctgagagatgggggtggggacagtgcctcaca

SEQ ID NO: 80300 - DNA, 1010 bp, Homo sapiens
acacacacacacacacacacacacacacacacacacacacacacacaatttttttctaaagtgttaaaagtccacaccaatagtcccagctactcaggaggctgaggcaggagatcatcctgggcaacgtagtgagaccccatctctaaaacaaacaaacaaaaaaaaccccctaagtgtctgcagtttggtgtctgctctgtccgagctcagagaaggtggatgttttacatggtgttcatgccacaggcttaaacttactgtcccctgtatgagataagtgtcaacacccctggaggctctggctgcccagagcggtggtgtgtggaggctcaccctgggtaggtgctcatgctaattgctgggaagcctccatgatcagtatttaactccggagatgtctgaggtcatctgggccagcactctgcctgtacggcactctacactttttaggaatatcacaatgattcctaattttaatttagattcgtttaagaaataccaatttaatagtagtcagttctcagcctttcaccaggtgctaggcccctgctttcaagggaccaacagacaataacaataacaataataatagaagcggctaacccttccggagcacttagtttatgccaagcatatacaatatgttttatatgtattaattcatttaagcttcatgacagcctatgaagtctgtgctattattatccccctttctatggttgcagaaatggaggtccagggaaggaagggaggtaacttttacagtgttcccacagccagtcagggactcagcctgcctcgcaggccttctgtcttgccactttgtcaggctggtgggaatgacccggaaatatgtggtccagagcatgggacctggaggcagaagacccaggcctcgctcttgcctctgctccttactgtgtgaccttgggctagtccctggatgtctctgagcgtctgtgaaaatgaagttagtagtctatctctgtagggtgctctaatattta

SEQ ID NO: 80301 - DNA, 1051 bp, Homo sapiens
catttgaaaagtgagccaaataaagcatccaaaccttgatctgtattatcccggctctctgtagatcagagctccctgtggaaggcgagggaaggtgggtcccagagcacagtcctacctgggtccctgggcagaaagaccaggttcccactgtcaaatgaccttgatctttgctccagatacctcccgatgcccccagcgctcagacctgcttttcctttaggtttatggaaaggaatagcctctactagcttgaggcatttgcagcaaatcatttaaacaccttgagtttgatttcagaactaacagttttataatctggaatctggtagaatccaggacgtggaacggctgatggaaagaaaggtgttggtggaaggggacaaagggatttaattcctgaggatttttatttaactcctgaaaaattgctggttatgcctgccctgctgacctccaggtgaaagaccagcttgcaaaaatgcatggggaaatttgggattccgagaaatttggaattctgggaaaggggatttctgcatacctgagtggccaactgataactttatcatcacaaatctttcttctagagaccctgagtctgccttcctgccttactcattaaaagatctgggaacaaactcaagttattatggattgaggctgtttcagggcttgagctgttctgttaaactgaccttttcagggttcggatccacattaatttctcaatccttggagttcctgtagcatgtgatccctggtataccagccagcaggtaaaggcctaatgtgccttgtttgctgattatcttatgagcatgatctttggctccctaacttgtgagcttgctgaagctagagattaggtctgattctttttagtagctttcacagcattcatcaaagggctatgcatgccagttagagtgtgttgtggatttttcgaataccaggtatagacatataagatttggcaggatttggagcaaacctaaaacattccctgttgctgcttggacaaaatctctactgttagagatctgtggac

SEQ ID NO: 80302 - DNA, 1059 bp, Homo sapiens
agagacttggctccccaagtgaccaactaggagcgccctgaccagaggcctggtttggcagtggcagaggcagagggagcaacttcggagccctttctgctcaaccatcaggctgcggctgcccaggcctggcagtgcatgccctacatgcctggctgcccccctggcctccacagtggcccgtgacccccggctctccctcctggaagctggccgtcctggcacactgggctgccagcaatctttccctcctttgtttctctgaaaccatgagaagggccgctgagttgggagcctgggttgctaagagctttcctcaggccagaccatatcaccagcttgagaagtctcctggccaagatttccctggaactctggctcagagggagggagagtgggtggagggaaggggagagggtactcaggagccacaaacaaagctgcccctctgcaccaccgcccccctctcccaggaccagagtgtaggagcagcctgggagccacaaactcagtgggcctttgctttttgaagagccctgggaacaatggaacaacaaagctcttcggaggctgcccccccatgcccagccctgcacttctgttctctcaggtacccccataactctgctgttacccccacttttcagagggggagacagcctccgagaggatggcctgccctgcttcacacagcaggaaggggcaaactgggccataacccgctggctgcaccgccccatgcacaagcaggagctgcaggccagctggcctggcagtggatggctgagggtgctgcggggccgctggtttagaaggtcctcccctaccacttcgcttagaacccactatagaattcccttcctttgggtcttttaggtgttcttaaaaatacaagtccccctgagggggtaataatgccctaagtggttgtcattgactggaccgagcctgctggaaggaaaacactagagtaggtgcaggaggggttcctgagaggcaaatgaggcaggagggagagctggttactgtaagtgagccagttttgccagggaagtgagt

SEQ ID NO: 80303 - DNA, 1094 bp, Homo sapiens
gggtggatgggtaggtggaggcgcttttggtacaagctgagctgtgctctccagctctcaccaggttccccagcccaggtgagcagccctggcaggaaggtgctatcttgtatctcccatggcctggtgaacactaattccttgggcagggtggtccctgcttggaatagaggagccccgatttctgaataaccagcagcagatctaaagcagttctgtttgtttctgtctcctgaaatatttatgcaggaatatgagaaaggggctctgtttattgaactcatcctccagggcagaagccgtggggaaagagccacttcccatgtctgcgagccaatgagcagaggtggaatttctttgggtttgaagtgagacagagcctgtgtgcttgcagaaggaagtggggtgggattcctggagaggacagaaagccctttcaacctcttgcctccagtcccaggaaagcttttcagcacatactttcctggcgaatccaaataataacaattgaaatctcagccttggttctactctgggctttgcctctatcatgctgtgtgaccttaggcaagttgttaacctctctggattgtttttttccaattctgaaaagagtgaactatcagtccagttctagctgtccgtgcagttctagctatcagtccagttctgtctgccccttgatagtattttaagagtcagttgagttgtgcagtgaagtggatttaggaagcattgtaccatgcaaagtcccaactctgcagcattcgaggccagagaactggctgagtggccagccaagtggcagcctcagctgtgacttgtggggtcaggccagagagagtactctcttgagctggaccctaccctgcctcaggttgggacaaaggggccccctccctctttcctcctccagctaagccctgctgtcctgtgtccctgagaacactggcaggatttcctcccaggaagggggacatggatgtccagtttacatccctgggagttgcagacaccagagaagcaaggcagcacttccccatgacagtgggatacgccttatcgtcagatatagaagcctgtggctccaggcc

SEQ ID NO: 80304 - DNA, 1022 bp, Homo sapiens
cgtgaccctaggtgatgggacagtccacatgggtgaataaaacaggaacagtccctgccctcagggacaggcccaggaggatggggagacaggacagaacacaatcctgacatcagtggtagaaatgctgttaaagaaaatacaggggcatggggggtagggggtgggggttgtgagaaggggatcccctgtggaatgaaggggggatagagccccatgggatctagggggatctttctggctgagagagaagcaattttgaggctccagcaggagcctgcctgccacggaaagcacagtgagcaggcctggtctggtgggaaaggagattgaaggggaaggtgggttctggctcccataaggctggcctgtgctagctgctcactaatacttctcgactgactgggaggacagataggtgaaggataaggctggaggcctggagcccagcagccatgttgaggtgatgaggatggagccagggcagaggcagcaggcacagggaagatgcatcttcaggccttggggatggtgtgggaggagaggggtacaacacagcaggcagagtcttcccggagctcctgggagaagatccagatccacaaacccacggggagaaatggccgcgcatcacgcagagcactccccacgccccttcccacaggccaccccagccactctggcctcctgacctggggcccatggagcccatcctgtggctctcctcctgcctgccttctggagggtgctccaaactgggtcttgtcctcctgcagggccagcagggctccgcagaagtcctcagggaccgccctcccctgccagcctcacctcgagtccaacctcattagtattttgagcagaagcatatatatctttttttttttttcctgcagggaattggtggcctgctcatttcaaattgcgtaaaaccaaagagcaattaagaggcacagccttctcgggtcaaggagaaatgacagagagaggtggctttgctcgcctggctgctggcacatctt

SEQ ID NO: 80305 - DNA, 1097 bp, Homo sapiens
ctagttgctggatgactgtgttgtcaaacaaataaatgaattgaatgaatgaacgagtggatggatgggagggtatgcacagatgagcgaaagttggcctgtaacctccaaataattattatcttaaaaaaacacacttgctaatcatactagtgtgaggcctgagacagaggagccttcgtggaggacaaactgcagcaacagtgcgaggtcatcagcagatgtcaaggagtccatgtgtttagggcagagttagggtgacatggtgctgtgggctgaattgtatccccctaattcatatgttgaagccctaacccccagtgtgtttggagacagggcctttaaagagataattcagggtaaatgaggtcataaaggcagagccctggcccagtaggactggtgtccttataagaaaatagacaccagagagctcactctctccgcatctgcacagaggacacagcaagaagacggccgtctgcaaaccaggaagagaggcctcaccagaaaccaaccctgctggaccttgatgttggacttacagcctccagaactgtacgaaataaatatctgttgtttaagcccccagcctgtggcattctgttatggcagcctgagcaggctaatacataggggatgctggatctgagtttggagctcaaggggcagaacatggggaagagtgccatgttgtagaattcagaagggcagctggtctccttcagaggctcatactagaacatgtgcaccaggaggttcagcataagagcccaggctgtggagtcaagactgctggggtccaaattcttaccccatagaagcgttgtgagcactgagtgtatttcatacacagaaagcatttggcacagagcccggcacacagtcagcactccacaggcatgagccgcccctcgtcgttcttatcacgttcgcttgtcagtattgtcactctgggcacccccttcccttgacgcatactccagggctccagcattgctcagagtttttgggaccttcctgagagcagctctcagtagcagcttctaccatcaggaaattggttccattcttcatggtcagcccccacccccaaa

SEQ ID NO: 80306 - DNA, 1066 bp, Homo sapiens
ccttgaaatcaatattctactaagaggtctggcatctttgcagtccttggcaaagctcctactgtgtatacctgtatagatggctgaaactcctgaaagtcttagtaagaacactttgttctcattgtcatcttgacttagctccagtgtccaactgctgctatttttgcttttcaattataaattgctgtgagtttagcttccttattatagatttagtttgttgtgggttgttcagttagccaccagtgtgtggtacctatctgtatatttgaagcccataatttttcaatcatcaccgtgccttaaaggtgtcatcagtggaccacctgcattggaatctcttgggtgcttgttaaaatgcggattcttgggttctcacacagacctcccgaatcagaatctctgggagtggtccctagaatatatgtctctgtgccagggagaacctgtgaacacatcttaatgtgttatcagggtggttcagaaacaaatcatccagatctttattgttaaatgagttacatgtaagtccccaattctgcttctatagagatagttgcaagtggatttgttctatttaaatatattgcaaaaggaaggtgccgtattatcacataaaattgtgcatcgcttcttttacgaagtacctgggaggtgattcataatgtccctctcttattcttctttattgttttccctctaatgcatgagtttgggtagatgaggagcctccgggccagccaagattagaaaccaccattaagacacaaaggagcataccagaccctgccaagtcagtaacttgctggagaaactattttaaagaaaagacatggggactaagacaaggagagctcctgaatgactttagagggtcatgagaggaaagccccggagccctcacggtcaaggatgtgtctggaggctgtgctggaaagtgcctgggaggatttcaggactcccgggagccctctggggaagcggcttcctttccgttcctgccttgtgtgctgggggaggggctggttccagggctgcagcgggccctttatccgctcctctc

SEQ ID NO: 80307 - DNA, 1034 bp, Homo sapiens
cacagctcagggcaccgcctccaggaagccacctggagccatcctgcttcttcctctgctttgccaacagactctccgcttcctgccatgtccttgccatgtttgaggcaggggtatcgtggtctgttttcacacctgttcctgcttctaggcgatgggctccttgaggctgggaaacacacccattcgtttttccattcccaacagccagagttcagcccaaatactggacagggatcttttcggacagagaaatcttttgaggcccagggtgcagatgagtcttggccaaagccccacatctgcctgatggcaaagctttggatttaaaaccctgcgtgaggagtgggacgggtgaggccctgtggataagccaggtttgcactgggcctctctattcactacctcccccttctcagcctcagtttccccatctgtgagatgggagagtgcactgaagatgggcggggggatgtggaggaatgctgaaagagctagttctatgttttagtggagggagttgctggaaaggaaagagacttcagaccagttacttccatctctggaaatagaatatggggcagtgaagaccatgggcttcgggacctgtagtcctgacccagccatttgctagatgagttattactcccgaaagccttggatttcttatttgtaaacgagagataataaatcccacctggcagggttgtcatgatgacagtaatcacccacacctgttgaacacgtacaacgggccagggactgttctaagctcttgagacgcctggtgccactgaatactcagcaaccttgcagatgaggaaacaggtatagcttatacaaagtcgcacagctgggaagtgctggaactggaataaaatagagtgatgctggctaagagtttagcaccatgcctgacacacagtgagcctcggtcagcgagagggcctaggtcatctgccccacaacgtgttcacacttgcaacctgcaggcatggcccagggctggggaggggggcgctacaggggatcca

SEQ ID NO: 80308 - DNA, 1031 bp, Homo sapiens
tataattttatttaatttcaaagatgtattttccctggtcttattctgttttatgttgctgggcacatttacaataaacagaaatttatttggtttacggttctggaagctgggaagtcaaagagcacgatgcaggcatctggcaacggccttcctgctatgacatcccatggcagaaggtggagggcaagagagatagagcaagagaagaccaaactcacttttataacaaacccactcacaagacaactaacccactcccaagataaagacattaatccatgcatgagggcacagccctcatgacctaatcacctcttataaccacttcccaacactgtagcattggagactaagtttccaacacatgaactctggggaacatgttcaagccatagcaccctccagaccatccattggtaacaagggtgtagagaaacctgtatgaacaaatacattgatgttgcacaaaagcttttgaaacttgcaaatctggtaggcaccagtctgcatattatttcttcaagaactgtttgcttgaaaccagagaggaatatttttcaatcaaggctatgggaggtgtgttttttgtaataatatctgtttttttaataacaattttatatgtttgttagaattggaagctgctagtaatatccaactattcagatgttgtcactattagcattctgatgtattttcttgtagattggtttttttagatagggatccttttatatgcaggttgagcattctaaatccaaaaacccaaaatccaaaatgctccaaaatctgaaacttcttgatcaccaacatgatgctcaaagtgaatgctctttgaagcactttagattttggattttcagatctgggatgctcaaccagtaagtaaaatgcaaatatttcaaaatctgaaaaaaaaatcaaaatctgaaatacttctggtcccaagcactttggatatggaatactcaaactgtatagaacttgattctgttttactaagcgtagatctttagcaatgctcatgc

SEQ ID NO: 80309 - DNA, 1230 bp, Homo sapiens
tatgctttcaaccacagggcactgtgtaccggtgttcaagatgtacactgcagaaggacgctcattcatatcgtagagagaatggctcgtgtaagagtatataggtggacccagagattcagacctctctgctgactcccagagcagcaggaaagagcctcctcctgatccaaagctgactgtgccctgggggaagcagggagtgtgggccccagggagagtaggtacacccagcatctgagcgtgcgtgaacaaggcagatcgtgggcctgtgtgtgtgccaccagggctgctgcccatcaggctggtcactccagtgggtagtaacagcttaactttaaacacttttacttgatgcaggggcaccttttccttatttgcagaggtgtatatgaacgagcagcagcctgtcccaccatggctgtgtggcctccctgaaccattcagtcttggggaggacacagctgcagagcagtgtggcccagactgacttggcccagcagggcccaaaaacaaaaataaaacacaggtgattcctcaaggaccttccagtccagttgagaggcccagaaaaaaggtgctccattcaaggccaccccagggccatcaaactaatctccttctctctctctctctttctcctctgcagacaggcaggattgaacccaactaccccaaggtctgcggccaccagggcaatgtgctggatatcaaatggaaccccttcatcgacaacatcattgcctcgtgctcggaggacacgtcggtgagcagaggggtgctcccggaggagggtgggctcaggcccctccctgcttcctttggaggcctctcttcctaccctcccctcctccaccctttgcccttcttccctcctctttgtcatctttccagcaagccccacgatgtgggggggatgggagctaggaaagaaccaaggcagcaaatccctgctggattccagagatctgtgttttcagtgtgattgagcttggaggtgttgcttttgtaggtgagaattagaatttaaaaattaagcgtgtgattcagcatttgtctatgctgtctaaagaagggcaagggaaagaatatgaacaaggagggagggagaaaaggaaggaactggatgggcatgaggaaaagagcgcctgttctttgcaggctgggcagggtaaatgtaccatctggtttgtcctctctgagtcgtggtttctaggaaaggagacttag

SEQ ID NO: 80310 - DNA, 1549 bp, Homo sapiens
aggaacaatgtcggccacacctgcaagatgttcaccctctttttccagagtgggggctgagctccagagagattgagagacttacctggggacacatagcaagtagcaggtttggggacaatgagaacaagtcccttgcctcctgtttgtaagaccctttccactgcccctggctgcttttcgtgacaagaaagtcagtcttgccaccacccataggacgggctttttaacatctaggggaggtcttaacataaagtagttgccatcctaagaggccttcctgggatttggggaggggtatgccatcctgcctgcagagaggctgagaccagctcttctccctcaggaggacctctccatgcccctgatcgaagaggaaattgatgggctctctggcctcctgttccccttctatgatgctgacacccacatgctctacctggctggaaaggtagtaggaggtgggggagggcccggggcagcctgtgggagagccctaccctcaatgcacccctgcacctgccccaccccctggagagtagccagcctaaccttccaagttcctgggcctcacctttcccatccacacctgccctcaagtctgacacccattcttactcaagtgtctgctaccaagaattccttcaaaggtgagctggagcgggcttttacattggaataaagatcagagcctgcagtgtagtcagtgatgaatgatggaatttgagatacccgccaggagatccttggtgaatacagccttgtttgtcagaaaggctgtctacacacacacactcacatcagcccatccacctccacctctccacccgcagtgagtcccctgtggtgcacccactaggagcctagaagccaggtttccttggtttttttaactgcccatgaggcacaggggagagctgtcttcagctggctcctgggaccaggccctgctctgccctccctacctgccaccttcctcaactccatctctcctgaccccagggtgatggaaacatccggtactacgagatcagcactgagaagccctacctgagttacctcatggagttccgctccccagccccgcagaaaggcctaggtaagtggccccgaggctgccacagctggtgtgctcatggcacgggaggacatctggcccatgggtcaccccctcccttaagtggaaaatcagactcagaaggccatagcacatgggcaagttggaacagaacctgcaagagctggccctgctgcagctgtcactgcccactggaccggcgctgtcaccccactgtgctcacatccaccatcagcggcagcttgccagcatgtgctctgcgtctgcactcctgatcgcagatggggagcctgaagcccacagtggctatgatgatggtgggaagtggtcccgtaactagaggtcagagtggggtctaggcacaagtcccttcctgagcctctaggaagccgtgactcccagatcccagcagcagctctgtctgcctgatagggcaggaagaagttccaggtgttcccgtgactgcagccc

SEQ ID NO: 80311 - DNA, 1031 bp, Homo sapiens
aatttaaagttcatctgaaagcaaagtcctagtttttacaatgttttctctcatctttttttgagacattgaggtataatttgcctatggtaaaattcatcctctgtagtgtgtcggtttaagagttttgacaaacacacacagtcatgcagccaccatcagccaagatatagaatattctccagtcttttagggctagatcttccacacccaattcggccacagtttttttagcatcatctttatcaagattttctaaagcatttaattaagtttttatagaaacaacaactctctttttgtgctcatttcatcaatttatattatatttcattaaattatgcaattacaataacaaatgtaattcacaccagaaagtttgagaccaaacacaattgactgtgggtaacattcaactcaggtgtgcaggagcctcaaggagcctgctgccttccagggctcggcgttttgtggacatctgtcaatatgctttacaggagaaatggaggcgggttaagctagagagtcattggggtgaagatctgccaggatagctgtacatgaatccctgaccagtgcaaactttggtattcttgtcatagttcctcatcagtagggaaaaagctagattccattctgtatcctgagcctccttaagaagagaaggatacaaagcattttagaaagttctaaattatcagcacaagccgggcatggtagcttacacctgtaatcccagcactttgggaggctgaggtgggtggatctcttgaggtcaggagttcgagaccagcctggccaacatggtgaaacccagtctctactaaaaatacaaaaattatccaggcatggtggcacatgcctgtaatcccagctactcgggaggctgaggcaggagaattgtttgaacccaggagacagaggttgcagtgagccgaaatcatgccaccgcactacagcctgggcgacaaagcgagactttgtctcaaaaataaataaatacataaattagcaataataatgtaataata

SEQ ID NO: 80312 - DNA, 1215 bp, Homo sapiens
catgtaataatacatctattatgtattattatacatctattattatgtattattatagatgtaataatacatctattaatacaatggtaaagaaaagcattaagttaggacccaaaaagggacaagcttgggatatttggaaaactggactgtttggtcactcctttttcagtgatcctgaatcaattaatgacgcaggttttgtttcctacctcacaagggaaagtaagagccatgggctgagctagagatgggagaggtgcaataaatgcacctggggagaataaatgtatcaagcagtgggaggcctgggggaatgtgagggcacgggcggcaggcagctggagactcacctgggaaatccttgtctcacctgctctctcctgggccctccttggccccctctcttcctccaccccagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacac

SEQ ID NO: 80313 - DNA, 1061 bp, Homo sapiens
cacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatcaaacctgggcatagccatctcatttaaccccagtggttcctgttcttggtcaccatggtaccttgatggtcagctccccacccacagctcctttgcctttctggaatgacaacccacgtctgtacctacagatataatttcacaccttcatttatctcagcactattgacatttggggcgaataattctttgctgtgggggctgccctgtacattgtaagatatttagcagtatccctggctccaccaatcagatgccatagcaaccctcatccaattgggacaaccaaaaatgtccccagatattgcccaatgtcccctggggtgtcagaatcacctcccggttaagaaccactgttctaccgctattcaatagatgctgccccgtgttggggtctgggtgagaccaacgctctacattgg

SEQ ID NO: 80314 - DNA, 1176 bp, Homo sapiens
taagaacctctgctttacattcctcccgagatgtcaagtcttggtgggggctctgagaggctgggggtgaccccggcctttttgtgctctgtgtggcttcctcagcatgtcccaaggcagggcatttctaatgttctggtgtctgtcctttctcctaggaggatgaagaaggttataacgatggagaggtagatgacgaggaagatgaagaagagcttggtggtatggcagcctttttactctcagctggtagcagcctggccctttcactttggccttagattgcttagactcagaggcccctggcagtgggcaggacactcctgtcagaggcctcagattccccttccagctgtgcagatgtcttgcctcggtttccaaggatggcacagcttgctagtcatgggtcccctgacttctcactgggtgggttgagttaaagaggtgggattaataactaatctaaatgccgctttcttacttttccagaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgtta

SEQ ID NO: 80315 - DNA, 1050 bp, Homo sapiens
cttgtgatatggcagaaaggagccaaaactggcagtcccgggaccaggtcccctaggcccagctcaactagtgactcgatgcgtgaccttgaacaagtcagttctctctgtgcctcagatctctcacctttaacctgaggagtttgatttgatcttgccgctttcccgggccctggaacctgttgctgtgctctgacaatttcctggtggtctcggtgtgagaggcctccagaaggggcctttcacatgcataacacttgtgaggggggcttatctttggcacaacttcaggatgtgtttaattatgtcagcactgttttcatgagagttagtgtgttccatctttggacttaggtgggtgtgggagggtcatgagccccacactgaagacgctacaaggggcctgtgctgtgtggggggcggagccagctcaccactagttctgtttccgttccccatttcgattgcacagaggaggagtatgatgaagatgctcaggtagtggaagacgaggaggacgaggatgaggaggaggaaggtgaagaggaggacgtgagtggagaggaggaggtaaggaggctgggctgggcagggccaccgtctgcccctttgaggcagtcccactgactgcctctgtgatcagtcttggcagccccggagccctggttaggaaagtcgctccccgatgggtagtgaagtgagtccatttcagagcctttcactgggctgtttctggggagacaagacttgcagtaagctctggggaggctggattagaagaggggaagaggattttagaggcagggactgaacctgctggggtaagcctggccgttgtttctatgtgaagaagtacagaatgcatggccccattttctgctttttgctttcatatgctaattaagatattcattgagcacttaaactgtgctagggaaaaccaaagtctgccttgaactgataggtagcaggataacactgctggatcccaaatcagagagtgacactatggaaatagagcaccaggagttggccattttcctaaagaga

SEQ ID NO: 80316 - DNA, 1035 bp, Homo sapiens
agtacatgaagtgccatgttaaccgcccttatcatcatcattatcagatgcagaaggagttagtttgttagttcaagttgacttttggtttccctctggctccttagtctcagggagaggcagtaaacctcttggctcatgcaccaagaaagccccaggctaatttcaagtcaatcactgttaagacagaagctgtaattgcagaataaaagtgttaacattggataaggcttcaaagatcctccagtccaaccccccattttccagatggagacgccgaggcccacaaactgcaggtgatatgtctgggcaaacactgtggctaagcagagccaaatccaagcttccttatcacctggaagtcatggtctgcgcatgctatctcatggcatccttgcctgtttgctagggctgttcctccaccttcctcccacaaatcacttactgttggcttcatttttccgcttgcagaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatggtgggtgacagggtgcggcccagggctgcaggggcccagctgaggccttggggctcgtccttggctttgcagaggtgggtgggctgggtgttgggaggcccccacccagctactgaaggctggctgtctgtctggtagctaccaccttccaaagctatggaggggagtagggctgtctgctttgttttccatagtccctaatctgtctcattggttgacttccctaaaagaacaaagcatgagtcccatgctcatggaaatatcctgagattctccaactgcataataactcctttaaaaccatccaactgaatccccacttcaatttttgtcccttttccaaagcccccagggagtgggattct

SEQ ID NO: 80317 - DNA, 1354 bp, Homo sapiens
aaacatggggcaagcacaatcctgattaaagcttcttctccttcacttttttcctttgcttttttttttttttttcttcttcttcttcctttaaggcagagcaaggtaactcttaggcttatggccagatctcaggtcttaactactttcctgtggtctaagcaattcttcttgcattgcctgtgaaacccactatcctaccaccagttgcatgtggaatgtcccctgtgggtaaaggtgtgtaacctacagcagccttctctccaccccaatctcatgctgccacctcctttcttcccttccacaaattctctcgtacccacctggcttcctagctgttccccaataaggccaagcatgccacccactcaggatctttgccctggcttttccttctttctgtctggaaggccctcctagttgttgacttggccttacgtctctgctgaaagctcactttggataggccttcctggttaccctctctaaagtagtgtcccttgtcactattgcttttctgtccttttcttttctttcttttttttttttttgagacggagtctcgctgtgtcgcccaggctggagcgcagtggcgggatctcggctcactgcaagctccgcctccctggttcacgccattctcctgcctcagcctccggagtagctgggactacaggtgcccgccaccacacctggctaattttttgtatttttagtagagtcggggtttcaccgtgttagccagaatggtcttgatctcctgacctcatgatccgccagcctcggcctcccaaagtgctgggattacaggcgtgagccaccgcgcccggtgcctttctgtccttttttttttttctttgcagcattcatacacattatatacatgtgtatacatttattggtttattctttggctcccctgctagaatgtagatctgtgagacaggcacctagttttgtttaccacggtatctttaacacctagcatagtacctggcatggcatgtagtaaatactctgtacggactgttgaatgattgtatcgggcctgcatcctaaagcaagtaatgcttaagaagaaagaatcaaatcatagcattttaagaggggaaaagactcagagctctctttgcagggctttatcatacaatattattaattcatctaataagcatccagcactctttatgtatgaagctctttgcccacggtcacttaacagccttgtgattcatacagggacaggaagctcccaagttttcagagcagcccattattttgtgagacagccataatgatctagagaccttcttacaaagtacactggggagaaagctgtctctttatgattcct

SEQ ID NO: 80318 - DNA, 1061 bp, Homo sapiens
cacttttattcattaaaaagaaaactgactggcttggacctacaaattagtttcattatttgttaatgtttgaaagccattaaaagatgaatattaaggtttctttatactcaatacttgtagttttgtttgggggaatgagaggatgcccttggtacctttgtgaggcctctccactgagggtcaatcatgacttctgttttaaaccagcccatcccatcttctccagctgctctccttatgtcttgcttctctcccctccaaccttctcagcataaggactcaatcctaggctcctaccccagacgggtgccttccaacgttcctggtgccagtggccccccatcagccatgttcccccagccccttctccacactcttgtcacccagggccccatccttcagtgcattgcacactttgcatgctgggtcagggaagattgtggagagaggacagtgcacctggtttcccccacatagactgcgtgggggtatgtcctgcttccgccacttccaactgtggcacttgggcacgcccctctcagggcaccttccctttttgtctccgcaaaatgaggttgtaatagtgcctgccgcactgtctggcacacagtaagctctcaagaaatgttagctgttgttgccgttagaacaccatagctagaataccatacctggcattcacttaaaaaaaaaaaaaacaacttagggccaggcgcagtggctcacgcctgtacttccagcactttgggaggccaagacaggcagagcacctgaggccaggagttcaagaacaggctggccttgtctctactaaaaatacaaaaaaaaaaatcagccgggtgtcgtggcaggtgcctgtaattccagctactctggaggctgaggcaggagaatcgcttgaacctgggagacggaggttgcagtgtgagccgatatcgtgccactgcattccagcctgggcaacgagcgaaactcggtctcaaaaaaacccaacttacattatccgcagacacattacatacaaaagtaaccattttctttcaatgggaaaggaggtt

SEQ ID NO: 80319 - DNA, 1049 bp, Homo sapiens
tgtttgctctttcggcggaagtgatagagtaaggggaacattaaacatgaggttcttttggcgggggtgaggggtgtcgcgcacgcgactctagtggccctgactgaagccaaggacagcagcctgttccccgggagggaagagttgtcgatccgttggggaaacgccctcccgggctgggctctccgggaaggtaggtcgagctccgtgtttcaggtggatgttgcagcgccctgcaggctaggggaaccctcctcctcggtctaaacctgctccttcccccttttatttttgcctgggagaaggcagctacaatagtaatgagatcctaaagcgaaagagagggatgaaggtttgcttttgaaaaaagtaaaccgcctttctccggatgttgacttaggagccaggcaattcgtcgcgtcgggtcctccgatgctggcatctctgagaattttaaaaagccgatataggtgctggttaagcacctcacgagctgaactctggtatctgtgcagaaactaactttcatggcagtgtccagcagaggctgccttggaagccagcttttactttgacctttggaatacatcgcatgatgttttccaggctgacttactgcctaattgggttcaagtagcatgatattaactacagtttatgcaagccaaccaggaactcgcaggcagaaaattgagcctgagttcccctgtggtcatagtcagttgagttctgctgctgatagtagtttcgagtctgaggggctccatgatgaagatgggcttaggaattacacagacctgggtttgaattcctcctgccacaaggaggtaggatacgtttacctgcccttgtgaccttgggctggtgagcttaacctacctttttgaagctttgtttcttcacctgtaaaacggaataatcctatttaatcagtaaatgatgacaaaattggtttgatatggccctcagtatatgctgtctatatgacagttttagtctcggagacatatcagggtgcttccaggcattactttgagctcctccatggt

SEQ ID NO: 80320 - DNA, 1854 bp, Homo sapiens
ccggccgcgcccctccccctcgcagaacgcacctgcggccccgcccccggccgaacgctgaggcggcggctggctggcaaggccgggcggctcggccctcgaggcacagtcaccttcccttcccccgccattccgcccacccccctcactcagccacagagcagccgccgcgctcctcagccgccccgaaatctaaaggggtccgtctccggcaccactaccaaatggccgagcctccctggccggctgcgcagcccgcccattggtcccttcccccccccgccgccactgccattggctgttgcccggagaccctcggcggcgattggctcgggccgctgccgctcgtccatggggccgcagatcccgcctccacggcgatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgagcatttgccaaaaatatctctgtcggtccattctcctactttgtgtgtgtgtgtgtgtgtgcgcgctggggggaggcactttttttgggggggggcgcccgggaggtgcgggtttgggggtcggactgcaagcgaattggcaaggctggggggttgcaatgccatccgagcatgttccggctgccgccgccgctgcccttggtgtgtgactacctgtgcgtgtgctcccgcgtgtgcgagtgtgggtgcgagagtgtgcgtgcgagtgtgcacccatcgggggccggcgggcgcacgcgtttgggtcggagagaatgaggcgaaatcaccctcggagatcgctgctcccgtgactccgtctggggggaagattaacgagggaggaggaggagaggggctgcctcctggatttaacaacaaaaaaagggggttttacattttataaatgtatccccccttccgcccccctcccgcgcctcccccctccctttctctcgctcgctcgctcgcacacacaataagtttggggcttcgcgagtccggtttagtttctgataaatgtgggccgaggcccccggggagagcgcgtggggagggggctgcagcggagttgggaatggctggagtttaaagtgcgtcttcatttctttgcagtgatgaggcgagagacgggggagccatatttgtaactttgtagtgttcgtgaacgcgccctttctctccctccctccctttctctgcctcccttcctctcctcctctttctccctcactctttccaccccaccttcgggccagatgctgatgtttcttcctttccttccgaagggaggataaattagaaggagggggagggattttcgaacgtgctaaggcacagataatccccgcgtctccctgcctccagcgatcgctggtgcaagttgcccaaaggctacgtcccggtgccccctcgccccagctccttccggcttccccaagatgccagcctttgggccctggtgccccccagctcgaacccccggcccgtctttctcagtgctgggcttgtcggcagccattcggcgcctgcttaataaatgggcacgggaaactttgtcaggacgcgagctgcccggagctggcgcccgtggtgggtactggctgggtccacgtttatgcgggcatggcaaacacgcagctctaggatgggagtttgcccgctagccgccgttattgattgggcagcggcgggagcacggccggaggaaacttacacgggtggg

SEQ ID NO: 80321 - DNA, 1206 bp, Homo sapiens
atcctgggggctcttccggcttggggtaggggtgggtggcggcacacggggtcctaggtctttgacgtcgagggagatttatcagggtcttgagcttcttggaggtggtgtagcggggttccgggacaaggggtctttttacccgggtcccgagctctttggggcagagaatgcagtttagcaaggtttacaccggtgtaaaccttgtctctggaggcagatcatcggggtcttgggggttctttgagcgggcgtgggcgtccgtttcgcattgctgggatgaagaagcagtgtgtccgggttctggggagaggggtctgttcatcggtgtctccgggtgagagagcgatgtatccgttccgctggggccggggccgccttggggggttgttgggggctgagggtgtgtagcggcgaccagcgtctggccggggtttctgctttgcccggagcggggcggtaacttggcatggtctccagtcttttgggggcgacggggcgagttagctggcccccgggcagtctctcggggtgggcgcggctccgcaggcgctgggtccgctgagggcgggagagggctttggtgctaccgcgcaggctgggcagcatcctgaaacgtttttgttcaggtctccttctctctggatgagatttactcaatgcttagttggaggattgatcggtgttgttgcctagttgaagaagcagtgcgtttgttctgcagttttcttttctctgccccgggatccctgtgggggcgcgctggtctcgctggagctccgggagctagagtggcagcaccttaggtgggcgtttggtctgcaggttctttaggaggccggtgtccgcaggttgagcgtggatacagctcctgagcaactggaatctgttgagggtggggaagactgattttggcttgctttcctaggtggtggtctgctttgctcatcctgcatgattagatctgttctgaagtcttgcctgagtgaatgttaggcagagtcggatagtgcagggaagcgtgttctgtctggcttctttctgtcctttgaaaagcatttgtagagagggataacgtcaaattcagcctccagaaaacaatggaatttgaaatcccaaagctagaactctgcaaaaacgttttctgtgacctgtaaggatggttaatcgagcttttttagagaattctgcttaacagtttcattg

SEQ ID NO: 80322 - DNA, 2462 bp, Homo sapiens
aagtaaaatgttaaaacatgttaagtttgttggatatttaattatgtaaagataaattaattttaggactttcttttatcaaatttaattgtttcctgagtttgcaaaaggaagtttttagatttcctagaggagaatagggtgggggaataggtattcttattgtggtacagacttcaggaaatttctttttgtcaaacatatacacatctgatagatatattttgcttgtgaagcatacgaaccatacaaataattttatagtttcattattacactgctgaaaatgacagtaccaaagtgtcttttgaattatcattcagagttctagaatcataaatatgatatactaaagcagtttctagaaaggaaatcataagacatgaattccagtcttcactgtgctactcatggtgtgtccttggataattccttaatctttcagggccccagttttcatatatacatatatgaattatacttacatacattttatatataatatatacttttgctttaatatatacatatatgacatgtgtatgttgttatatacatatgccatatatgtatataatatgtataatatataaaatatgtgtataaaaagatacatatacacacacttagagtttttgtgttgcaagtctgaagtattgtatgtacaaaaaggaagagataccttaagagtagctagttctcaagaaacaactagttccatgtaatttttacatattatacctaattttagaagcctcttctttttaaaggtacatggcaagtatttaattccagaatatagattcatgaaggtgagtgattttctttagataatttagctttatctgttaaagcattattatttttagttccaatccctggttctgtagtagattatctatataataatatgtccttacttaactctggatatagaatgaggtctctagtggttgcctccagacttgatcccctttaatccatccttacattactgccaaggtgatttttctgaagtgcaaatctattcattgcttcttttcttgtttcttttctcttttctttctctttctttcttagaaatgttactgagatttatttatttatctttcaacttttcttttaagttcaggggcacatgtgcagaatgggcaggtttgtgacacaggtaaacatgtgccatagtgatttactgcacagatcatcccatcacccaggtataaagcccagcatccactagctattcttctcttcctgatgctgtctctccctgcccttctttcttaaagcccatactttatcagcccaactctctatcgttacaaggcctttcatcatctgactaatcttatgcatttcccccaccataaatctaaagctgcacttgtactaatacgagcagtttactgaatgagccatactgtttcctgactcagagccttcacatatgttctctccactatttaggatgtctttccttctcttgtcttgctggcaaagtctactgattttttaagatacaacgtaagcactgtctgctttttttttttttttttttttagctcttttttagttaccattttttcttttttttctttctttactgtctgctttttaagtcttctggtcttccctcttcccaaccctaggtgttatatactcactgtatcatgttcattcattctcttgtgtttactaatgtgttgtaattaagtctctctttcctcctggactcaaaggcaggtttatatttgtcttattactttttgacttcctgttgcttgtttatgcatagttggctatcattacatgtttgaactctcagtaccaagattgatgtgttcatgatgtcagaagtgagttaaactcaaatctcagtcttatcctgttttcctaaaatttgggagtttctaaagtatcttattctcttgccctgtgaccataagctgatatgagaatggtagttcttagctttgtgtttaagaaataagacttctcgcactttaagaggtgatggttacactgttaaacttgcagaaaagtcttgtagaattttgaggcaactactaatccttatctctaaaattgctagaagagatattaactagtttgggtgttttaaatcttggacatcattatttggtagatattttaccttggctgctttttacttggaaaatgatagtagctgatgtatgcaggtttttatataggctttaataattgctttacatacattgccattcattttcaaaataaatcctaaacatttaataatttgctcagcgtcattatctactaagatgcagactatgactacatgtaggtctgactgtctccagactctatgctttttctaatactacactgttttctgaatatgactgcttattcagtgtttaaaattattaacatatttaattcattttgtaaattgaagaagtaggttgtaaagtttatcc

SEQ ID NO: 80323 - DNA, 1028 bp, Homo sapiens
acatggatgagcataaggatatataaaaatctgtgcaattgaaatgtagttgaatttgatctctactataaaataatctttataaaaataagattttaacaggtaggaataagcatcatcaatcagatcatggatttcaatttttttgcatagtttacatgttgaggtgatttaatcttttgaagaaaactaaggaatctcatcctcttataaaatgttagatattagaaataacttgtccaatcctatatttttatagttgaggaaatggctacccagtgacgtacccaagctttctggtggcacggccagtgccagatcccaggcctcctgactccattcagtgcactgtaccatgccttaaaccatactggagccacttggggagtttaaaaacttttatgcttctcttatccccagaccttttgatttaattggtatgggttagaacttggtcattggaagttttaaacacgccccaggtgattcatgcatcatagtctgggaacctctactccaaaaagaattagtgtgcttgaggaattggaactagagtgaaatcagtggtacagacttctatccgttatgattccttaatcacttatttggctgggttttatcagagtagtaagacaattttttacattgagaaataattaagatatatgcagagcaaagacttccttaataaaactgtcctttcactagtattttgtgagatagcctgtgacaaaatttttcctaatcatgaaattggagaacaattttttgacactaatcaggcaaggagaaagtttcgtgccatctgtgttgtggcatgctctgctgttgttttaactagataaaattctaattactgttaaacagattgtttatgaggttgtttttaatattttagagcaagtgcataaatataaagaggcaaagaaatggttccagatttaaaatacagtttctttaaaagtaaatcagaatttgacacactgggttgtttaattacacatttcagtttgggtccttggtactgc

SEQ ID NO: 80324 - DNA, 1025 bp, Homo sapiens
gtactaatttgggtgaaggaaagtagtagctacttttatagagataggtggttcaatctttaaaatgttactaggtaatgttgatttctgtgaacttagcatttcagtggccagtaaggtaaagcatcctgttgggtttagttcatatgtaaaaattcttattaattggcaacttttgaagagagctggaagtttaactgtgaatggtgtaatactaattaactgaagttttcttgattctttgaaaaagatgggaaaaaactcctgtgtttatggacattaaaatatagtagtgacttaaacacacgcaatgctacagagagaagagacaggaaatttactaacctactgaaacttttgacaggtgcagtgcatctttggaagtcagattttgattattattaataaaacagcctttgtttagtaagttgaacatcaagtgagaagattacatggagcagtaagcatacagatttgcaataggtactccattcagtgggttttaatgggtgtcaaaactaaactgaccttagtgaattatagctactgcacacacatggcttcagttagaaaggatatggtaccaggtaatgtcatcagtttttccaaatgtgttcctggggaaaataacctaaattcttgaagcagatcatttaacttataattggatgtaatattatgacaagaaaagaccttaaggcaaaaactgttccttatagaggctttttgtttttcatttgaaattagtgcagttgctgattggctttaaaaaaaaccctcatattcttttaaatataataatctgaaggtgttgctaaatttactagcccaactgagaaacaacagtatccttaaaaacaaataattgagtttaggttaaatggaaatagttggctaaatatgatttttaaaaataatacctaaggtacatgtaggaaccagatagattaaataacatgatagaaagtgttcagaagaggtagtacttttatacttagttttaaaaaatttaaattcctctacta

SEQ ID NO: 80325 - DNA, 1015 bp, Homo sapiens
gttcttagtaacctccattgccactgctgccacagctgtgatgggtggctgggcttgagagagtgaagagagaaaaaaacggggggatttgcacacttccttgtgagtcctaagagacccctttccctctctcaagccagaggtagagggcttctcctgaagctttccatttgggctgtattatgttcagtctggatgaaagcagagggggaaataaatggtaaacctgtggttgcttcagtggtacatcaaattctggttgttttaatcggcctgctactgttacttttcaaagttccttagtagttgttccatgcattctgtccaggtcttatagctacattaacttgttggcatgtgattaccccatcttatctggaactggaagctgacttaaggttttcaattttgtttctctaggaatttgacaagaaactgaagttttgattcagatatattttgaattgaaaccagagatgttctagagtttagattctttcatttgattaaggtaagattgtttgataaaatttaatcatacctttactgtacgttttcagtgatgtgctagaatttagattgtttcatttgattaaggtaagattgtttaataaaatttaattataccaatactatgcatttttagacttatattttaatgtgtatttgattaacacatttaaatttcccagtctaatctgagattctgacctcaggaaatattttcatggtttctttaccacttaaatagctaatgttccttgtaacaactactagattcaagggaaacatgattatacattcactggaagtgttatagactgatatcaaatctgtttgcctagagcaggagtcagcaaactatggcctatgggccagccacctattttggtaaataaagtttattggaacacagtcacacccacttaatacatattgtgtgtggccatcttagcactacattggcagagtttttagttggaacagtgtctgtatggcccacaagcctaaaatc

SEQ ID NO: 80326 - DNA, 1040 bp, Homo sapiens
attggagatgaatttgttgattgctttcaaaatttggagatgacatttgagacacgccttttaaaaaaattagcatgtagtagtagtagtaggaaataaatgacataaaaagtgcagggaaatgtagtataatggcaaacactggactaagataaatttgggttctgagcctataatctggtttcattttccagctgtatctcttaagagattttggacaagttgagacttgaaaaaactagtaaccgctctaaaagaaaaatggaacttacatttccacattcttgagtatatacacgtatctcatttagttctcaagacacctgtgaggtacctgtgagctagatagtactagtgctagtgtactaatgagaaaaccgtgattcagagaagtgaaataactggcagtggaagaaaagctagtaagtgattgagtcaacagttgactctatatcagtttccttatctgaaaaacgaaggtaataccactttgtagttatgagaattaagtgggattacattaataaggactcaaaactgctgctagtctcttcctctacccccctttttataaaggtccccacttcccagtctcttgacctgccattctgttaactattaattaataagagaaatttataatatggatattactcttatgtatctttaaaattgcaaaagattatgcagtgtctgaaggctgtatattaaatgtttctttttatcataaacattagaaaaaacattacttcaaattgcaagtagaatttgcagtattgtttattctaccagattatccttacatgtttccattagcgtattctcacaatcattttttctgatatcatgctttctgcattgctttgtgaagtagctcaaaactgcattctatataaaaaaattatcctaataataactcatttaaaaaccaatttggggctgggtgcggtggctcatgcctgtaatcccagcactttgggaggccaaggcaggtggatcacctgaggtcaggagttcaagaccagcctggccaacatggt

SEQ ID NO: 80327 - DNA, 1004 bp, Homo sapiens
tagctgcatatatgctccagactgcctatttctagatatattttatatgagtgaaaacccaagctggaacataagatggtttatttctggtgtctgttactaatagcaaaacctgttcctcacaggtacagatagcagtgtggtacaagcatctgactccctctaaccccacatctagttaccactgaaatgactataaatatatctaaatagagtgtaccagcattgaaaacaccaaaaaggaagtgttcacatacctgaaataccaacatcccaagaaaaagaaataactgcagtaggttgaaatgtatcaaatatgttaaaaatctgtgagttcatatgttacttttttttaaagctccttatgtttggggactagggagccaattcattattttgaaaattgataaagatttaatcattaattctgcccttcccatacaaactgtatatctcagggtaaccaagtagttggcaagagcaagattttctttatagaaatattttaactatacattaagaaggtctgatagaatatcacccattttgcaacttttaatgaaacaatcatcagtgattgctaaaagtaatattgggtgaactgctaaaggataactttataatggctttcctcttgtttttgggctacaacacagacatggctgaggctttagtagctttcttgggtcatataatggctttataatggattaggctgaaaatagggattaatcttaacatcataaaaagagagacagttgaacattatatacttcctgatgaaggttcacatctctatcatgaagtatccttgtgaaaaatcaaaccctacttttatcaaaccgccgagatcccgccactgcactccagcctgggcgacagagcgagactccgtctcaaaaaaaaaaaaaaaaaaaaaaaaaaagaaaagaaatattgaggagacagactctgaaataagattctgcaaccttaaaaatacaggaatgttgcactcaacacca

SEQ ID NO: 80328 - DNA, 1350 bp, Homo sapiens
aaatgcttcaaaatcaagaactttttaagcatcaacgtgatgctctaaagaaatactcagtgaagcgtttcagattttagatctggggtgctgaactgttaagtgtaatgcagatattcccaaatctgagaaaaatccaaaatccaaaacccttctggtcccaagcattttgggtacagcatactcaaactgtattaggtatttcttttggcctagggggcattgtgaaaaattactgagataccaagggagccacaaactaagaaagtttgaacatctctgctttagaagcttgagctaactaaggatttcaccaaaaggaggaagcacctcttacctttttttgtgctgaaaagtttgagtttgcaattttaaatctgatccaaaattgtcctaatacagttgttcaacattaaaaaaaaaaaaagcaaagaaaactttatcctatgaaatgccggtagtacatctttgcatgattttttttcttcttgcctccataggtatggtctgaatatgcgttgcttggcagctcgggtcaactataagactttgattattatctgcgcactcttcactttggtcacagtacttttgtggaataagtgttccagtgacaaagcaatccagtttccacggcgttcgagtagtggcttcagagtggatgggtttgaaaaaagagcagcagcatctgagagtaacaactatatgaaccacgtggccaaacaacagtctgaggaagcattccctcaggaacagcagaaagcaccccctgttgttgggggcttcaatagcaatgtgggaagtaaggtgttagggctcaaatatgaagaaattgactgtctcataaatgatgaacacacaattaaagggagacgagaggggaacgaagtctttcttccattcacttgggttgagaaatattttgatgtttatggaaaggtggttcagtatgatggctatgatcggtttgaattctctcatagctattccaaagtctatgcacagagagccccctatcaccccgatggtgtgtttatgtcttttgaaggctacaatgtggaagtccgagacagagtcaagtgcataagtggggttgaaggttggtatctgtctgcttcacttgcatttttcaagcatgattgtgttgaggaataagaaaatgttgttaattatacatcaagtacatagcttactgtcaaaagacctttcatcactctaatttagcagggaggaacaggttaagcctgaacctagggcaactttctagatgctatgacttaagggctgccataagaccaaacctgggcaaacagaattattttattaacgtaactcagaatctaaaattct

SEQ ID NO: 80329 - DNA, 1794 bp, Homo sapiens
gtaggaaacaggattatgaaacatgacatctgtagccatgagcaaaagtaacacacacaaaaagccagtccttaaaaggtaatttatagcgttgcactatttgttaacaaataatgaatgagagtgaaagaatacttaatttttgtttttcacatctggttaatttggtactagatctggtcattatgagagcagtattataaggaagcccacaacttcctgataaccctgtaagatcccccagaagtaaatcagtgaggaatggtattaggaataggcttgtaatgtctggatatgattattcattttgtttctctattttataggtgtgccattatctacacaatggggacctcaaggctatttctatccaatccagattgcacagtatggattaagtcattacagcaagaatctaactgagaaacctcctcacatagaggtatatgaaacagcagaagacagagacaaaaacaagcctaatgactggactgtgccaaagggctgctttatggcgaatgtggctgataagtctagattcaccaatgtcaaacagtttattgcaccaggtaagttatgtattatatgtgcctgctaattttatgttgatttatgggaccctgatagtcccttaaaattttaatatggtttaaaaaaacacataagcagaccctttatattacatatataaagtaacaaatggtgtcaccccaatgaaatctctaaaaaagatacagctaaaaagtcaaggttataaaaaggaatatttactatgtaaagagccaagccatagattgaatggtaaggtccaggttactgcacaatgtgtacctgcctccaggggtctatatctgataggaatgaagttcctccatttaatatttcagtacagtatagtttaatttttaaacttttgcagtaaatagaatggttttaaggagacagccatcttttcctttgcctattttttgccaatagcttttaattttttcaggataatagagcattaccaaagaggcctgtttcccatattggattttgttaatgtagtagattatctcaaacttcatgtaaagtcattttcattaataaaataattaacaaaatcaaattaactttatgcaacatttccccttttactaagacagtctcattaattagaatgtaatgcattttcctgcactaatcaatatcaatgagaattaatgagtccattacttaagaagacaatgaaataattttagttagcacctcaggtttaattctctatgggggaatgttgtcaagtacagaacttgttccccctcccaccagtcttgcagttggtaaataaaaagagaggaaaggttataagacctcttctgtattctctccttgttcttcattgatgactgtgtaatttacagaccctgaaagccacaatacaaacctactcattctagatagccttaagtaatgaatttatgagtactgaatgcagtgcaaataatagatgacctttaatttttattctgtcactagaactccttttctcccatggcattctgtgatattctggtacacagagcatctttgcttattgtaaacaacaggtttggctgagtgagaaagtacaactaaatttttaagaatatttagcttgtgatacctaagaggttattgcaacaggaaatgattagactatgcaaaagaacttttgggtgcactcaagaaacttatttttgcactagttaataatggttgtctggattagggtggaatcagcagccctcaccttgatctccttgagtgttt

SEQ ID NO: 80330 - DNA, 2104 bp, Homo sapiens
atgctttgatatacatatatgttgtgaaatgactgccataattaaattagttaacacatccatcacctcatagttacctttctttgtatggtgttggtggtggtgagaacatttaagagatattttagcacatttcaggcatacaatacagtattataagctgtagtcaccatgctgtacatcagacccctagatcttactcatcttatatctgaagtttgtaccctttgatcaacatctccccatttttcccacccccccagcccgacaaccaccattctactgtttctgtgagttcagttgtttggaggtccacatataagtgagatcatacagtatctttctctgacttgtcacacgtagcataattccttcaaggttcgtctatgttgtcacaaacggcaggatttccttctttgttatggctaatattctattctataggtatgtgtgtgtgtatacacacatgtgtgtgcacgtgcacacacacacacacatatttacaccatattttctttatctatactagacacttaggttgctcccatgccttggctattgtgaataatgctgcaaagaacatgggagtgcaggtatctttttgaggttattgatttcatttccttgggttgtataccaggaagtgggattgctggatcatatggtagttctatttttaattttttgaggaacctccatactgtttcctaatgactatgccaatttacattcccacccaaagtgcgcaagggtttccctttctccatatcctcaccagtacttcttatctcttcccttttttatgatagtcatcccaacaggtgtaaggtgatgatatatcattgtggttttgctttgcatttatttccctcgtgattaatgatgttgagcacctttttatataccttttggccactcgtgtcttctttgaaaaagtgtctattcagatcatttgcttattttttaatcagatttttttttgctatttgtataagttcctgatagattttggatattaacctcttatcagatatatgtttgtacatattctctcctattctataggttgcttttcattttgttgattgtttcccttgctgtgcaaaagctttttagtttgatgtagtcccacttgtttttctgtgccccttttgcttgtacatttgatgtcaaatctaaacaatcattgctaagaccaatgtcaaaagtattcttaaatgttgatcatcctttattgcctaaagtgcatatatatgtgtcacatataccaaaaataaacagttatagtaactactgggaataactggttaggagaggatgggtcatggctttcaaacaataaaaaaaaaacaaaactttctattagatttgaaggaggaatcttcagatagcctagtacctccagtagagctcagaaccttacctggtacattgccaaactggtttccaccatcccatttgctcccattcaggtcctcgtgaatgatgccaggaggttatttaacgtcctctgtatatctataaaatgggaattaaatgatttgtaagattgttgtgaagattataattgttggttggttaatttaaattgaggattgtgacttctgtcacttctcctagatgactcagtaacaccctctgctggtgttaaggtcttaggaaaattaatacattggctttttaaaaggttacatcccttgacatcgttcattactgagttctttggactggtttgtcatatgaagatataaggtgactgattaaaccatgtcatttcattaaatttgtgtaaataaaattgtaattctgggaggaaatgggtactcttccagcttccgaaattctgggaggaaatgggtacttttccagcttcctcacacttggacttctaaagatgggtcattgttatccagtttggccagaatagacgtcatagttaataatcccatctgatgagaatgaaaaaataagcactcaagatagtctgctccactgaatataatttaatcttgagtggttcataagtcagttcagaatcctgcagtgtttcagggatgttgtcctgaacttcagatcccattttactatagatgcagaaaaatgc

SEQ ID NO: 80331 - DNA, 1038 bp, Homo sapiens
tcagaattgtctgttccatccaatgaagtaattaagagccttgggacaaatataaccatactgcttgagtccagtgttgcaagagttaaatgatcaactcagcatactgacaccctccaagtatacactatcatcagttcacattcctttttccctttctttttttttttaagagacagagtctcattctgtcacccagaacaagagtggtgtgatcatagcttacttcagccttaaactcctgggctcaagcagtcctcccacgttggcctcccaagtacctaggactacacatgccactgcacttggctattgtattatattttttgtagagttagggtctcgctttcttgcccagactggtctcaagctcctcgcttcaagcagtcctcctgccttggcctccgaaactgctgagtgtgaccagttgtgcctggcccagttcacatttctgatctttgctcctggtgacacactaaagattttttcaaggattctgcaaagcatagatctgcttctatggctgcatctaagagaacctttctattgaatattctcataagaataccatctccaatatcatttgtctttttcacagtctgaacctgagtccgggaaacctggattctagtccctgctctacaactaattagcttttggcattgggcaaaccatttaaccttgcaaagcctacatatcttcacctctaaaatggagatgtaatataataattcctgccctaccagcttcagaagattaagtatcaagtgagataatacatgtgaatgcgttttggacatttaagctgtgaaaagatcaagataggaagatttccctttaatattttaaaatttgtactacgtatatttttgttgttcttattcttgctgctgctactgctattttaatatgctcagtttcttggtagatctagatgagcagtattcaaaatgtcatctttctgggaattagccatcattaatactataaatattcaagagaaattttctctttaataatttgtcaaataaaacagct

SEQ ID NO: 80332 - DNA, 3591 bp, Homo sapiens
tactatggcattgggcccagaacttcatggagcacagttaccagggacctggtcactgacctcaggaaaggagtgggtctttcaaacacaaaagctgtcaagccaaccaaaataatgcccaagaaggtggttaggttgattgcaaaaggtaagggattcctcgacaacattaccatctctaccacagcccacatggctgcattttttgctgctagtgattggctagtaaggaaccaggatgagaaaggtggctggccaattatggtgacccgtaagttaggggaagggttcaagtctttagagccaggatggtattctgccatggcccaagggcaagccatttctacattagtcagggcctatctgttaacaaaagaccatatattcctcaattcagctttaagggcaacagccccttataagtttctatctgagcagcatggagttaaagctgtgtttatgaataaacatgactggtatgaagaatatccaaccacacctagctcttttgttttaaatggctttatgtattctttaattgggctgtatgacttaaaagaaactgcaggggaaaaactcggaaaagaagcaaggtccttgtatgagcgtggcatggaatctcttaaagccatgctgcccttgtatgacactggctcaggaaccatctatgacctccgtcacttcatgcttggcatcgctcctaacctggctcgctgggactatcataccacccacatcaatcagttgcagctactcagtaccattgatgagtccccagtcttcaaagaatttgtcaagaggtggaaaagctaccttaaaggcagcagggcaaagcacaactagagctcacaaccaaaactgcacttcagcctctgctgtacacagaaactacaggctctgtctcaggagagcataggcacattttaaaaggttatgtactaggtttttgtggattctatcaaagtgataagtgatccttaaaaccagccttctaaaataattgcattccatgggttgggtatttagaaatgtaggtggcatttagaacacaatgtttaatcaatgggctgaacaaagatgcttcactttgccttgcccatcaccctatacagtttcgcagatagtctagtcactctatgtgagaaagataatggtaagtagttgctactggccaactgtctagcacttacctgaaaacttagtatggagctcttttaaaatgtgattatttatatttatgttgaaagcggactttaaaaaaaataatgtgctgtaacacagtaaatatgtacttgtagcctggatagcagactgtgttcaactttttaaaaagatgtttcctttctaaagattaatttcttgggagcaaatgagtatttgttgcatttgttcaatttgttgtatatggtgaatatttaattatggttttcttgaaacgtgtaaattaaaaacacaatcagtgttcaggcttcagttatataatgtaagcacaactaaaatgaaacttgttgactgcacaagaaattacaaaaatgtttctgttttgaaacttgatctacaatcagtaaaagtttgataatcagtatatcccttcccaacccccattgtgacagtttctttttgtcactgtctagaattttgtattttatttcagactataccttggagttttgtatattttgagagagatatttttgggacattattttggaaacttattacaaatctaaatttggaaaggagctagtagctttaaggccaccaccatattttacttttttaggatttttccccctttaaataaaaatattagatcaaatactatatgcaagaaatcatagcaaagtttttttttcctaccaagatcattcttgatcatcagcttcccaaactagtaagtctgtgcatcattgggtgtttttttttaatttaattttaaattatcccagctattagatagaagggatgttactgcacttatgtgtaatcagatctttatttaggtatacatatcctcctataccgcacataaatagatttcagagcccccatacaatgggcagtgtctgctatagggcttcaggcattaaataaaaccgagggttgttgattttgctgtgacagtacactaaatcaatactatatcttatacagtttgaaaatatgataccctacactttcaggggaccgagtctgacaaacacaatacatttatctgtgacctatatcaagtacacatttaggagccaggtaggttacctgcttacacactatattttaattgaattcaaactatcaagcactacttagaaactggaaaacatatatatgttagcatcaaagggggcagaagcaaagaagatacagatctgcactgaagacattagactggccatagaaaagtaagcttgaactcccaattgatgtgaccacactcttcttaattttgttcacagtaaaaacacttttttgagttattaggcttacccctagcttttgacctttgcatttcatatatgttagatgtctcagcaagaatatctggtctcccctaatttttattcccagtgccgatgttcaaaataaactttctccagtctgggaaccttttttacttccccatatttgttattatttagaatggttcatacgtctgctttgtttgcatactggtcttcagattatgagactcgatgataacagtatggtactgcttctgtgacaaatatcgtgccttaacaatgtggctgtccttttccactgaagaaggaaagacgttttgatctagaaatagcgttgtgatttccttgctgttggttttacactgccttccacattgcaacagcaagttgatttcttgtgatcccagaattttctaagaggatgagttgaatctatagcagcattgtcagtacagaccagtggttctcaaactttaaaatgcctcagcatcacttgggagcttattgaaatgcagatcccagagtcagtaaatctgcctgtgaagtatgatagtctgcatttgtaatgagcattcaagtgattctgatgcaggtgagctgggggcatacagggaggaacactgccctggactatccattgcatttttgcctctaaacaactacagaattttctagggttttaaattatgtaaaatgtttacttattctgagcttagagagaatggggagggtatttttaaattttattgttttatttctttaagtttttctttgctttaagattataggtattaggtttgtttttgtttttccacttatcttgagttcactttgatgttaaatctattgctacttcagttgtaaaaccagccaaaagtttctggatgaaggtcaagtttgaccttttaggagttattgtacataaaggcttcatccacgaaccatccagcgcacagaagcaagtgcaaaaatgacacaagcacaactctccagacgtggctccttctcctttctcagtgcagactctcactgaaagctgctattttcatcctccttgtggttgcttttcttgtttctcttccattgtacatgtgggttatataccatatgttaaatatgcaataaagtg

SEQ ID NO: 80333 - DNA, 1048 bp, Homo sapiens
caagctggttgtgaggattccgtgagcaggaattgcagaattcatgtgaatagcgcctgaggtcccctgatcctactctgcctcttctctttccctgctatccaaatctgccattatttactgctggccaaaaatgcccagtgattttccccaggtggtttgcagtttaatagctagaaaaaccaaaggcttgaaactgtcacggtagaattgtaggcattggctagcaggtgcatgcaagtcttggccatgcaagaaggctttcctggatgctgagcttgaggcaggaactgaaagggaaaacttgctgatgtgcccttctgctcctagttcctggaggttctctcttctaaataggctgcatatgatttgatttcatttcactctaaattgctcagcctgcaactaggggtgcaaggtggagtcctacaaatcaattctgctgtgcaaataagcaggcacctgcttacttgggggtgcttagaaatgaggccaagctacgaagtgttgaggaaatgattgcagttttcctttggggtcaaactgggtttagaatacaaaattgtcttcaaatattagtttgtcctttcaatgtatgtaccatgcgttttatgaaggtctgctctatgcaaaacactttgctaaggctagagtgggaagacggagagaatgtttcttctttcctgtgctcacaggagctcagagcaggagtgcaactaagacctagtaatagggttccatagacagaggttcaagttggggagggcagggcaggtcagtcctcttagtctaagctggaacatcattgtcctgggacagagggactccttttattatcctgtatccgtccatttatttttttggaaaggctgctttaaatcttgcccctattacgtggccaatattgggcttcccatccttgtctggggtcagcatagcaggtcagatggaggcaggtttttttaatctgggctcagccctggctttggtggcaaaatatcctccccaggtctggggccagattcctaaatgaggtcaagttgtccaa

SEQ ID NO: 80334 - DNA, 1017 bp, Homo sapiens
agaacacatgacaccccgctgtggacttttaagaaaaaaactgacaaactccaaatccataatgacatgagaacttacactttgaaggcagaatggacttgtgggaagagaggactccccttctgttctcccttcactaggtggagaagggaagaagggctctccccagacagctctcttcattctggaatgttttgccagtccccaaggcactcagtgaccaactttctttcacaggtcctcccagtgactgacctggctcattctccgaaagtggttgacaggccactacgagagctcttgagagaagctttgtgacatgaaattcatcaaatgaagcaagattcatttttaaagaataatacaaagctccagagtaatatgcttaatccaaatgtttaaatagaatttaaaaccacattttaagtaaatttaaaattaatgaaatatcaatagtttgccttaacaaggacttgcttgaaccatattctccttttaaaatcacacacacagaatcagtgtacatttagagaaatttccccagctgaataacatttttgacatgaattcattcaaaagacaccaaccattatgaatattttaggccatgataagctgtaaccacctccggcttatggtggttaggatgttgcagcttaatgttgacatctggcatgaaaagcttatggtctgagtcatgtttcttttttatgtaattctggcttgggaatccgatacagagcagctgagaaataaattatgttgctgaggctgaagatgatgcacagaagtatggctccagctatctgagagaaagagaagggcttggaggtggccaggagccattccttcctcagagtcttgtccagaagtatggcttccatctgcatgtgcgtggccaggatcacacacacgtgaaacagctggtgactgtgacctatggcaaacacaaaaggccgtcaagatcagcaatgaaaaggaatgagtactgatacatgctatggcattcatgctaaa

SEQ ID NO: 80335 - DNA, 1143 bp, Homo sapiens
taatgtggtgacttgggagccagagagacggagcctgagacttggagcagggcacagcacaggaatacaacacttttcaccagaacgacattccgacctctgaatcaaccctggaaaggcccttccattgaacttcttgtgatggaggaaaagaaaccctcagtttcgtcatcgcaaggcggaagagtttaaataccatacctcaagatctccctccagccctgacacgcgactccgcggccctttcagcgtcggtcgcctaggagacaagcgccacttccggcagcgaagtcacttccgcggaggtcctgcctctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgtgagtacgaggccgccgagcagggagagagggcggacgggggccgaggcctcggggctgggggcaggcgtctccactcaggccgcggccgtacgcgggcagcgcggacagcatcccgcccggtgctgctgcggccgcgaccccaaagtgggaacctccacgtgtggccgctccgcgggagcctgggcgcggagacccctgccgcgtcgccccccgccgccccgcctgggcctccaaggggccaggaagggtcggcccggagccggggttgttttacgccgcacccggttcccgggggcggggcagtcctcctcggggtcccgggacagcctttcccttctccctcgctggctgccgccgcctccagagtgcagttggccaacttagtgcgggtcggaggtggtctcgtgtgtggagcagagcgagtgtgctgggcattggttagatgggctccgtttctggagagccctggcaccggtgatcgccgctagcttttttttcagccgagcaccctgtccttgaggccgagcccatccgcttacacaggccagttacttctgctgtattttgtggccgcagagaacctccgcccacattcctaagctaatattttcggc

SEQ ID NO: 80336 - DNA, 1005 bp, Homo sapiens
atggcgaaaccctgtctctactaaaattacaaaaattagctgggtgtggtggtgggtgcctgtaatcccagctactcgggaggctgaggcaggagaattgcttgaacccaggaggttgcagtgagctgagatcatgccattgcactccagcctgggtgacaagagagaaactctgtctctaaataaataaataaataaaaatgtctttgtatattaaatgttgggttaagctgacaagtttttaaattgacatccatttccaagaaattctaacagttttaaaaatctcgtgtgacatgttgttgacttttagagatattagtagtagtataactattatttgtgtacaatataatagtgaatacactgcaatttgatttttattaaaatttattttaattttgtgtgtatttaaagtattctcatatctaatacatacttgtatttgtcaatctcaagtagcagattttaattttcttagcccttggagatacagagctcttaaattgagagactgaatgtttgttgaatgaatgaatgaatgagaagcttaagtgaaaaatcaggcaaaaggtcgaactttcttcttaaagcaccttcctatttcttcaggtatactgtagggtgcgcccactgggctttcctgatcaagagtgttgcatagaagtgatcaataatacaactgttcagcttcatactcctgagggctacagactcaaccgaaatggagactataaggaggtaattctgatttggaccaagttgtttttactcaatatgttgtttcctgaatgacttctagatttttagatgtaacaaagttcatttgtgagcccacattttcaaaagacttatttacttcattataaccactgtatctaaagtgtttttgacttctgggatgcacagacatacctttggtatgctggggttagaggattgcttttagcagataatttcttacactgagtattattgtttcttagagcatgtgttagggatgat

SEQ ID NO: 80337 - DNA, 3496 bp, Homo sapiens
gactaagacacctatggatacagtagtagtaaagaagaaccaaagcactggattcattttgaaaccttaactgttccttagtttttaaacatatttcttactatttaagttaaattctaaaaaacgtggtgtgatttttttttttttgcccccacttcaggttttcaaatctaatgataggaatagtatggatatacagtgtgaggttgatgccttattagaacgtcagaaaagagaagctatgcccaatccaaagacttcttctagcaagtaagtaattatatttgtctgcagcactggcctaggggcacaggattctttcctgtggtttgcccagacatgaggaatggtgaacattaaatagagaagttgacttttgtgagattaaagttaaggaatgttcttaagttctttgctcagatgttttctctttggctttgagcacattttgtttcaatcactgttttaagagggtgccactctggatggggagagggtataaaagccattgttgtgtgttcgggaggacgtgggaatactgttggcaaaccatgagtatgaataaagctgctttgtgcatttctgcttgtaattgcagatatttattttatctgttagtttccccttgggatcagttacttttttttttttttgagacagagtctcactttgctgcccagggtggagtgcagtggcatgatctcggctcactgcaacctctgccttccaggttcaaacgatcctcctgcctcagcccccctagtagctgggattagaggcacacgccaccatgcccggctaatttgtatttttagtagagacggggtttcaccatgttggccaggctggtcttgagttcctgatctcaggtgatccgcctgcctcggcctcccaaagtgctgggattatagctgtgagccaccatgcccggctgggatcatttacttttaaaatggacttataacgtatacaattgaacttttctttttttagacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaagtaagtaataaagagagccccttcttagctgttaatgttggggaagttactttgcctcaaggagttttagtttcttcagttatgaaagagaataatgcttgcatttgttttcagaatgaaatgatataatttgtatatcacgtggttttgtgtttgagtatgtttattattaactagatatgtacctgtattagggaactagtgggttaaagcatctaaggagaagagggacccaaatattcatcttggagattacttttgaaaactctgggccctgggctatgttttgagaaggatcttaattatataattaagaacgtttcaagaacctgagacagtaaaaggagttttgtaggctctttaaccacccgtgtcttggtgatttctacagactggagcctaaagctgttatctatacaagtaatacttacatatcttctatcattcattaatatggtatgatatctgcactgtaattccatcagagttgaaatactacttcctagatttccttgggtcttgcctttctgagacgtaagactggttaccacttggcatcacaaatgataaatctgcatttgtgccagagttgaccctgggatcttatgtttaatattagtatcttgttcctgagttgatggttttgtttttcagctaaaggcttgtctttaatgctgtctttattagggcctctcaggacataaataatacgaagacctgtggcttatatttaactttgtatatctaagggaacattattggagaaacagctggatttagaaaatcattagactgagaatacataccagtatatccacttttaattacatgaagaatttatggactctggttgaggccatacttgatacaagcatttctgtggttcttagtgagtcacattttgatacagttatcttcaccagagtccttgaattttcatcacgtttattgggaaaacaattacaatatggctaagtaagctaaatgtaaaaatattaacactcttaatactaagagtttatgccaaggaagactctttggctctgtttaacatttcttcaagtgagaactttacaaagggacttatttctggagtgacctatctatatttacccttggaatgttggtaatagtaaaaatacttgggttaggttgtggagcaatacatggaagagttaaaaccttgtgagacagttactttttatttatttttgagacagggtcttgctctgccatgtcagctcactgcagccaacctcctgggttcaggtgatcctcccgccttagcctcctaagtagctggaactacaagcacaagccaccatgcctggctaattttctaatttcttgtagagataggagtgataggggtctcactaggttgcccaggttggtctcgaactcctggcctcaagcagtcctcccaccttggtctcccaaagtgctgggattacaagtgtgagccaccatgcctggcctgaccatcactttttatatcaaactaattactttcccatttgttttaaagtgtcaactgtcttgactctaatcttgagtatacccattttcatgtatgctcgtgtgccaactttttgtttggtttgttctaaatgagattattttcaaaggatcatatcttggctttatttagttatacaaaagaagattgacaaaagtaccttgtgtgctttgtaacctttctgggtaactccttaaatgaacatacaagggtgcttgtttggccctgaattcagatttaatttgttaggttggtgttagacctgcttttttaagctagttaacttttagtacttttaatacaatgaaaaactattacaagtggagggtttttaagatatgactcattgtgattgtcacatagtctggactgaacatgttggtgtgagatggctgctgtagaaacagtaacttctaccttattcctttggtaggtggaacagttgcagcacacccatgaggaacacagattttgtgtatgtgatggtgttggctcttttcttaaggagaagggtgcagttatactatggttggcattctgtggcatgtttgcatgtaggttattttccattgtcactgggctggctgctgtctctaagccctccttgcttcctgaaaaatctgctattgactatcagtgatggtggctggtaaatgtctctaccctcaccattcacaagacttaagaccaaacaggtagctctcatacccaaccttcatcttgtcatacagactaaaacttcataagccactttgaaaggattgccactcctggtatataccaaactctttctgaatttgttttctgctgttg

SEQ ID NO: 80338 - DNA, 1741 bp, Homo sapiens
acaccgcgttggcatctccctggtgtggtccccatagttcctccccacacagacgatattcttcccccacccccagaagcgggacggtggcctgggggtcgccatgattcctgtcaattgcctagagaatatattttaatatgaggatattaaacatctctatataagatattccttcagagaatttaggatttggaagaaaccttatagtcattaactgtaatgttgcattttgtggaaaatcctgttggtagaatccctgaaggatggctgtttaaccttcccagaaatactgctattgaaagagagcctggaccatgcatagacagctctttatattgagccacaaaaatttgttatttataatttctatctagtagttgtttgaagttgagattttataggcaaacagaacacactttagctactatactgttgttctgaaatggcgtctatgtatttttttctgtcaggtaatattaatcagtcactaatgacgctaagaacatgtatggatgtcctaagagagaaccaaatgtatggaactaacaaggtaagcagcagccttctctgttcttttgtatagtttcatttgtgtgcattttttttgcgtaacacatttggatatgaatgtctttgtagatggttccatatcgagattcaaagttaacccatctgttcaagaactactttgatggggaaggaaaagtgcggatgatcgtgtgtgtgaaccccaaggctgaagattatgaagaaaacttggtaattttaatgtatttgtcctataaagtcttgagtttttgtcgggaaaacagttacttggatgagcagaatgacattttgaatattttaaaaatggatagagaaccattgattgtagaagtaaactaggcttggtgtggtggcttatgcttataatcccaacatgttgggaagctgaggtgggacgatcaattgggcccacctgggaggtcgaagctgcagtgagtcgtgttcatgccactgcactccagcctggtgacagactgtctcaaataaataaaaataagcaatctttgcttcatttagtaatttctgggacttggatatccttatttttttttaaactccatttgttttgtgttttagcaagtcatgagatttgcggaagtgactcaagaagttgaagtagcaagacctgtagacaaggcaatatgtggtttaacgcctgggaggagatacagaaaccagcctcgaggtccagttggaaatggtatgatttggtgttgtatcatttgtccactcattggtctgtctgtttctctcttttttaaaaaaaattatttcatttaagagaaatgtttacataccttctgaagaaccaagcacataataatttgaacaaaatttaaatgagcttattttgcatactatgattcttaggtaagtaaacttatgtcagctcaagaaattgcaatggttagttgcactggggctgtatgcagtgttaaacttgtttaaataagctctttctctcctatgtaactttttgtaattttctataattcaatacagaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatgtaagggcaaaactatttgaaataattt

SEQ ID NO: 80339 - DNA, 1076 bp, Homo sapiens
aaatttccatactgaaatgaaatttgcccagaaatattaattaactcgcctaagtcataactagtaagtgatgttccaaggatttcagctcaggtttaattaatcccaaatagtagtgttgtttctatttttgcgtttgttgttgtgaagcaaagtacctgtaaggattgggaagagaatgctatagtgcacagtgaaagacttgagtattttttcagcatttaacagaaagcttctgtgaatatcttgtcaactggagaatgaagctcctgatttccctctaaacttgttttctcattatagactgattctcacagagatttgctgaataactacattttatctagtgtctgctagcaaaagttgatatcattgtttgttttagaactggtgtaaaacttgacctgtatgtttttgtttcagctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataaggtttgttttgacattattatgatagatgtatgtgctggtgttttagcactgttctctgagggagatattgtgctccaacggcctgtaaatgctgcttattaagagttctcggttgagtgcggtggctcatgcaggtaattccaacactttgggaggctgaggtggccagatcatctgaggtcaggagttcaagaacgagcctggccaacatggcaaaagcccatctctactaaaaaagtacaaaagttagctgggcgtggtggcgagtgcctgtaatcccagctactcaggaggctgaggcaggagaatcgcttgaactggggaggtggaggttgcagtgagccgagattgagccactgcactccagcctgggcgacaagagcaagactctgtctcaaaaaaaaaaagagttctcaggctgagtgcgggggctcatgcctgtagtctcagcacattgggaggccaaggcagggagatcacttgagcccaggagtt

SEQ ID NO: 80340 - DNA, 4050 bp, Homo sapiens
ggacgtaacagatactcagtaaagcttaattggatctgtatttggtttacaaatcgattgtaaaagtataaactcaggattaatctcttacaatggggtagaaggaaataccgttttgttgggaagcattgcagcactgtgtaatgtatgtctgttctctcatttacagagggtcatttagaggtttggtgggggtacacattcataagagaagttagtctcaaccaatatagtttttttaaattctgaaaatagcctaaaaactaaattttagcccttaattttaggagaaagtaattttcacatgaagttagttgtaaatgtctttgggtgaggagcttgtttaacatgttttcatttctgagaatgggggtgggaattcagatgaaatgttagagaaaaaagtgctttctccatgatgtttctttccacaaatatgcttgcataagcaaattaaggaagactattttatagcgacatgaaatgtttatataccaaatattgaacatagtggtctaccttcctagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgtgagtatcgtttgggtagtgcttgtctcagagtcggatgatttattttacattgtagttaggttcgatattttgaattattgtatttgcggtagggttttggtggtggttgttaactctcaggaagaattggagaactgtcatttttaggaaataaagagattgggtaatctggtgtactcgtttgctgtgatggaatgataatatacattgccactgataatctgtaggagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctgtaagttatttgtaattgtgtagtaactttgtactagagaaattttgttcagattagatgactatttctatgaggatttttacattttataatacttacatttctgaaatttctctaaaaatattttaaaatttagaataaacacaaatttagcacaaaaaaatagaacaaataattatttgtaatgttaagtcttcatgtgctaacattatagaaaagtaatgaattgtttctctcagtttttcagtcttgctcattaatttttctccaatttttctagctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcagggttagtgccagtattattttaacgcattgtagcaatagattttatcttctttgttttttgtaacttgtgtctgaaagttcattggaaaaatggttgggctatagtataaagaaggtctaatttctcagttaatttgaaagattgacttacggaaattgaggcctggctcctcatctgaaaaagcctaaacacatctggcagcggaagtgtgttcagtgaacacaggtcagtttggtgcatcccagagtagtctgagcttttcagctgcatacgctaataagctttgcacagaattggtgaatgtgtcttaaagcatactttccatatttttcttttggttccccttccccaaattagattttttatacctcctttcatgccctagttttaaaaattgttttcccaaatttttattttgaaaaatttcagacccaaagcaaagtagaaagaatagtatggtaatgtctttccctccttgcctaagtttaccaattgttacttgatatagatatgtaaacctttttcccctaagccttgtgaaaggaaatcacagacttagagacacttaatctctaagaataaggacattgtactacctagccacaatctttatcacatccaagaaaatcaacattaattaattatcctctattgagacattgtgcagttgtcccaaaattggattggcttttctttttttttttttaaagacagagtctcactctgtcacccaggatggagtgcagtggcatgattatggctcactgcagcctcagtcttcctgagctgaagtgatcctctcacctcagcctcccaagtagctgagattacgggcaggccaccatgctaattttttattttcagtagagacaaggtctcaccatgttgcccaggctggtattgaactcttgaactccagcaatcctcctgccttggcctccaaaggtgctgagattacaggcaagccactgcaccagccagcttttttttcaatccatgatactatgaaagtgtatgcattgcatatcatgattatgtctttcatctcttttaatataaaatagtctcaccctgtccccctactttttttatttttatgacattgactattttcattgaagagtttaggccagttattttaaaattactgatttccatgcccaataaattgcttttaatcttgaggcatttatctcaatttacatttgcctcattcaagggtatttaaataaattcactttcatatttttcttcttaaagattaaggtaaagtttcttttgaatctgaataaatggaccaagttaatgtttgcgaattttatatttagtaaaatcttcacaaagctctcttagaatatttcttctaaatcttacagtaaacatttactttagattttcttatataagtcagggtatagatgaatgttcatttatgtggcctgaattcctgattattaagggatggtgatgaatcccaagttatttaccagggaaacagatgattctaaagtctcttaagttctttactttgcagatttttccttaaacatttttagacagcaaattaggtaaatggtcattctgaccaactctagtcagtcattttatgaaagtttataggctgaaaactattcaaggcttgcgtatgccttgcaaaccgtaatgagatatctaatttggctatgagatatttaagggaatttactagagattcttacgtgaaatcaaaatctctttagaagtgcagcagaaaagttactgtaaggttagtatctgtgcatctaagtttgttggtcaaaaattatgtcaggtggactgaatttatacttcagtgaggaaaaaatttaaatatttgtttcataaatgctagtagattgtatggattatcatctttctgaagtgtgtttcatcatatgcttattgttaaatgtttgaagaaaacctttgtttttgctaaatggtagatgataaggaccagactttctttcgtgttcaacattaaataaatcattgtaggaatggaaagttcctgtttgtcttgaggctcagcatctttagtggcaaactgtattgcccatgtcttagagctgtcactagtgctgcatttgtttcttgttaactatatagcgaaaatgattcagttcctcagatgtgcattttgaaattgaggtcttcatacttgactagctttgacagatttggcctgtgatagactttttccatttgctttcagttttgttttttgggttttttttttttttttttttttttttttttgagatgaggtcttgatctgttgcccaggctggagtgcagtggtgtcatctaggctcactgcagccttgac

SEQ ID NO: 80341 - DNA, 4652 bp, Homo sapiens
atatgtgacatattattttcttaggctgaatgtgcttaatttagcattcccaggtttacatgacatttgactggaagcaacttgtttgtttttgaggcagggtctcattctattgcccaggctggagtgcagtggtgcgatcttggctcactgcaatttccacctcctgggctcaagcaatcctcccacctcaacctcctgagtagctgggactacaggcacgtgtcaccaagcccagctaatatatatatatatatttttgtttgttttgttttgttttgtttttgttgagtctgggtttcaccatgttgcctaggctgaacttgaacttctgagttcaagtgattcctccacctcggccttccaaagtgctgattacaggcatgtaccaccatgcctggcctagcaactagtcttttattgtgtgatagagactgatttgacactgtattatttatttgtttcttggaacctgtatgaaatgtttgggggaaaaattagttggtatattgtagccattactgtatttgaacttttcatgaagttctattatgagattttaaaatcttaactgaaagcactcagaagtatttcacatttctttaatcattttattcatatggttcttattatacctatgttcttaggattgttttctgttttgtttagaagcctagaaaatgtgtagggctttcattgatcttattgaagattttaacagagttgtggacataatagattacctctcaatagcagggataaatattggtttttgatcaagaatatgaaatgagttgtttgtcctgaaccacccccaagcaggaaagacttgcagcattaccagaattttttcttttatcctttattgaaagggaaactcccagatagaatgtgtaacatacaagttggtgttaaagatgtttgttggttttgtgtttaaatgcaaagatcatgtttaaattacttgaataaaatatttagctttggaaaggtttgctatgatactgtcatcaactaatgtagccaaacctgctgcacttctaataatacccttaaattaattctgggttatgcttgtttctcagttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaaggtaaaaaactaattttcacaggagaaaaaaatatatttaaaaattcaacaaaagtccatttgtcctgctactcctttggtgacacacaggtagtgtcaactggaacatcagtaggtatttgatataacctttttgttagcagaaaattagtcactgcttaggttttaagtctgccaaactgggactaagtatgctttaaataggtatagattcttcggtttcttagaattctagatccatgatgtactttaattttttaatgactgtatatttagttttaaccactacttaaagtaatctaagcaaagaattcctattgctctccatcagttcaagataaaaaaacaaaaacaaaacaaaacgaaacctatgttaaaatttgacccgtcaaaattactcagtattgagctgcctaaagccgttttccagaaagagacttgcctgactatagaagaattcccctttgatcatagggtcagtgaataatcaggaaagtaaaagataagaccaaaaaaaaaaaaagctttttatttcaatttcaatttagagtttttgttcttattataattagctacaaataagactatactgtcatttgaatatgggcaacagggggcactcagagaagaaagtaccatgccttagagcgtgtagaaacttccagcaaatttcttgatccttagtgcagtttagtttttaaattacagatggagcaaaaggaatatttttttctgcaattatgaatgttactgattacattgaattggacttcttttatttgtgagagatatgtactcaaatttctaaattattttgatagtacgtactcagcaagtaccaagtaccatctgattttgtggatgggaatttctataaaatagaatcatgagaacagtttgaaatatatatgtgtgtttttcgtttgggtgtatcaatgtgtaacagtgaccttttcttttggctttagggtgatatttataaaacaaggggtggtggacaatctgttcagtttactgatattgagactttaaagcaagaatcaccaaatgggtaagtaaccatcaaaaatctctgtataaaagttggtcattttcttagctgctcattttggaggaacagaatagcctgtgaaatgtatcattaattctccaaagggatgtagatagtattcccctacttctaatatttttcctcttcttagatggaaaaataattgttgcatcatgtttcccctttttcagtagtcgaaaacgaagatcttccacagtagcacctgcccaaccagatggtgcagagtctgaatggaccgatgtagaaacaagggtaggggaaaaattaaatatttgtctgcctactaaaattaggtttgtcatgttttaaaccccacagctctagatttttatgctctttgaaaatgctgaggtataatctcacattgccagtgcaccatgtaggcctattcctagaataacaagaatccacttcatcaggaactcccttgcaagtgttattcctgaggagaatctcttggaaagaacatgggaaggtaggggtcaggaggctaagctatggccttagccaccaactctctttgcaaacttatctaaaatgagataagttacctggatgacctaaagacctttctggctcacaacatttgtggcctgtgccagaaataaattacgagtgactggtgttttaacgtaagagtctttgctgaactagaaagcaatattgcatttcacctaggtgtggagcctgctaaataactgtgttttatagactattgagaggagctgatctttttcctcttgtcattttcctctcagtgttctgtggctgtggagatgagagcaggatcccagctgggacctggatatcagcatcacgcacaacccaagtgagtactgactgtaattggggtcttgctgtgtgcttttttcctcctctggtctttacattatcactccttctaccagccatccacttattcttcagaagaaatatatggttttggttttccccttggactatctgggcctccatgggcagactgcagtaggcagctggaatgctgagagcctcagaaggctggataagagcaatcagagctgcaaggcaggcggtggtggaagattggtggctcatgttcatattctgccaacgctcataaagctttctgaggctgaactgagagtacctctaaggagggaaggctaaaggcttaagttggagactagacagctttgtgtaaatcattgtttcctgacttgcttcttggtcttggtgtagcaataggtgttcactaaaataaataacactgaatgaaagaatttatagtagggaaggaatcataccttttcttcttctgttaaacttatactcaggagtctgacccagtctttttccatattttaataaaatcccttctttacaaatacatacatatatgtatatcacatgttatatacatatatgtatataaaatgttatatgtatataacattttaaacatttacataccttactgagcaatttagaaaattgttgcagcaggataaagatgggaaatcctttctaaatttaatactaagataagcatattttataaaagttgtttgctttctcagagggacttgaattatctcatcataaaacagcagttctcaaaggcctcctaaagattgatttgctatgaatgtgttactaattgcaaagttcaactctaagtgctggttgttatgttttaggcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtatatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattct

SEQ ID NO: 80342 - DNA, 1054 bp, Homo sapiens
cccttactctcagggtcagcgccggctgggaaggccgcgacctaaccaggagattacgaacaatgtcaccagggccacagcggagctcctgccaagtcaagcaactcatggaaccaacggaggcgaagtccgaatacctaggcaaccctaacctaaaagtgtttttaacgttctcaggtcctataatttacccaaataaagtgggaccgtatttgcaggcgctgagaaactttctcaacagtaagaaccaatcaggcgcagtgcgcaggcgccttcagtgggtcctgggtccgcctcttccgcccggtgcgggcgccgattggtccgcgtggacacataagaggctgcgtataggcgcgagagcccctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggtgagtgcgggcgcgggccggcggccgggctgcctgtgggcggtgactttcggctctccatgcggttcccggctccaggccgttcgactgagcacttccggccggggccaggccgcgaacacaggccgcatagggcgggcgctcctcggggctggggcctctctccgggcaggtcctgggcccccgggaccacgtgcgggcccagcgggcatggagtgcgcttgaggctgggcgctccggctccaagagccttcgtgtagaaaagctcttccgcagtgcttgggcaccctgacccgtgcctcgtctctctcagggacacttactcggacctctttcggtgtaattgccttgaattcccccggtcgtggaggaaggcgcccgagctcggctccacctcccaggtcttgtaacttaaaaatagccgcgtgactcaggcaagtcccagcccgtgaaacagcagtgatgggctcgcctcattgcagggcgcc

SEQ ID NO: 80343 - DNA, 1085 bp, Homo sapiens
tggcacctctccagcgctggcgcgtgaaggtcgcaggcccacagttgagctttttttttttttgagacggagtttcgctcttgttgccgaggctggagtgcaatggcgcaatcttggctcactgcaacctccgcctgccgggtacaagcgagtctcctgtctcagcctcccaagtagctcggattataggcatgagccactacgcctggctaatttagtagagacgtagtttcaccatgttggtcaggctggtcgcgaactttgatccacccaccttgccctcccaaagtgctgggattacaggcgtgcgccacagcgcccggccgacagtcgagcttttagagcccgcggcgcgcccaccaacgcagggccgggaggaaaaggcgggccgagaggcggggctggaggccgagtgtggccgagggaagccgaactttccagtttcgctgaggcctgttaaccgctgggggcgccttcgggacagctggcttctgcgcatgctcttgaccctccgtcccccggaggaatgtcttaagtcaggagctgattagtggttgaaggcagctgatctgtttcgaatcctgtgtgtccggagaggccaacgctttcattagccagcaggaatgggctggggcgcgtttgtagttgggaatcctgagcccgggctgttgcttggaggactcgggagcagcagtggatttcggcgttaccaggagaggtctcgagcaccagatccctcttccttcacttcccagtagtgggttctagccgttcccagcgccttcatttccagaaggcgattttacccagagaaaggagagggaagatttgctctacctttggcttcttatcaaatagctaaatcacgtgggaagctggtaaacaaaaacaaaaatgaatgaaacaaacaactaaacagcttgccgggcccctccaaggcccaccgaaccagcccctcgaggcagccaccgggaattttcataagctcttctgatgagcgggaggataagtcagtcagggctggaaactcccggatcagagcaaacccagctcctcagcacctgaggagaagacgcgtagtcaat

SEQ ID NO: 80344 - DNA, 2516 bp, Homo sapiens
ctcatcaggctgtgggcctgagctgctgacgccagctcctagcttggaaatgcttcttcctatttgtaaactcggaggagaagctcttgctaaagcgtcctgttctgatcattatgacttactgtaaagatcacgtgggagactgttactgagcttttccttatggaaaagcaggtgggaggggagctctacctgaaaatgcttcatgggtgctttaaagcctcccccacctcctcttcaccgcactgtgctccaggtcggagcatcagagaggggcagaggagggcaattgttgccgagagaaccgagatggtgttgagcactggaaaatgaattcctgtcttttttctccctgcaccccacgccttcctgctgcttctcctcgtcttcctcctccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgctttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctccccccagtttgccagtcccgccccccgccccccgggaaaacagccaggccactgttgctgtcacattctggagcctgggccagggc

SEQ ID NO: 80345 - DNA, 1034 bp, Homo sapiens
tctccctccagaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggtgagccggcaggagggagcattagtgcctcgtcctggggaagtttttacccatcctgcctggtcttgtttgctgtgaccttggccctgtctgaggcactgtggggtggccagaaccgttgggatgagggatgcacaggtgaaaagacagctccgcctgccttatgcgagggacagaggagggagggccattgggcccaggagttggagagggctctgggaagaaagtggagctggagcatgtctggggaagtggaggtcagattagtggagcaagcagagagtctgggagcagagccccagagaccagattagggagacccgactgggaagccacatcacgtggtagctaaacaagcctcaggacaaaactgctggctttgaatcctgcctccactatgacctagtgcaagtcgctgaacccctgcggctcagtttcttcctgtgtaaaacagtgacagtggagcatcttcctctgactgtgccgcagcgcaaaggcagacgggtgcctggcccagctgactcttgtatacatgggctgtgtgtgttattcagcgtgttcatggatggcctcagccccatagttcatgcaggatgaagagatagattaagagggcaaattgagggcgtgtggagtgcgagttaaggagctgtgtcctaaaggcagtggggccctgcattctctttatcagtcatctcacacgtagcttccccagggccttcctgccttcctcaccttcctgagcctccagctccacctcctccagaggcccacc

SEQ ID NO: 80346 - DNA, 1819 bp, Homo sapiens
tccctctgggtctccatatgacctcctgtgttgcatggggactgggacctgggatggcctgtccttttcttccagctccatcatagctggaccatgagctcctggagggcagggattgtatctcattcattctgccactcctggcctgcagcaccagggctgacccagggcagctgctcggaaattggtgggtgggtgaaggtaaagtttggactcttagaaaggagtaaacctcaccaatatcatagaggggcattggtcctgatattagtctctgggcacagaggtttgctggcaggtgcccttgccagttgcacttccctccctgctccccagctcggtggtaacagccacatggtgatttctgaccactatcaacccctaggactactccgtcatcttccctcttcccaggcctcccatcccaaaggcttctcatcctcatttgctttatagttgagggagaactcacgaaattttggggttccctttgtgccaccttctgctaggggagcttgggcacattcaccaacctcttggggtctccacttggtgatggctacagaggcagtgactgtccctgcccttgctcctttccctgtctgtcagagggaaaggcttcatgacgtggcatttttgttttttttacaaccctggtgtttctccagagttgctgacagcctcaccgtggaggcgggggtgttcacacagaacgcttggctgctcatctccactgggaagttggtggctgcctgacgccctccttccctatcaatctccccattcctgtcgggctcagcaaatgaagtattgctcatggcccctgcctgtcagctcagatccatcttacaagactcagtgcaaattccacttatccctcctttgagcaaatgagtgtggcaagcgcgagatgggtggtgaatgagacccaggtgaccctcgccctcacagagcgtagtcccacaggccagaaggcagacggcttactgcagggttaattatttaatagcagtgcagagctgcaaaagagaattggggatgcgcccagggcatctccccggggactcagtctcaggggagtggggaaggcttccctggcaaggctctgatggagccacgatctgcagggcagagaggagttcagcttctcttccctcccctgacctccgtgtcacctgcacttagctgtgtgcggatgtgtgaattgttacacgcagcagaaagttttaaccccgaaccctctttttccttccagaataactctgtgtcaccctcggaaagcctccgggccagtgagaagcaccggggctctgcggactacagcatggaagccaagaagcggaaggcggaggagaaggacagcttgagccgatacgtacgtccaaggcgccatggcaccactggggtttctgttgggtagggcagggggtgtctgcagggcccaagctgtggccagggtcttcttgtggttggcagtgagtcagagaagcacaggttggcgataggggaccctattgaggagagcagggtgggaacagggctagggtgaagttcacacacgctatgagcatgcgagccactgtggggcggaggtggatggggaggtcgtcctagcctccatggggtctcttcccacagacaggccaacaaccccatgctgctgtcatggtgctgccggaatcccacttggctctaaggggctgctcccagtgacccccaaaatgtggaccctatagtcctctcagttggcctgaggcatgcactcacttggccacccagtcatggcttttactagccttttaatgggatgcccccggca

SEQ ID NO: 80347 - DNA, 1581 bp, Homo sapiens
ctgtcataaaatgggagctgctgtcgtcacctgttgagagtgaccttcagttgtggaagcccttcctctctccaggctttaggtctgccatttgtcaaatgaagagcttgggctaaatgagctctaactccgtttcatatgagaggtgatactctgagaggtcagctgaccagccctggatcttccattgcgaggggctttgtggagtctctgggctaaacccagggctaaggacccaggtgtcccatgttcagggccaaggtttttaccacccccctgctaggatgcctcctgtatgatcttgcatcctcctcattcccttcaaacgcctgcagtttctccctgctctgggctttcactcgatttaagaaagtgctagcaggcgagcattaaggccaggccgcctgcgtgtctgccagctctgagatttgttgtaaatctttctgatcacactgaggctccgaggttctgtttcaagtgaataagccttctgaataagcgcagtggagtctggataaaaaaaatcctccagcgattagcaaagctattttattcctcatcgctgtccttgtatctggggccatctaatctgttaggatggctttggttattacctcgtgttaagtaggacttggaaggtcaggcagttaactaaccatctagacagcagcttccttgcgcagctctctccaatccagccctccttcccttcctggccctccccctacccaggctgactttttaaacctcccattagcagtgaggctggcgtccgtggcctcttgacccgcctacatgctcagaaatccaggaccacatttgggctgaggaatggctaggtacctaagagaggagtcattgaagctgaaaatccatgttcactgcctcggtactgatcctctaacagtggcattttttcggagaggcagtttgcctagataggcggaggcctggattggacattttaaggctgaggtctggtcccagctttatgaggccctgtgtagttctcttggcctctctgagcctcagtttccttatccataccatgggaataattcctgcttgaccaacctctcagctttgtttcggaagaccctttataacctgactgaggatccagattacctggctagcagggacccacttcagtggaattggagggggagtgggaagcccagcactctctaaagagcatgagtctttacctcatcctcatccctattggcttctggctttgtgccccatctgtgaaagttttctgctaaaagaccccccctgggaacccccaagagctgggctgtttaccatgctcgctgaggtccatgcatggcacacatgggcctcaggaaactccagtgggaatgaatcaagatgctgggcagaggcagcagtgggcagggccgaggctgtgcgcatggcatgtggcgtggtgacggtgtcagcggcggtgtagactgaaataatcaggctttggaaaccaggttgtcaacagatgaggcctacggcaggaaggacagggctgtgtcagagtgggaggggggatggggggacgggctggaagctgtcccagaggggtta

SEQ ID NO: 80348 - DNA, 2157 bp, Homo sapiens
cctaacttctctttcagtagtggagaagaagttgggtggggcgaagggagaggaaagagaagcccaagcccctgaggctagtgttgagtggggaagttgggcctctggagccagggcagcggagtccttgactggggaggagacagggagaattgcattgttgttgataatactgacttgctgcatggcaagtttttagaagggttcagcaatccattttaaactctttgtaaatgttagctactgccatgaggcttagtagctgtgcgccatgagctgctgcaaacattatcttacaataatcctctggggtctgctgctttccccctttacagataaggaaatttgaggctccaggacttgaagtaacctgccccaggccacacagctaggaagtgccagagctgggatttcaatcctgttctgtctagttccaaagcctccactcttccagttaccccgttttccaccactgatgtccggtgacgttagctctcattccactggcccccagctcatctggctctggggcctttgctgtgatgacctgccctgcccctgctctgtaaggcaggcttggagttcctaagaaataaggagccttccccagggtccagcctcagggtggaagatgctggcagctaatgctgaaggcatgtatgcatgagcaaacactgccagggctgtgagcttaaaaatggatccctctctactcagagggaaccccatgactctgcggttttttaaatgcatgcattctttatctcaggcttggaaacaaacattgagaaattatttgtgaaacgggggtgcagggagttggggggtgcttgaagacataaatctttacattacagtctattaacagacttccttcagcgagacattcatgtgaactgagctgggggcaaaggttttgggggtgcttccccctgccacccacccagtgaaggagcaagaggaatgggaagagccactccctccctccctcctgaggtggccacgcctcccctgccctccccaactcagctgtactcaccaccgacttcattgcagcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagaggtgcggctgggctggggcagagggtggggcggggcaggggtgggcatgggcgctcataggcctcacagtgagtggacccagcaagtgctgtcgtcctaagaccaggagttaccaaggatttggagtcatctgttgatacctggtgcagggaagccaatgccatccgcatcccatgcaccttttcctactccttggtgtggacctggtattctctgtcctgaagaccctgtctgttcatctggagctcgctcccatcttcctacaacacccttgcctgtccttcaggggccagccccagtccaacccttcaggatgccttcctggtcagactaggggctttttcaagttcctgtaagagtttaagagttgggatgccaaagttgagtccttgttactgtcgtcttacatcctacccctggaaaatgtcttgtgctcaccacgatcattagttccctaggacaggtgccaagttcttgggtgttttccttacatctatgtctcaccaatgcagaaacctgggaaaggtgcacagtcagtgctcaggtaaaggtttgttagctgactgcctgtaagtgggggtagtgcacaccccagcaagagatcacatagacttggagtcagaacttgttctctgaccctctctgcagcccctaccatgaggacccatgaagctgcaccgagcttggcctcaggagtggttcattggatcagaaaagagaaaagcctggctccctgggaggcccttttcaaaaattggtgccaaatgcactctgcccttagatacggtatttactggggcacgtagccaacaccttctgagcactagggacctggaatgtcaccatcctgccttggcccaggccacagggtggtagccggtccagggaactggaggc

SEQ ID NO: 80349 - DNA, 1038 bp, Homo sapiens
gctgagcctagaaggttgggtaggagaagagacctttcctggtaagataagagtcagggtgcgtggagctattcaactccatcttgccttgggtacaaatgttcagtgcacattttctctagaaacagacttgttcatgaaaggagttagctgtgtctgcaggcagcaaagctacttctttgaagccttctttcccctcctcttctttgtctcttcctcaagggatcttattggctctgcactataaaatgtggattaaataccttgctttcagtccttgctttctgggattttactaaatagttatcaccagcagaattaacgggcctaccaacaatttgtctaaacaaaggggccctactggagactcattttaaaaccaggtatccagataaagttgtattgtccgaccacaccagggaatactaggtagccattaaaaaggacaagaaaatttcttcagaacattcctaaattaaaatcaagctgtatagcagtatggttcacaggagtccatttctgtataaatacatttgaaatgtgtagattttcataaagaaaaacctaggcagatttaacagtagaatcttccgagggtaggattgaagggtaattttaaaaactttttaatgtctacttatttttagtattttcttaaaatgggcatgtattagttttgtaataagatattaaaaattacattttcttaaaaaagaaaaagtggaggagctcagagtaagcgcccatcctagaggagctggagtttcttagctgggaggggttggatctccgcattggactctgtgatgctggctccaggggcccccatagctttgtgtctgccatagtgtctcagtgcagatgtggggtcagaccaccctgggacagtgcccatgaactgcctagcaacagacgtcacagaagtgctctgacagctttgaacaacggccgcagtgccagcctttcacccagaactgacaaagggagccctctggggccaggagtgccatggcttctgtggctgccgttaactttggg

SEQ ID NO: 80350 - DNA, 1703 bp, Homo sapiens
ctgagcacgaggagggaaatttgacacttggtcagcaacctgcagaaggcagcatctatatttcccaagcagatttaagaccctttgagccgatatatcacccatttctggaaccctcttgttacattgctatatcatggcccaagatctttggactggaaagtggaggaggtctcatctgcttacctactgacaatttggtcttcattcccttggaaattaacagtaggggagatgtcacagagcattgacttgattttttttttaagtgggagggaggagaggaagagggacgttgtagcttgtcacaaaatacacaggatattttgaagccatacctaaggtattcactccaggatgtggatgagctgcattcagttgactgaattttgtgtgaggggaaaggatggccaagagaatgtgccttaggatccgtctttcagccaggcagccatggtggaaggaggtaacgctgagtttgagtctgggctctggttgctgatggcttcatggagctgttcagcctcccgagcctgttcaccatctctgaagtggggatcacaagggttgttgtgagcactaaaagctattaccaaccccagaagctcaatgcgtgtggagctatggtgcccactgagtgatgtgaaagagaaggagcagtcggaggcctggagctgttctcgctgtccttggagggcaggaagtgttcattttacgctgtcaggaccctgtctgactcctctggtgggagcccttggcgggtcttggctctggaaatgcttagacaacttcactacgttcaacccaaatcatgaacctgagaaacgcagcattaaatcacctagcgaaggcctaaggcgtgatgtgcataatccaattacacgtactctgcaagcaagatcttcccttcaacctctcctggaagtgactgcaccttctgagccaggccatgggtgcttatcacttgtgtggagtacatgttcgttgtcctatttgtgctctggcaggaaatgttcaaggagggaaaagtgaacgcccatgcatgggcttggttccaggctcctagcgcctctttggggttagggatgcaagagggaattattgacttcctttcatattgtggatggaggagttcccatattggaaggaatggtataagctggagacaggcggtctctgattgtggaattgattccatttctctgccatggggaaagctacccagttgaaaacagtatcagcctcccactcagacatcactgtgtttgagcacattgtgctctgaagccagcagacgtgttgcaggggataggaatacagcctgaggatagctgtgcccgcctgcctgcagaggtgctgagctgtgatagggacgggggtcaggtggggctttgcccactggcccccacacctgtcagggaaaaatcttcgtttcactctctgttgtacccaagattgttgttagcggaccctccgtctgacaagccctggcatctgctcttgcactgaggaaggagccttggaggttggctctcctgtccctgcttcccagagtctgctggaccggtccttgctgtgccttcaaaccaccccaaggagacctcgagggagtttctggctctttgcagcaggttgctcttgcactcagagatgaggaacgcttcagttttgcatgggagattccttttctcttttgcaaagag

SEQ ID NO: 80351 - DNA, 1252 bp, Homo sapiens
tattcataggaggcaaaatggcccttggttaagaacctctgatctagctcaatgcccttgttttacagagaggggaagtgattatgatgtttaggaggaaagccaggccagaggcccaggtggctgactcgcagcccagggctcttcccctggccctggtgcagccctggagggtggcctgtgtcatctgtctcagtgaccagctctcagcttggtggtggttctgctagtggtagcagggggctgcagggttgggacataccttgtgaattctgttttccgacatttctcctcttccagctcctcaccccatcccctttcaaccatcttcttgaggtttccaggccaactcctcctacccctgcggtggccacagcagggtcccctctcaccctctgcccccctctttggaattaaaatcctcttatgaaaataattttttttaagttttaagaaaggagtaaaactgggggagaagcactgcttggattagctgtatttcccttaagtagtattcaggaagctacaagttaggtcgaggcagctcgaggcagacattggaattcaattaaagccaacgagtggggcctgtgacccccattttcaaggtaattgcttctccagctccaagtgaatgcagccatcgccctgtcattaagcaggcagccgtctaatcgctgcgcctgacagagcctcacaaggcaggaattacggacagccgagtcgtgctcgcactggggagccgtgcttgactgcactcccgcgaaggagtccgctaatctagtcagggcgttctttatctcctcctcgaggagagcagagagcgagcctgcagctgagctgcctctgggaagcaaggtgaagaaggataacggggtgcagagccatgggctgagcaaaagggcaggcatcctggccccagcaggaaagggcaggagagagagggtcccaagaggctcttggcagctttcagtggctacccccactgcactgttggatttgctgctctggaaggagacacagcctggcatcctggtcttggacttagaggagggctttgggcaagtcactttgttcctccaggcctcagtttctccatctgccctaattgtttagtggctctcttgctcattggatttgaaagattctgaggttgtggctcggctcaactcaactcaaagagaaatcagatacctccggcatgggcagggaggtagctggtggcatatttatcatgaggattagagtattc

SEQ ID NO: 80352 - DNA, 1294 bp, Homo sapiens
tagactttatttttttaagagcagttttaggttcacagagatttcccatatcctccccactatcaacatcctcaccagagtggtacatttgttgaaactgatgaatctacattgacacatcatcacccaaagtccgtagtttacattagggttcattttaccactttttctttctctatctgttcatctggaaacatactttgttttctctctatttagacaggtatggataaggtatatgtagacatactttttccccaaatcctttgacggtaaattgcagatatcctgacaattcaccactaactactataactgcatctcctaaaaacggataccatccttcatgattacagtattgttaccatgtttagagaattaataatcatcctgtaatatcatctgatatccagctcatacgcaaattgcatggaaaaatttgtgtgtgtgtggttgactaatagccatcttttggcatgctctttgttttagaacttaaaaggaagtttcaattacaaaactaatacatgctcattgaaaaaggtctaaaagagaaagtaaaatcgcctgtcaccctcccccctacttgtgccctgtgcctgttcagtgggactcctctgtctgctctgggcctctccgagaggccctgccagtgctgcacagcctgtgacctcctctgtccaggaaagtggctgcatctaacgcacaccctcttccctccagcaccagcagcaggtggcgcaggcagtggagcgcgccaagcaggtcaccatgacggagctgaacgccatcatcggggtacgtggactccccaatctgcctcttaccgtgtgtatagcccttttattcctctcatttatcataaccagagattgaccctgaccttagctggcctcaaagaatggcggccccagggctccggcttctacaagcaccccaagggcttggacccatgtagggctgtttcccccttggctcccagttgcctcctagtcctcaaactaaaggggagccagacacgcctcaaatccacctcttcagccatctgcctcatcttccactggcttttggtgtccttgccattgaggagggtgggggcctagggtcaccttcaaggccaggccagctggccagtacctggccacctcctcacacttaccccggggcctgtctgcctcctccctggcagaagtctgcccttctttggccacctgggatcagaacagtctctgctgtactgttgatgtgcatcgtgctgtggaatttgggtttacgtcttgctgtcccatgcgcg

SEQ ID NO: 80353 - DNA, 1053 bp, Homo sapiens
tggtgagggagaggctagtcccagggaaccctttgccacataggaccgcttatcagcttagtcccatttatctgagagctcatgtcctattggcactgggcaccagtgggcagagcaattcctctctcactaaactgtgtttcactcttacagtgggttttgctgggttgttgggggtgatttttatttcgttttgctttaattagggattccatccagaggatgcaaactatattctgaaccagacatgtagactacctctgatggaaattggagctccctaaaatgtaggcagcctggctgcaagggagttgaaagagatttcttcatgctgtggatttagctagagcctcctggtaggaggctgactgagggcagaaaggatggagccccgtggagaggggctgtggtctggggggagtttgcatttccacttgcctatgacatttcagtgacttgatttatttgcctgagcttcatgtggtctccttgcctttgcagacagagattgcgaagagactgaacacaattttagcacagatcatgcctttcctgtcacaagaggtaagaccttcttttattatttcttccttttctttccaaatcagcccagtggctggtggggtctcactggagcctgagccccagccccagccccagcctcagcccctgtccattcatactgactgagctgacaacctggagatttccagagccttctccggccagtctggaggcagggggccatatcagagggaccatttgctccttcttctcatagaattgtttctctgccatcacctgagtccagagattggagtgctggcatgcgacctaaccatcagtgggcagtgggtgcctctttcccatccaaactagcatccccagcccaaagtggacctcagttcctggtacagagtgcccttgctgggagcatgacccaggtggtcatgtcactttctacgcctaccttccaagggacctccatttgggacagcggctggactagtgggtgatttgagataaatgcctgcaaagaagccccctggtgcc

SEQ ID NO: 80354 - DNA, 1020 bp, Homo sapiens
ccacctctcagattcgcttctgaagacctggctcaaaagcagtggctttgtgggaccgagatggagggaaggatggaggtcggcctctggaaactacagccgccttatcgataacggattgcgccaagttgccaaaaggagttttccaacatacgatcgagttccagtttgtgatttgtgacctgtcccaattgttgaagtcacacttgatttttttttttttttttccttttttggaactgatgtttagagcttgtttgagttggatccaatgctgttttaacagctgttctaatcagaagtgctgtcaattattaaccttaatggtggtttttctttcaaaaatatttctctaagctctcttgaaatgtcaaaatttggcttcttggtaggaagtcatttagtgaaatcacttaatggctgggcatcagtttccccatctgaaaagtggagatgttgacaagcgccttctccgcggggttattgtggatgcacacatggcgagttgggtgggtgatatcagcggtcattactgttgttaggagggcttctgttaagccagctttccatttccaggaacttcccctcccccaagcgccaccctccaaaaaataaacatttctttaaaatgttgagcgaacagctttcctgttcatgctttgactctgcagagtgcacgcagcccattctcagggttgggcagcctttgtagagatgggggaggcccaatccctgcttccactttgtggggagaccccaagagggtactagcagatgatggcacagtgacagctgggagggatgggatgtgcttgcttcatgtccctttcccaggggaggggctgggtttacgttgggagaacttttacggtgaaccaggaggttctcccaacgtaagcccagcccctcccctctgcctgcctcaaccctacacagtcctgtctggtgacgtgccaaagtccttcctgccttgcagagaggcctctcttcgtcgaacatgggcctcaggaaagacagcct

SEQ ID NO: 80355 - DNA, 2977 bp, Homo sapiens
atgggggagaagcagcctggtttagagctcgaaagacatgcccctctcctgcagggtcctgctgctgttggcctggtgtcggtctccatgtcacccagtccttgtgtgtggcaggcacccacaggcctggtctgcaggaacttgagaagtgtctagatacccctttctcttagccttttgggttttctcactattcttttacctggttttttaccttacttctcaagagacccctacccagctcttcctcactatccatttgcccagggatattgggcaaactccctttttaaactcccaggatgttgaatgcccattgggcctactggatgatggatggggtgggttcccagcaagccagtttttcttggccagtggattccctttctccctcagaagatcacaagttcttgccgggtgatcctggagagttaggtatagagcaccagaagctgggagatttgtcttcatggctaagaggttggctttggagtcagacaaatgtgggtttgagtcccagatcagttcatgttggtgtgtgactttgagcagactgtttgacctctgtgatcttcagtttgcagtggagataataataacacctgcctgttgcggcagtgctgtccagtagaactttcttcagtgatggaaatgctgtatgtctgcactcttcagtaaggcagccaccagccacgtgtggctcttaagcacttgaaatatggctactgcgactgaggaactgagtttgaaatttaattttaattaaatttagctagccacgggtggctggtggcttcataaattgtacagttacagttatagggagtgccatgaaggatgcatatagcctgcttagcacaaaaccttgcacatggaaaggccgaagcaaggtattctcacaaggggacagagtccccaaattgtcaaggcctcagacatagaggacaagatccttggtgttgcatatgttgtaagatttctcagagccctttcccatatgtgacttgttggctctacggtcctgcagtgtaggcaccgtgggcgccacgcatcagatagcagcactgacggttaaagaggttgagtaacttgctcattgttgcacagcagaccagtggccaattcagaactggaaaccaggcctgcttccctcgtggacctcagtgatctttatccataggctatatcaagatgaggtcttctgtggtcttcccacatgtctacccccagaccaccatactacaggcatcagttccagtgctgggaagaaaccagatgaaacctttcagaattcagtaaaacatgagcatcagccacatgtggatcagggattgccaccctgggcgctgtttacatttgggactggataattttttgtggtgggattgtcctctgtgtttaggatgtttaacagcatttctaatctctacccactagttgttgttatcagtgcccaagttgtaacatccaaaaatgtctctagacattgccagaatcccttgggggaaacaattactattggttgagaggccttgttatagaggaaggagtctggctctaacctgggagatttgcttaccacctggtcttcctgtgtggtcttcctgtgtgacagcttcttgccctctctgggcctcatttgactcatctgtaaaatgagagatcaaatggtgtggcttgggaggaggtcagtttgagaaggagcatatcatataaaataagtttctaaatgaccgatcttgatttttatagcctaagaaatgccatcactcctgccttccttatttggagaaagaagaccctctaaccctttttattttaatttacggaacaggtatgctctttggttgtgaataagatggtaggtagatagaatggggctctgtctctgcccctcaccttgttcttccctcatgccacttgggttttccaaagagtccctgcccttaagaagtcctagccagcatttcatttgtagtgctgacctgatggggggagacccccaaaatttaatgagctgtctctgcaagggtaatgtgacttttacagcctgttgaggggcaaggggagatttgcataatgttccaagggggattaggtggctgggggttgccatggcaaccccacagggatgaattgagaatttttcctcctggcaggagttggccaatggagtctgggaaggtgggggagggggcagggggttatctgaggggagggaggagggggaaggagagagggaagggtgggggcggtgtgcctgggatgaatgggcagtgttgggggaaggtataatctgaaaaagcactccctgttctgtctgtacaagcaagctctttgagagccatctccccccacaagtaggggtgggaggcaagcagagtttagtgtgtttgggaaccaagaaattaaagtgaacaaatatttaaagattattggatcttgttaacaggaagcccggtagatggaaactgaaagtctgaggaatgaaactctttagagtcctaaagccaggagggacttgagctgtcatctgggccctgtggtgtctgcctccaagtctctgttgggtctccatggaatgctcccaagggcagggcactcacacagcacctaattcatttttgagagctccgattattacactggactcagattggacttctttattcggaaactgaggcccaagtgcaggatggatctgggctaggaatgcaggactctagactgtatgttgctacctgtttctggggttgggttgcctggatgcatgctagcttggcctaaccatccccagttcccttacactgtagacccctggaagaaaagaggaggtgggattcctttcagggaagtgtgcagaagggtcgtcccaaccccagcaaccccagagtcccttgccgttgatcggtcctagctggggaagggtgagtgtgtttcctcctccctgccctggctcctcactgtcatcctcacc

SEQ ID NO: 80356 - DNA, 1596 bp, Homo sapiens
agaagcaacttcccatctgtggggcctgagaggccagggaaaccctgttggggcctgaagtctatgttgtcctgttctctcccaggctggctgctcttggtaaagggtaggagcatggatgggcttggctcgtgtgtcttaggtggttccttccatcacccactgtgtgaaggataggatccagtgttctggctgctgccaccaccaaataatcccaggggaagtactttccagaggacaaactgtttgaaaaatttgatcttccagatattatagattataatgctacggcctcttagaatttctgtagcacttgattgcaaagcagattcgacattttcatcttagcagctaaaataatgggtatttgggtccaggacagacagacaccaggataaaagcatcagagcataccctgaaagcttggggtgtgaagatgacctgtgtactagagggctgtgttctcaaattggggttggggaggtgaggcctgtgctgtgacaggactgtgagttccgtgagggacaggaccattttgtatttgttttcactaagggtcctgaaccctgagcagtgcctggcccatactggatacacagtgtgcattttgtggggactcaaggaaggaaggtaatattccagctcagggttctctctgaccctgaatagtgttatggactctttgggaaggatagaagctttcttagttttctgacagaggcctgtaggctgcaaacgttgtgtttgtagaaagagttgtaaaggtgtcatgagcctttatttaaaagtgtctttaatgtatcttaggcatctttttcttttcatctaacactatggacagtttaagtgcaaaaggggaagaaggcagggtgggggtgcgaagagataactgggaggaagagatgacaaagcagagatgcggaagagacaagtgctgagtgggtgaattggtaaactcggcttgccatgccttggctgtttgggcatggagttccaagtgttgtggccttatctcatgagccttttaagtttgactattgttcacagttcttctactgctttttttgtttgttaattttgaatgaaaactaccgcaggccgatagaagtttctttttcgtttgcgctggaaggctgaccctttcctcaagtggagacccaaatgcagaagagctcttcccactagtgttttagcactgaataccaaatgcaatttgggtacaggagagggctctcccttcctggtcagccatgaagacttgaggtttagactccaccaccctgccagctatatgaccaaaaggttggaggaggcggcctttcacccacttcccaaatctttcccttgggctagccctcgacaggtctttgctgagtttggatctgaaactgattaattctgataatactggcaggggcatgctttggaaccggtgatgctttgtgatttctgctggggaaaatgagaagaggaaggcagttcagtgcagactagtggacaagggatgggagtccattctagctctctggtgggggtgaggtacaagaacttctattaaccttcctggcctctgtccaggaagaagtaggacactca

SEQ ID NO: 80357 - DNA, 2059 bp, Homo sapiens
cacggagttcttcctttccttgaactcctccttcccacctaggctgtttgtttccattttgttgaaggagtgagtcagtcaaggaataaatctccttttgctttctacgtgggagaatgtcattctgtctcattgtttgtacaaaatactgggacaccaggggcaaaaacgtgacaaagacctaagcttggcagtgttttcccctgtgatctggcactcattcctcgtctcatttttgtaggtatgaaggaagcccctctgctgaggtctctatagcacttagtatgtaataggtgctcagtaaacatcttggtttttcttcaaaatttactcaggttatctgagagtagagttccgattccctgagccctgtgagtaggaagtggggattttagttgtgggctggccgcccgctctgcaggcttcctcctatggcccagcatccagtttcttcatcagtgaaatgagggggttggattcattcccaaagcagttattaggggactgggatgtgctgggtgtgggctggggttggttacacagccgaataagacaccattccctctgcgggggagtcggatgtctaaagaagtaattgcaatgcagtgaggtaagtgctaatgtggcccaagtgtcataggaggagcacccagcacagaacagcttattcttcttgggtgagagcagacttcactgagggctttgcttggcgcgagtctgaaagggagggtagggtttatgaggcagaagtcggcagccgaggcccctccagggtggcaacagctcgcggcaaggcagtgagatatgttctagaagccacacgtcttcggaatgatgtggggcggggactgcacttgggaagtgaggcgaggtggtgacattttgcagcagagcgatctccaaggcccctctgcccttgcagtcgcggctccccacccggtggctccctgcatccctgcatggctggctctccagggctggcctgagtccatctgccgcggggtgggggtgggggcgggggcgggggcccgctctgggccgtttgtggcctgctctgcctgctttcctaccgtaatatgctgctttgaactttattccccaaagtggcattgtctcctttctcatattggtaattctgtaatgactggttatgacccgccccctcccccatatttaattctcatcagcccagctctccactttgctattaatgatagcagccagcaaaatagctttcaacatgccattgacagtctggtttaagagagcacttgaagtagtgctagacagctgaaagcacccataattgtgtaccagagtgagaactgcgtgctcaagggccttgtttttatatgcttaaagggacaatatcttgttttcaacaaatgctctctgagactcacagccaagatgctttcttcctttttccttttcctttcttcttttggctttctcttctccttcaaaatacatatttaaaaaaaattctttataaaataattgttcccttcaagttggggttaaggagaaacttaaggaagggggaaacgtcctgccgccatgtaagcggggaatatttggtgggtttgttgttttgaagcatcgtcctttgcaggcagcaagctgtgggtcagccttgccctactgagggtccttaggaccttgcgtttctcaaggaggtaatgggagagtctgaattcgcatcagcattgattttgaattcttttctttgctaaggatgttgcacaatcagtgggctgcagagctgtcactgtgaatgtttaggcagaggccaccttttgggggagggctggaggagaggggtcaccgtgttggagagtcaggccatgaccgctaaggaatcagattctaggaggctgtttgctgcagagttgatggcccaagaggcccgtctggaaatcaacagggtgggtggggcaaggacttgtattcttaagtacaggttcacaccaggcttggagggttaaccagggggcccggctagtccacccggcagattttatctgagaacaaatacttttctccccttcacaccagc

SEQ ID NO: 80358 - DNA, 1034 bp, Homo sapiens
ctgtagaagaaagccctgccactaattgtagtgtgggtcttgggtgcatttggcgaatggtggttaggcctgagcaaacaagtttatcagctgacctgtttagcggttgactggtgttttatcggcacacacaatcaagtgactggagtgcttgaattattcatgcagtgtcctgccctctagacttgactgttcgtgtgattacatctgcctggaacaaacaggctggattcttcatctttaagctggggtgggggtggggactgtctgtacttttatataatagatgatctatagagctagcaccttgggaagtgtggcagtcctcagcctgcgcgcatacacgcacacgcactccaccatcaccaccacatattttttttaaaagctctcctttgctggctctatgggaaatgccaattagctgggaacctcgagtcctgccagatgggcccgggtattgacagagggcagctgatgaggtgcgtccagcccatttttattttactgagaggttaaactcactgtggctggctccttctctggctgtttctctgtctctctctttttccaagctgtcaaaatcccagagaagtaataaatggtttctcctcctgctcttctgcctccctccctaattatggtaaagcaaagattacagaatcacaggcctggcccgggacttcaagaggtcacccacctccaccaagccccctgcttccaggcagaatgtcaagggtggttcagagagtctgggaaggcagtgatgactgaccggctcatcacttgccatcttgtttgtgcagaggctttccagtgtcagccacaaataacaaagccagcttaaaaccaggggccccagagcaattgccatgcattggatttgaggcactggctctctgagaagctgggtcaggcagccttttcacccactgttggtgagcactgacatttttgaaagtggacttgagccattttgattttggggcagtgtcgtgccgacacaatacagtcacctttttctgtgaactgaa

SEQ ID NO: 80359 - DNA, 1031 bp, Homo sapiens
gccttgcattgacaaggtggctttctcatccctgtcttgatttgaaggcagccgagttcccattttacagagaaggaagctgaagctcctgggtgaagtaacttgcccaggggcagcctagccaggactttcgagatggctgggggttgagctcagctttgaaatcctgaagtcaaaccagtttagctagtgtggtgtcgtttgatggatatgtaaactacctggtattgtcactcttctaataacagtatacctcaaaccgagcaaatacaaacaccctttatctcagtgcatatcagtaactagtcccagtgctaggctgggctgtgggagaggcctgtttgtgtatttgtgttctgaggaaaggctgcctataatttggcttggccaacgtttagagttgacttggcacgtataaatggagcaggcaggccggttgttctttttaacaattggtgttcatgaaatctcagaaggctgttgactcattctagcctttggtgaccgtgacttgaatggattttctgctctaaattaacagtcgtttacaaggtttcaattttgctctttaaggaggcaggacccagggcaggtgagaagggcaggtgaccctggaaagtgggcagattcctacccactcgggtggcttcctatagagcctttgggatctgtagtttcctttcccctcctggagggagcccccagtgttgggtgaagggaagccagaaaggggcctgagtttattgagcaatgtgtgggaagccagcttgtggcttcctgagggattagttagtcccttaggaaggcacatgaaggctaccatgtttttacttcttgacacacagaaataatagacagggctttatacgtaaagatatttctccttggaaaaatagaatagagacaggttctgcaactggaaggggccaggtcccggaagaatgcttgaaatggaactgggggcccaggtgtttcaaggaccttggggtgtatgcagggtgccacttcctccctttgtctgccctgtctta

SEQ ID NO: 80360 - DNA, 1092 bp, Homo sapiens
tcttttgttgttattcctctgtcttccctctttcctcctcccgctaaataattatttgctagtagaccgtgggaaaaaaaaggaggaaaaaaactcgagcagcccaggactataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccga

SEQ ID NO: 80361 - DNA, 1151 bp, Homo sapiens
atacataaatatacaacatatattaatatataaatattgtatattatatatatgagggaaaaataagaatttcaatccagttaaatatgatggattaaatataccttgaccttctctcactggcaacattttattaaattgacagtaaatggggagacatatatgaaatgccaagtccaaagtggtttgtgacatcaggagataagagatttcaacaaatacctgggctctgggaagcagagggatgagtggtaatgactcagcacagtggagaaagttacaaacttcagcacttgcggaaggcagaccagtgagaagcacattgatttatcttaaaggattcctgagagattcagagcttgaatgctccaagtctgcaaaaatccatggcgatgtgcagagtggaaggcactgcagttaatttaaagtctacattcagaggagttagggacccagggtaccctccccatgtccaccacatccacatggtgtcagacttcaactagaacttgagaaatagaagacaatggaaacatgaatgcagagaggaaccctattttgaacacagagcctgatcataaatcaagtatgatggtggaataagtatatttcaaacacgcaaaaaaattgacctcccttgcacctttccttaggaaattaccataggatgtgcttcagccaaacaagaaaagaaaccaataaataggaatacatgggatacaggaaaatggggatctcacccaagaaactggctggattttagagataaccagagagcagccggtccaaataaggggtgaagtgggaaggcatggaggtgaaatttgtatattatccagcatgttgtttcaaacttttggaaaacaatattgataggcatttgatacttcttttggaggacagagaattgagcaaacaaaaaagcaaagtgatgtacaaatggaggaatgtacctgacttgggtcatgggggaataatattttcacagccataataatgtaaacacagccccaaactatgatataacatagtaagataatcaaaggagaaatggaggagagagcttataaagtagctaaatcctcaattaccagaacatgaagtcaatagataatggggggaaaagcagcatagcaaattatttagaagta

SEQ ID NO: 80362 - DNA, 1028 bp, Homo sapiens
tagaaataaagggtcttggggagagtgaatcgaaacaagggagagaaaggggtgggtgggtggatggtgcttcttgcagggattggcctttgtctgcaatgtctgggcagagggggaccctgttcgtggtccttgaaaagggagttcagtgtgaggggacctgacctatagtcaagagatctgggcacactttatctctctgagccttgatctacctgtgtaccctgacttcctcaaagggcaattttaagagccagatgagataatgattatgcaggtagtttataaatcacaaagccccatactatatcaaaaccaaattcttattatacagacagggaagccgattcccatagaagtgacccaagacgcacagttgatcagcatcccagcattcactgggatatgccttaccatccccaggctcccagcttctctgtgctgacaagggatggagccctggagtctggggctaaagctccagatctggcgccacctctggtaccagcctaccgtgtaatctcgggccagttacttcatgtctctggacttcagcttcttcgtttttttcttttcaaagagccctctttccttattttcctgattgtcctccctgccagctacctcattcataacatctttagccaccatctttctctatgacctcaaatccatatctccagccccgtttttattctttgccccagaacctactgtatgcctatgaaacactcaacaggtaccaaatggaacccaggtctttccccacaaacctgaacctcttcctgtatttcttgtcttaatgaataatatcatttcatgtgactcaaccacatgacagatgatgaggaaactgaggtccagagaggctaagaggcttgcccaatttacacagcaatcggttgacagagatattaatagaactagagctcaaatttcctgactcagggccagatgtgccattctactctcttccatttgactggggagtgacttgaaaatattttcattagtctctcaatgacagg

SEQ ID NO: 80363 - DNA, 1025 bp, Homo sapiens
cgctgcattgggatttcccaggcgaggtgtctatacctcatgcgcagcctacttttcgcctatctgggatggaggttgtttgcatgttccctcctctttccttccttcctctgccacataggcctgtttttggcagggaccatgtcttaggcacctcagtgtccctaagtgtctctctcagtgactgacacatacttggtactccataaaagtttctgtagttgtcttaacttatggaatgactgccagcaaagtatttcttgtttccaacccaggctcctcacttgccctgcttccctgagagctgctgggaggaccagcagcagtggccagcacttgcagtgcctggcagcatttgcaaggtccctcatgggtcctttcccacagggtcccaggatgatgagcgtgaaatgagaccaataaaagattgcacaaatcttgttggactcacacataggatggaaagcaatatccatgtctgaaacatgttggagcaggccttccaccaagccctttagaaaaagggttgtatgtgttgtgtagagcaaacctggctgacaggcattagcatgcccattttacagatggtgaaacgggatctgagaatttacgagccttgctcaagcttccacagctatgccaatgccgccagcccgccatccctggggttggagccagggcatgtggggtgatgtttttcttggtcgtgagcagatgggctagtgccctacctgcacagtctcaccgtagctcaccctcccatacatcctgttaaaggtccagccaagatccacttccctccctcgttttcttgcctgggttttgcctagttccttctcttcatgcaccacaggacgcactctgagcaggcggggaggcccgtgagcctggcaaacaagctatttgctctgggaggtgggctgcttctgaggacagcacagggtttctgggacagtgctgaggaagtcacccacagcctggctccctggctgagtggacggttgaggtggccagaggaacttaga

SEQ ID NO: 80364 - DNA, 1110 bp, Homo sapiens
cctttggactgagattgaattacttcactggcttttcttggcctccagcttgctgacagcagactgagggactcagcctccctagtcacatgagctgatccctcatcataaatctcattttgtatatctctatacatcctactggttctgtttctctggagaacctgctagcacagagagagatagacagatgggggaagtgatggtgggaagggtggcggtgtggaatgggtctgagtgaactagcaggttcacaacaactattaatgatgactcttgtatctcaagcacttcctatgtgtcagacactgggctgactgcttaatataaataatctaatttcaccctccctgcagatgcttaggagtgacaggatgaaactgatttcctcatttacttgggaatattcacatagtaagctgctctaccttcttccaatagagaattctgaatataccctctgagcttacctcctccaaccttctcctaaagtggagggaggggtagggaaggggaggagaagagtcctgtgcacatggcactgcggggagcacttcatgatcacactgtgtgagatgtttcagagcaactggggagatggcaagaggattggggagtgaagaaagcgattttgcgggggaaagttattgtgtataatttgagagtttctagtaaaaatggaattccttctcaattatttttggctgcagaattggactggaccacatggggccctgaatttataaaggttacatagttgtgattgtctttatttatagatgaggcaacgaatgctaagaaaagttaagtgatttcctcaagaccacgctgctagaagcgatgaagtcaggacttgaacatgggccgcctgcctctgcgcaatgcacttgctctctctgctgcatatttcccgggtctaaataagtgagagaaacatttcctcatagacatttagacacagaaaagacacagagccatccctcccaactgtttgatcagtagagaaaccaaggaccagaggaagggaatgactggcccaaagtcagatgtggaatgcgacctcggatggaccccagctttctgccccaacgagtgtgattctctgtgctg

SEQ ID NO: 80365 - DNA, 1100 bp, Homo sapiens
ggggctgtttcctcatccatttgtccccttcacgggcttttccctccaccgaatcccaggagccctgggttgtggagcagagtgggcaagggtgacccgcaggcagtggcagggagtggagaaatcggaacccttgccatgcaccctggacttcccaaagcatttcatgcatcctctcattccccactcagcacaaaatgggcgatgtgatcgtgttggatggaggaggagaggtgaaggggctgcgtggaggtctcccagccactgtctggaccttctggctcctaaggagtgggttgttcagagtgagtgtgtttccaaagcctctttttatttgcagctctgttgtctccagttctgttttggggggagcaagactgtggtgcctccctaggaatccagctttcttaaatgcaccccttgaaagggtggatcgaaggctgctggagaaaagatgtggacaaaagccacataaactgctccccacccccagcagctgctctgccccagagcaagtttggggcttgtggtgtcctctgtgtttgtgaaagccagtctccttcagtgtctcctgggctgagcctgtgttagggactgggcagggcaggataagatgggacaaggcacagtgcagttggggagcctcacccttgcctgggacaacaaagagttcaccaaacttcagccttttgcgttccaacacattttttaactttatctgtctaccacctgtactattatttacttaatgtatttccttaaatcaactaacatttaacttagttccatcctaggccataaatccatttaaccactgtttgatgtattcattttatttttctcatgcacactaaaaataaaagtataactaaaatgaaaacaaatgcatccaggtaacagtgagaagcatctggcaaacactaggaatctttatgcctgggtaaggctttatgtcccccaccaggcagagcaggcgatctgggaggggacaaggcatggtatcactgccatcacccatctgcacatcagcctggcctggatcaacagagcgggggcccatagaacgcccgtctgcccagtggtgtccgaggggtggtgtg

SEQ ID NO: 80366 - DNA, 1046 bp, Homo sapiens
cagggagctgggaagctccccttaggttccagacacctggcccactttgtgtctagatgtgggcttgccacggaaggatgcttcaccagaagtggcttctgccactttggtcttgagtgatacaatgctcagctaccaccatttacaggtgggtgctagtcatgcatctgctctggtgttgggcagtggggttttatgtttatctgtggtcaggggtcctttcaccacccactgactttgcccttcaccacccactggccttgctgagctgtctccctgagtgttttcggcataatcattggctggtcttcatggatgggcaacctctggaaatggctttcttccagagccattgccctgggactactgagaagtcccaaggcccttctagagtgccttacccccatgactttatcaagatgactctctcccttctttggggactgccatagtctctggcagctgcctttgcaggggccttgctctggggctcaaggactccagagcttctcttcttaacttgacccttaaggactaaaatctttgaatggggagtagtggtatcagatggacccggatatgaataccagtgttgccatttctcttttgtttggctggtttttggataggatctcgctctgtcacctaggttggagtgcagtggcaagatcatggctcactgcagcctccacctctcgggctcgagggatcctcccaccccagcctctggtgcagctgggaccacaggcgtgcaccaccatgcctggctaattgtgttgcggttttctagctgtgtgaccttacataggtcactagccctgtctgatttcctcagctgtaaaagagggtaatgataaaaaaaaaatcacaattaacactactattttattctcaatgtgtcaggcattattccaagtactttatataaatgacctcattcaatcgttgtaattaccgtatgaaataattattattgtttagttcctatgtgatagatgtgtaaactgcgaccacgcagatagttagcagcagagcagggatctagg

SEQ ID NO: 80367 - DNA, 1445 bp, Homo sapiens
aaagacattcttataaactaaataggcaatgaagaacaattgtgaaaaaggacctcaatttgagcatctcttggaaattcttgtaaaaagaatgcctaacttgattttgaagtttgttctaggacagggagaaaatatctttggctcaaacttcatttgactcatgttttaaggaaagagccaatctatcccaggcagaaaaattccaccaaaagatttatgacttaacttttatgttaaacaattggttttgtctgacacatgtttgaaaagcatatatagtgacttctgataatgaatgacttgatcatttggattaattctccccattagcacaataaggaaaaccagacaaaatatttttttaaaagatctacatgtaggctgtagtgagctgatatgataaagaagcatattggaggatgacagaaacccagagaggtaaattcaaaatttgggctttttggagcatgttctctgaccaaaattgaattaaatgagaaccaacaactatgacatctatgaaaaacgcacattttggagattcaacaatacggttttctataacccataggtcaaagaagaaattaccccaaattaaaaaatattttaggccaggcacggtggctcatgcctgtaatcccagcactttgggaggccgaggcgggtggatcacctgaggtcaggagttcaagaccagcctggccaacatggtgaaaccccatctctactaaaaatacaaaaattagccaggcctggtggcacgtgcctgtagtcccagctactcgggaggctgatgcaggagaactgcttgaatccaggaggcggaggttgcagtgagccgagatcgtgccactgcactccagcctgggtgacagagtgagactgcatctgaaaataataataataataacaataataaaaatctcagacattaggataatgaaaataacaacatctaaatctgtgagatttggctaaatcagtgtttagaggaaaatgatttacatccttttattaggtgtgctggcttacacctgtaatcccagcactttggggggccgaggcaggtagatcacgaggtcaggagatcgagaccatcctggccaacatggtgaaaccccgtctctactaaaaatacaaattggctgggcgtggtggtgtgcgcctgtagtcccagctactcgggaggctgaggcaagagaattgcttgaacccgagaggcggcggttgcagtgagccgagatcgcaccactgcattccagcctggcaacacagtgagactccatcgcaaaaaaagaaaagaaaaaagtgttgaaaaatcaatgcccaaagagctaagagaaaacaaacaaacaaaaaagagcaatgtaaaccaaaaataagtggaaggaaaaaacaataaagacaaaagcaaaaatcagtagagaagagatcaggtaata

SEQ ID NO: 80368 - DNA, 1030 bp, Homo sapiens
aataatgatagatgatatactagatttttcaaagtgtgaaaacctttagactttttttagcaattagtttgacattcgctactatagtaaccaagcactcattatatatgcatcctccaaatgtttcatgcttatttataggaaagttatattaatgagattaataatgtgaaatacagttttcctgcaaaattagcattagagaattgattttagataacagatttttaaagttttagagaaaagtacagtaatacagtaaactgaaagagtatatagatagcaataaaataacataagtggacatgtttatagtaaatactctgaagtaaacaaccgtttttattaactgcatctcattagggaaagtttatatgtcttgttattttttattaacattttatttaccattcagagtgaaaattactaatttgagtattaacaaataactgaataaatggatcattacagttaggttttctcaaattgcaaaatttgccttagcaattatctttgaacatcccgaaccagatttttaaatcccatttttgtttaatagggtaaaaataccatcaaaatgacttctcataccaaagaataagccatcatattttttcggtgttgaaacaacattgaaagtcagaattggatttgtttttaattctttatacggtttacataagcaatatctgtctctttaattattatgattaatgtcgtccttcagcatgagttctgtttcacaagttttgggccacctatttcaataaaaaataaaatataaattaaaaaagttgccgggggtggtggctcatgcctgtaatcccagcactttgggaggctgagggaggtagatcacctgaggtcagaagttcgagaccagccttaccaatatggtgaagccccatctctactaaaaatacaaaaattagccctgcatggtggcaggtgcctgtagtcccaggtactcgggaggctgagacaggagaatcgcttgaacctgggaggcggaggttgcagtgagccaaga

SEQ ID NO: 80369 - DNA, 1079 bp, Homo sapiens
ttcctattcctataaacaagcctccttgttttttttctctctacaacaaagtggtcttaaataatacaactcttgaaaggaaaaaggaacatatgttaatcctagacttacacgggccacacccttttacttttcacactttgttgctgggaatcccccttcccttcctgtgttccatatgttacctggaagatagttcatgtgccttcgtagatgcttatatattagctaaaagtaagactatgtttatactcacatcttaggatatatgtaatatttattcttaatttggtattgcttttgtaaataatttctggagagggatttaattataaattacatattgtatacatccttggtaacagtcttggcaatattcatacctcaattttctggtgtataaagataaagcttctgtctccaaaaaggaatgatttctgtacaaagatgttcattgtacatgataagtgaataatatatttctcctacaacatttttttaaagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgtgagtaaccaggcacacggggctttgcaggaatatgtgctggctccctgtagttagtttgtaaggctcatttagaaattaaagtgctctgtagctatgttcggatccaagaatataattatttttatatgcgaaaagttacctatactggtggtgtaataatacttatttgatgcctactatacaccaggcaccatattaaacattttacgtactttatctataaactttatcttcatcatgatctcacaaagcagatttattccctccatttaattcttaaggaaacaaagaataacatatttgatgcctggggtcattcagctggggtataaacctggaactggctgactccaaatccagcatctttctcattgcagggtgctctctaaaatattggtccactaaactaaaggaggttt

SEQ ID NO: 80370 - DNA, 1016 bp, Homo sapiens
tttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatacgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatg

SEQ ID NO: 80371 - DNA, 1039 bp, Homo sapiens
tcaggaagtcatttcagtaaccgtaagtataaaagtatggattatcattacagttcacctagttcaagtaaagaagaatgtttattcttacttgtttaactatacaggaataactgtacaagatattcctgctgctaaacttcatcagcacatggaactaggaagacgttaagatgactattgtaacttctaacatattctgataattactgaagctctgattctccttagctacctgtattttaaaattgtatattgtatgaattaccaaatttgccttgttgattagtagacatagacatttgtcttgtgatatttagggttcatttttttatggaaagaacataaacatagttttctaatttggagaaatcggtcttaatgcaagtaggcattttaaaattacatttatgaattatttttagaccctacataatcttttttattctgcaatgttaaacagtttctctagaaaatctgtttttgtttcctagtgactattaaactattctctcctacaacagtaatatttatgctataaatttaaatcatcatttttgttttgattgattataagatatatgttttattatcatgtagcctagtttaagagtcctcaatatttctgaagttttagtgattctgctgagagagagcatagaaaaaaataagaaaaaaaaaaaccaacctagtatctgttgttcagtagattgtaggtacttctgtttatagaaataataaggggaaaatgggtattttagaatgaggatacttttgtgttgtacctcttgcttctcttttatttgaataataaaggaaataacatcaaattaatgtttagcctactttagtatggatattgaagttaaaatgtcattcatttgcatttatttaggaaaagaagatatgcttcttaaacaaggtcagatgtatatggcagactcacaggtaataactgtttttttttttaattttaaaaaacatttaaagaaaatttttgtgcctttataaagagaggagaaagcggcattgtacatta

SEQ ID NO: 80372 - DNA, 1004 bp, Homo sapiens
tatttgcatttcaaaagtaagaagtaactgcgtgattggtacagctgtgtccttgtgattctaattttccgtatcactttaatatcttgctatctatgttagattttcctaaaattgaacatatgcaaaagcaaaaggctgaactatagttagggccatgggattggagaggaaaaagtagacagaagatatgaggaccaagaacaagtaggacttggtggttgataggttctcaagagaatcaaaagtgcttctgaatttggatagtgagaagaatgaatgacaactcatacaacagaattgtacataattttcttctcatatccttggccctagtcttaaagacatttgccaatctttttaaaatatctttgccaagttcatgccttttaaaataggcttttaagaattaaaatattttgtgttctttttaaatttaggaagttatggttgctgatgatctggaaagcgaggtagggtgacattttattttaaaccattaaaattgttttaggaattgaagatgatatagtagtaaaggtttaagtcctgaattgagatagagaccaggattctatttctggttattaaagggaaattcaaaatctatagatgactaaaaaaggatgttttgaatgtagtggcatagattattgtaggcattttgttgttattgcctctgaaagtcttactttctgtgaaacttgtcctgaaaataatataaaattctaaacataaagaaaatgtctgaaaacattaagattgaaaacagagatttgaattttttatgattttgtttatagatattgtatgtttcattagtatatttgtagaaattatcaactctattagtagttaaagttcaccaggttggagaattcattaactccagtcctcaatgcaattccaattcacgttttctaaaacacatttttaatccaattccaagcacagggtgattttactgtatttattctgtttcatttcagagagaaaagctgaag

SEQ ID NO: 80373 - DNA, 1844 bp, Homo sapiens
gaaaaatcagttaaggaataccctttctatgccttacgcttcttaactttctcaattttcagtgtccacactgcctatttggatatgtaatgtgaaatcttggtatttctttctctctcttctttcctcattgtctttctctcctttcccttttctctgtgccagtatttaattatctgctgtgttttaggtactgttctacatgctggggatatagtagtgaatacaacaaagttcctgcttgttatagatttctataattagtttttctttctaccttcattgttttggtacgtatatcatctcttactaaaatatcaagctagatgaaacatctttggaaactgaaagtatacttacagattaagtatgttgtcaactagttttgggaaaaaagaatcatatttctataaaaatcctcaatttacatatgaagaaaataatccttcacatgtatcttaaattatttatagggagaaatgctcttcacctggctgctaagtatggacatgcattgtgcctacaaaaacttctacaggtagtggaagtggttaatactttagctttattattttgacaacaaatcatagatgtacttttaatgtgtttttggaattttagatcaaagagaatagtaaactaactttgactatgagcttacatattttttccatcatttgtgaaggaatgtgaacaataaagagcaaaaactgagggaagtgaattgcataactcagtgtattaaaaataaataacaaaggcttgaccttcctgttgacatagctgaaggttggaattttctgttgtctagactatcgtggaagataaagtaatacaacataggacctgtatatttctattcaaacacagataacttatactacataatattattacatttttaatcagataaccacaaaattctaactagttggctaaagttcccatcaaatatttcagtcatacatttttataaacatattcactaagtttcatagcagaactcacctgcttttctgattcagtatctcaagttttaattcttggtggaaaaaaaaaccccaaacaatacatattttcctgtatttcatgccattcattataatgtaccatatgtttcctgtttggtgaaacattgttaatttagttatataatgttactgtatttgttccatgtcagcatatttcatggattgtcggatagtctttagcttctttgataagtggaatattttaagattaaataacagctgttcatctgagtctggatatctaattttaaaataaaactctcctactttactaagttttctttactttaacagtacaattgtcccactgagcatgcagacctgcagggaagaactgcacttcacgatgccggtgagcagtggtttcccttggatacaaatatttgttaaaatgtctagtcatttgaattaatttcagggttttaacacatagatatttatataattcatggagaaacaaagaatattaaaaacctgtttgcacaaattagagatttattagattataccgcttaaaaagattcattcagtcagtatttacaggccagtcagcttgctagatactaaaggtacaaaggtagataaactataatcctgctcacaaggagctccaagctgtgtgtgtgtgtgtgtgagagagagagagagagggaaacagagagagaatgtgtgtgcgtgtgtgtgtttcatgtctttgggaattggagaaatgggaagaagactttccttaaactatgtttacctaattaacatgtctgaacctcttttttctcatttgcaaaatgaagttaataatactactgcaataagtag

SEQ ID NO: 80374 - DNA, 1007 bp, Homo sapiens
agaggtgaaaagtctcatttcctaaaattcttctcagtctttacttgcatgaatttattcagaatattataactggaaaccagatactaaatatagaaatgaatattaggaagtgaatagttaatgtgtgatgtgggtcactgccttggaatgcttaggtattaaatatagtaaagataacagcaggactataaattaagtagtttttaagagcaataaagttggaaaagtttcaagttcataatgtttcacttttatcaagtagcagtttgatagctatggaaacactggttattttgaatcttgccccattactgaattttaagctatttatagggctcacagcataaattgtgaaaatttaatatccaaaagtgatattgttcttcatgtttcttttttctcaaatgctaagatgttaaaagatgaagtgaatcttttttgggatggaacttttcagtgaaacctatatcactgaaatcagttctgcccattcatacttcgaatgttttgagtgactggtggcttgagtttttgtttggagttcttgatataaggttcaattttgagtgacattaaatagtcagttatagtggtgtaatttgatgaactgtgaactttagtttttgaactatttgaggagtgttagtcttgaagttttcatcatagagagtagaattttttttatttttttatttttttgagacagagtttcgctcttgttgcccaggctggttgtgcaatggcacaatcttggctcactgcaacctctgtctcccgggttcaagcgattctcctgcctcagcctcctgagtagctgggattgcaggaatgcaccaccacccctggctaattttgtatttttagcagaaacggggtttcttcatgttggtcaggctggtcttggactcccgacctctggtgatgtgcccacctcagcctcccaaagtactgggattacaggcgtgagccactgtgcccggccaagagtagaattctttctagga

SEQ ID NO: 80375 - DNA, 1038 bp, Homo sapiens
ctgagggctcaagcgatcctcccatctcagcctcttgaagttttgggattataggagtgagccaccacacctggccagggtgagcttcttgagatttgaaagaagtggataggagtgatctaggaaaggttaaatttctttcagagttaacaacaagagcaaaggcatagagaagaggaaatatcacggagctcagagctgggggaaggggaaattggatactagaaaaatagcaagggaggatcctagaacaatagcaaggggattgggtgggaagtaggaagtagaggtttgggggtagatcttggaatagctttaaaaatggccattttcaagagttgttgggacttcttcctgtggttccagaagtgggaaattccaaaatcaaacgtgttttagatggattactgtggtagctctgttgaggatggatttgagagggtctagcctggagacaggtggattggttatgaagctgctgaaatattataggcaagaattagtgagggcctgcatcattacaatgctggaagggatggagaggagggcccaagttggagaaacacaggccacctgaaaccctgaagaagttgtgacttaccaaagtcacagtcaacagacacgtggtcagaaacccagcctgctagccccttgtgatttccaaatgtcctgggtttgatgcactgttcagtccctgattgaatggtaattacgctgtaagagggagagagagagcactgtccatatcttcctgtatgttagcaatttagtgtttttattttattttttttgaagtgcacatatttatattcagttcgggtgaatagctcaatgttctgatgatgatgtttgataaatacccttgaaagtttaacttactatgctaataatctttataagcacagatttttagcaggtagctaatttgttttctccaactttttttttttttttttttttttgagacggagtcttcctctgtcgcccaggctggagtgcagtggtgcgatctctgctcactgcaagctccgcctcctg

SEQ ID NO: 80376 - DNA, 1050 bp, Homo sapiens
aaaaaaattataagtaatttgaaattatttgagcacatacaaatgtcccaattagaagtactcagtaaatgctagtgagttacttagaaagaaactgcttgtgagaaatccatgtgctgatagccaagatttattgagcatgtatttcccaggcattgttctaagtgctagtaactcaatcctcaccgcaaccctaagaagtaggtactattgccatcatttcagatgcaagttaaataatttacctgcccaagacactatagctaataagtgaagagttaggtagcctggctttggaacccatgtccttaccattgtgaactgatgtttcaaatttaatgctatgggatttacaccttaagccatatatacaaaaaaattggagaaggggagagaggaggcattttatgggaaattccaaaaccaatctgtgttccctccagagatatgtggaattgttgcattcctgatatccttccaataatagattctgttatttaaaacatttttaaatgtgatagaaaaaaatagtttggcttaatccatgtttttgatttccagggagggtgaacatatttctgtgcttattggctgcgttcatttcttgttttaggaattgttcattttctttgaccattttttctgctgatgccctgttcatgttgatctgtaagagctttatacgtccttatttttgctacttggccagccgtcgctttagagtaatgtctgtctcactatagctgtgcttctgttaccttccctgatatttaaaacagtttttgtttcatgtatttaattttgtgataattgatacattaaggttcttggctattttatattcattgtagagtgtaacttgtcgtataaaagcctctaatttgttgcattataacttttgttttgaattctacattgttagatattaatactgtcacactgccccttctgtcattttgctttgtatgcatgtatacttacccagtatattatactgtcatccttggttttatttggaggggtgtgtgtgtgtgtatctacaactgtgta

SEQ ID NO: 80377 - DNA, 1102 bp, Homo sapiens
agcttggggattgtggtaaaggaaggttttcattcattcttttttttttttatttttgagaataagtctccctcttgtcgctcaggctggagtgcagtggcgcaatcttggcccactgcaacctctgcctctcgggttcaagagattctcttgcctcagcctcccgagtagctggtactacaggctcctgtcaccatgcctggctaagttttgtgtttttagtagagatggggtttcaccatgtttgccaggctggtcttgtactcctgacctcgggcgatccacccacctcggcctccctaattgttgagattataggcgtgagccactgcccccggcctcattcttttttttttttaaaccttgaattaaaatttaaattacttgacaagtttagatcactgttcagagagaactgactagtcatgaaagtttcatcttcagaaattatcctattagtgagtttataagttcatctttctgcttctcccttcctctctagaattagctaatagccagcaaaattttgattttatcagccctgtttaacttatgtttgtatctttggtaaactagatccaagaataatagatttgaacgttataacatgtattgtttcatcactatcatatggaaacttttactgtcctgttacagttttgcaaatgtttgtcctgccacctaaaggatacagcatattattgaaatttccacctgcacgtgcttatttatgcaaaggaagtcaaattgatttctgtggggaatttgcctaaaaatggatggttgaaatgtgctgcctgaaattataaatggaacaataggatataatactcattgccttattttccttaatcataatacaattaaaagctttatatagcttttatatcattagaaaagataatgtctcttccaggcttaaaaatgtagccccaaaacacaagaataaattggattgtttgtagtcacacaaacagttttgtctgttggctttgttttattgtcagaaatcctaaatattgttgacattgacttattttcaaatgatacagtctccaagatgatatgcagaagatgaactgatgtagctgagtgaccaaag

SEQ ID NO: 80378 - DNA, 1090 bp, Homo sapiens
gcatgaaaattcaaagaatattcagaaacaaagtataagtatattaaattcaaaatccacttagaaacaaacttaagatatataactagtttcccctagtgcatttcttgtacttatattatagaaatacttccaaaagggatttgaggtagtatcaatgaagagagtcaaactctgtaaaatatttgaagagatttattctaagccaaatgtgagtgaccatggaccgtgacacagccctcaggacgtcccaagaacatgtgcacaaggtggtcagggtgcagcttggttttatacattttagggaggcacgagacatcaatcaaatacatttaagaaatacattggtttggtccagaaaggcgggacaactcgaagtggggggagaaaaacagagatcttgcttcagctgtttcctaactcatttatgaaaaggtaagatagccctctgtcagaagcaaaaatatctacgtgattgtatagattttaaaaatctatataaatagctgttttaaagttcttatctactaattccaacatttgtgtcatctttagtactgttacagtgactttttttctcgttaatatatgtttcaatttttattgcttcttcctcatctggcaattgttttgattgtattctgggcattgtggatgttctgttgagagatttaaggattattgagttttgttttgatagctactagagaatcaggttgatcctgttgaggtttatttttagtttagttttttttttaaggaagatctaaagtgatacttattatagaactagagtagtatatttttatatctgttaccagcggcaaatctatatgggtctgcagcaacctcaattcttgcctcctcagaagaaagaatttgactgaggggcataaggcaaaaggagagaccaaggcaagttttagagcaggagtgaaagtttattaaaaagctttagggcaggaatgaaagggagtaaattacacttggaagagggccaagtgggcaacttgagagatcaagtgcccagtttggcctttgatttagagttttatacgttggcatacttcccaggtcttgcatcccttct

SEQ ID NO: 80379 - DNA, 1055 bp, Homo sapiens
cgctccttgagtcctggcctggggcctcggatctgtgtgtctgtctgtctcagtttagttgctgcaacccagcgagcgcctggagcccgagtggatgggttgtttccgccaactctggacacttcctcaagtgcagcctaagtacctgcggccccttggcgcacttacagaagtagcttttgcacagcgagctcaccttggagctctacagatctggaagttaagttttctttttatttgaaataacatcagccctcacttgggaaggggattttagggcgttctcgggcccacctaagtatctggaatttgtggtctagtaagttttttaagcagtccgcacccagcaccgtacctcccagcctcctttgccgtcttactaaaagtgcatgcttgcttctcttcctgtctcctttgcgatctctaccacgctgcgcttcgcccttttcgggctatgagtctaaagcttggacgtgggtagcaatcattggatgcctgttggaatttggaattagagaaatagatacccgagagagatctaaggaatcgccttgtccaaccctcctttcacagttggaggcacccaggacccctgacagtctgaagatttttcaaggatcacacagcttttaaaatccgcgtgtcttctacttgattaatattgttggaggtgatggagtaactgggcttactagggtcttactgggtctcaatatacaaagaagcaaacattttaaaaatgtgacttaaaatacggaactcttcaattcctatagatttttgttggcatcatagttgaattcctttagaaaacaaaatcctagccctgaaattaatgtgaggaagcaagcagatgggcgtcctgggactttcctataaatctctgcagggctggagcagggatttcccagaggtctgggcctgggaaatgagtttgggtgatcaggatactggagccccttctgaataagcaactgggttggtttcttgtggggaggctggccagtggaactcatgtgatctcctctgtgcccagcactgggcggggcaccagc

SEQ ID NO: 80380 - DNA, 1046 bp, Homo sapiens
tgcacttttgtaacaagaggcaccagcaaacattttgctgccatatcttgtgatcttctaaggatggttttttggagaggggtaacatagaaattcaaaagcagaactgatttttataaatccctcataaaagaaaattttaaaagctcccgaagtggctttggacattttcaaatatgttaattcacagtattttcacttaatcttgaaatttcaggggtcaccaagatggtgaagcatcattctttaattcagtgaattaagctcctactatatagcagccactgtgctaggtgctggggaataaagtagtgacaaaacaaactccctgatctcatggagcttacattccattggatagagagagaaatttaaataaagacatagtatgtgagacggtaaatgctatggagaaaagggctgggctgggagagggaccactgttttttgtagggtcaaggaagccctgtgaagacaagatcctctgggcagagaccttaagaagtgagggaacgagtagaattgaccaggcaacctggaatgcagttcctcggagtcagaggaaaacctagatgtgatctcactccctttcctgccccaagtccccctgaatgctatgaaagtgcaatctcagatcagtgattatccaaaactgctccttacaaatatgtggctactgtgtgtgccaagagctttgaggcactgaggtgtaacatgtttatggagctgcagctttttttttttttaacaaaaccacaccaatctggttttctttttaaatgagtaagcagtgccagaatgtgttacaaatgattcacatttttaggcctgggtgcaagaaagcacattaactcatttgaggtaggaggacaggttatacaattcccattttacagatgaggaaactgaggcacagagagacggtgatttgcccaaggtcatgcaaccatggagcatggacttgtgagttgtgatgcacatgttcttgatttagaggtcaaattggatccagcagggatacagctagaagattactgtccttttgc

SEQ ID NO: 80381 - DNA, 1693 bp, Homo sapiens
tggcagtacattgagctccacagagacagcgccagggcaagtgagagccggacgggcactgggcgactctgtgcctcgctgaggaaaaataactaaacatgggcaaaggagatcctaagaagctgagaggcaaaatgtcatcatatgcattttttgtgcaaacgtcgggaggagcataagaagaagcacccagatgcttcagtcaacttctcaagagttttctaagaagtgctcagagaggtggaagaccatttctgctaaagacaaaggaaaatttcaagatatggcaaaggtggacaaggcccattatgaaagagaaatgaaaacctacatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttcttgtctataaagcatttaacccccctgtacacaactcactccttttaaagaaaaaaactgaaatgtaaggctgtgtaagatttgtttttaaactgtacagtgtctttttttgtatagttaacacactaccgaatgtgtctttagatagccctgtcctggtggtattttcaatagccactaaccttgcttggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaaagttgcagctgttttgttgacattctgaatgcttctaagtaaatacaatttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacccaccctgcatatcataatgagggtaaagttaagttgagatagttttcatccataactgaacatccaaaatcttgatcagttaagaaatttcacatagcccacttacatttacaaactgaagagtaatcaatctactcaaagcatgggattactagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaa

SEQ ID NO: 80382 - DNA, 1051 bp, Homo sapiens
cagttatggatgaaaactatctcaacttaactttaccctcattatgatatgcagggtgggtagacaaaagctttttattagctaactatatgaaaggataaacactgtaataattcatgtgattcaaaatgggcaaaagcaaaagactagcttcccctcaagaagaaaaatttcagacctatgaaaaggacaacaatactaataaaaaaattgtatttacttagaagcattcagaatgtcaacaaaacagctgcaacttttttttttttttttgcaattacagagtggtattcagttaacagaacaacaattatttcgtataagctgcatcagagacaactgaagatgaaaaaactaccatccccatatataactaatttgtgctgtgcaccaacaagaacctgctttaaatttccatgccaatttacaacccccatactgtaccaagcaaggttagtggctattgaaaataccaccaggacagggctatctaaagacacattcggtagtgtgttaactatacaaaaaaagacactgtacagtttaaaaacaaatcttacacagccttacatttcagtttttttctttaaaaggagtgagttgtgtacaggggggttaaatgctttatagacaagaaaaaaaaactgcgctagaaccaacttattcatcatcatcatcttcttcttcatcttcatcttcttcatcttcctcctcctcctcatcctcttcatcttcctcatcttcctcctcttccttctttttcttgcttttttcagccttgacaactcccttttttgctgcatcaggctttcctttagctcgatatgcagcaatatccttttcgtatttttccttcagcttcgcagccttcttttcataaggctgcttgtcatctgcagcagtgttattccacatctctcccagtttcttcgcaacatcaccaatggacaggccaggatgttctcctttgatttttgggcgatactcagagcagaagaggaagaaggccgaaggaggcctcttgggtgcattgggatccttgaacttcttt

SEQ ID NO: 80383 - DNA, 1044 bp, Homo sapiens
aagatggcaccatgctatagcagcttaggtcatggaggttggaatgctaaagtgtttcctgttctggggcaatgcagccacatgaactcccagtaactgtccacactggtttctggtcctgtgaggactgggagacccttttatagcaatgactgttcctgtctatggaggtgatggggcaaaggattccagcttactttttccccgtgagaagaagtttccctggctctgagctggtcctggtgggggataccatgtggcagagggaggatatctcacttccctctctgtggtgctatcctgggcttccatgctctatagaaattttgttgctcccccggtgctttccagtgtacttcatcagtaactccagtcaaagtgtagtttatttattgttttggtacctttttgtgtcaggcaactctagttggccatcatgctgacatcactctataagttactctagaatgtttaatttaaaaactgagcaaagtgtatcacatcttgggatatggtacctccttgtcaaagcattattaagaactttgtagtagaaagatagattaaactttttctcagaatcatgtggagattactttatatagagaacatatattttagaatagtttttcaatataataaacgtgtatttattatcttggccaccaagatcattgccattcactcaagacaagaaaggattctctggtttccttggtggtgagtttctttttgatgttttatcagagctttgtggaactgtggttgtcatcctggttatgtgctcaaaaacttggcagcagaagcagtactagtagtagtaacatccatttattcctgcaagatgtgaaatgaggaaatgcttattaaaacaggagtcaacatgtttttaaataaagggttgttgagaatattttaggctttctgtgctataaagtctgtcacaattcttcaactctgcttttgtagcacaaagccagccatagacaatgtgtaaatgaataagcatggctgtgttccaataaaactttatttacaaaaaca

SEQ ID NO: 80384 - DNA, 1949 bp, Homo sapiens
aaacaagacacaaaaatcagtaaccataaaattgtactacattcgagtcgaggttgtttaaaaattgaaacacatcataaaaacagtgaaaagatacgccatggacagggtaaagatgtttacaacaatatatttggtaaaagatttttattcagaatatataaagaaccccttcagatcattaagaaaaagttaagccagtcaatttaaatggcttaaacagacagttcatgtgagatgatatccaaatggctgataagcatatgaaaaggtagtcaatcaaaatcattagtccttaggtaactacaaattaaaatctcagtgtgacactaccagaatggctaaaataaaaaacactaccagtgttggtgaggataggaagcaattggaactttcatacactgctggtgggagtttaaatggtaaaccactttgaaaaactgtcagtgtatcttaaagctaaacattgcccatgctatgatctggctactgtattcctaggtatttacccaagataaatatggacatatatccaccaaaacacatggataacaatattcagagtagtttcctttacaataaagctaaactggaaataacccaaaagtccatcaataagagaatggagaaatacattatagtgtgtttatacaagagaacaccaaacaacaataaggaaaaaataacttgtttctagccaagatggagcaccagggattggatttaccttctcacttgaaacaaccaaaaatacccagataacatatatgaaataatgtttttcaaaaccttggactttagacaacaaaagatagttatcactcagagatagaaaataaatgaattgagtcataaaatgtccccagcttactgccttgagagtttcctggtcttggtgcagggaggggtatgctaggcagaacctgttagacatcttgagttaaggagatagacttaagagtccagcaagatggccaggcatggtggctcaagcctgtaatcccagcattttggaaggccaaggcaggcggatcacctgaggtcaggagttcaagaccagactggccaacatggtgaaaccccatctctaccaaaagtacaaacgttagccaggcatgatggtgagtgcctgtaatcccagctactcgggaagctgaagcgggagaatctcttgaacccaggaggcggaagttgcagtgagccgagatctcactgggcaacagagtgagactttgtcttggaaaaaagaaaaagagtccagcaagaccaagtgatgatggtctgcaggatagagtaccagagaggagagaactacacagacagaagactgtggagctctgcaggagatcctccataaggatgcagcatactactgatcagcacacacatttgaggaaacaatctgaggttgaggaaagaatcatccaagagaatgaaaaagaacagtgcccagcattcattcaggaccaagaacagtgactgttcccactaggcatactttaaaaactcataatccaggaggcattgaatagaatactcaggaagctctcacctcagtattgggggaatagttaaccctagactgtgtcctgctctggatctaacaaattaaaacagcagtaatgaaatgattaatctgtttctaaataacttaactgtatcctagcataaagtatgggaatataaaaatatccagcacccaacaaggtaaaattcaagatgtctagcatttagtcaaaggttaccaggcttgcacagaagcagaaaaatattaacattattccccataatgaggagaataatcactgaattgaaagcaattcagaactggcacatattttagaatatgaaaacaaagatattaaaaattactaaaaccatattccatatattcataaagttaagtagaggcatggaagatattaaaaagacacccaaatctaacttct

SEQ ID NO: 80385 - DNA, 1087 bp, Homo sapiens
ggctctgttgcccaggctagagtgcagtggtaccatctcagttcactgcaacctccacctcctgggttcaaatgattcctgtgcctcagcctccctagtagctgggactgcaggcatgtaccaccacgcctagctaatttttgtatttttagtggagatgaggtttcaccttgttggccaggctggcctcgaactcctgcccgcttcggcctcccaaagtgttgggattacaggcatgagtcaccgtgcgtggcctccccaggcactgttcttatcactttacactcatggtcctataagagagttgctaatagcatcttcattttagaggtaaggaaatagagtcaggcttgaaacccaggccatcgtggctctaaggacgtgacctgatgaagtagatgttacacctgaggaatcagaggacctagagccagtggacaagctgagttttgaaggcggtgctgctcacccccagatccctgcagtactcatcctcctgcgggtgccaactgaagggatggagggctggatttgggtgaggtctgagtgggaaagaggcttcttgaaagcctctgtggtggagaacctagaagagctgcctgaggatcaggctcttgttggccacaggcctgtgctgcaggcattgtgcctgtgtgttttggcagcaggaaatttttttcttcaaatgtattgacgggggccagttaaactgtttactatgaagttcctgcaagtttttatcatgctcttgtgatttgacagttactgatgaaataatccaaatattagcctaggaggcctgtgctgcctacatatgtcatgctcctcccggctgatgaaaatcacatttgcttatattcatcagtcattaggtacttgcatagtatatttgaccccaaggagaaatgtcagcatattttcaggatggctgtccgctccactctctgtttcaggtttgaagtttgaggaaaaggctgttggagtttagatgtttaaaaaattgttaggttgctctgctaggcaacaggaaacttcattggagtcagataacaaatgaagctattcaaccttccaccagatatttatt

SEQ ID NO: 80386 - DNA, 1051 bp, Homo sapiens
tgatacagtctgatttggcttggctctgtgttcccacctaaatctcatcttgaattgtagttcccataatccccacctgttatgggagggtccaggtggggataattgaatcatgggggcagttaccccttgctgctgttctcgtgatagtgagttagttctcacgggatctgttggttttataaggggcttttcctccttttgcttggtgcatcgccttactgccaccgtgtgaggagggctgtgtttgcttccccttctgcgatgattctaagttttctgaggcctccccagccatgctgaactgtgagtcaattaaacttctttcctttgtaaattacccagtctagcgtaagtttctatcagcagcatgagaacggactaatacactgtccttcccccaaagctgttaaacagctaccaaacctgccagtctccatttcttagaaatttctgtgagaacactccatgaatcagtgggagttgtttacaaaagattaaaagaaaaatcacttgtgtagctgtagtctgaggtgggaaggtgcacccctctttccttttatctgggtaaaatctgccttggtacattcttgtgatgccaccatgtttaccctggaataattatttattgcctagttaccctttggagccatgttgagcacaacatccagtgtacctcttcggatattttaatacaatcatgttgtcaccccgcatcttctttttgccagcctgctgaataattttatttccttaaactgatttctgtgctttggggcttgctgtttattatcctgactcttccctttagagtgtggttaatgagtcataacgcgcaggtctcctcacctgtgtgagctctgatgtgctgggcttggaaacaaggaatgttattgggattgattagtgatgccttgattgggcttgggaagggggaatggctacatctgtgctgcctctttgccagttctatggtttttcaatctttccaatcatggttacctaggtgccgattaatcctgctagttgctcgaaaatttgagatgagtct

SEQ ID NO: 80387 - DNA, 1047 bp, Homo sapiens
tagtagctcagttttccatcatgaaccagagcctcatctttcatggttcctgtgcctccgagggctgggctactggggtgtctgtcagtccagatggctttgttctcaagtttcctccacagtggatatgaatgtttgcaacttacactcaattacaacgctttcctctacttttctccaagtttgctgaaatctttatttgtggatatctcctctctttttgctttgtcctcataggttaaaacgttttaaaattccctaacagtaggaaatttagtagggttttggaagggagaggaggtgtaagatggtcactcttccatgtttaactggaagtggaaagtctaggcttttgcttcaggcctgggaggtgcacatgaaacagtccctcccagtggctgcctggggggtccctgaagggtgtgagaccaccgtgaatcctggggcagggcacttgcagtacatgtgctatgtgtttgctagtattgttttagatgtttgatctcctagcctttgcttttctttgtatttttcctgctttagtccatttcccttctagctccttctgttctcatttatcttctgctgctgcttggagttacattttcagcaagtctgtaacacctctctgaaccaaaggctctcaagttcatctttctttctccaagcctacgcctgtgctgctgtcatgagtggcgagcttctgtttcttctgtcttcttgtcagtcccaagtgcccttttacagagaatgcctgtttttcactgtctagctcagttaccaggagtccctgtgaatgacacccacaggtccctcaaagaagtcagatttctcttggacctgataaagcaaacaaaatgtgacccaagcaggctgagttggacgggtcccttcttaccttcgccctctgccatgttgacattcttatctgatggcacaggctgggagttcaggatccacttagatggggtccgttcaggggataccagcgttcacatttttccttttaagaaagggtcttggcctgaatgttccccatccggacac

SEQ ID NO: 80388 - DNA, 1032 bp, Homo sapiens
ctgtgccctacccacctgaggtctggcatggggcccaggaatctgcattttatgagctccccaggtaattcagatacatctggttcgtggatatgtgtttcggcccactaagaccggatgacctctgaagcctccctaaggcctgttgtctctattagtctgtgcctctcgggcaagacgcaccttcctgccaagtctctctgggtgtttgtctttggatcagagaatcagtacgcagagcagggctgagggagttggccaagcagcgtgcataactctgcgcagcacctgtcctgcattatcctccacactggccaaggctttgtgtccctggcttcatggacataaaattttatcacaggtttttatgtgttatcacattgtaaaagtgccataaaatcaagggtccagttttcagtgcatctgaaaacgtcgtattcctttaagttataatcttggttgcagtcattttggtaacttgttgagaagcctcatcccgaccctgccatttattagctataactagatttttaattgctccgagcctctgttttctcatctgcaaaatgagattaataacatcgacatcatgaagtctcttgaaaggattaaatgagataacctgtgaaatgctactgtaatggacctcagtgctcttttctttcttttggctgtttctgccccatccctgcttccattattatacatcttttcatgagcttattgcccatttatatgtcttctattgtttttaatgaggtgaaattcacatagcataatattaacccatttccttcacatccttgttatttatttttttttaattatatccatcctagtagtgggtgtgaagtggtattcattgtggttctgatttgcatttcttgaatggctaatgatgttgagcttcttttcatgtttttgtgtgcttattggccattcatatatcttatttgcagaaaaatatttattcaagtcctttgctctcctcttcttttttttgtttgtttgtttgtttgtttgtttgtttct

SEQ ID NO: 80389 - DNA, 1063 bp, Homo sapiens
tggtgcatggctgtcacccaggacccatggacaatccccaagggccaaataacgctgaaattggcattgaccaaggctgcggccaaatgccagcccatcaaggcaaatgagtcagtttgccagtgtctgacccaagcctaggagaagaaacaaaccagcctccctctctctagttctttgaaagtaagcccttagcctgatatgtttgttgcaggatagacctgtggccctcatagtgctcagaactgtcagcagaacttcttcactggaagaaggaagatgcacatctttcatggaggttgtgctgtctatctgggacaaagggggaatccgttacaaaatctgcttctttttgaagctgcacattcagaaacagactatggctaagtgacacactggagcagatgggccagggctgtgctggatttgaaaaaggccctccttcctgagcagaattaatggagctcaggtctggggagggtgagcgcactcttggcaggcagctgtcttgtgtgacttgtgctgcactcatctgtgaaacatgttggatctgagaaatgagtcttgaatcctgggtcatgttagcatcagaatcatcttctgttaattacatgagacaatacatgtgaggtgcttagagcagtgcctggaacacagctcacgttcaggaaatgcaaatacttgtcagccccagcaacttcttctgcttttagttgagggctcttttcttaaatcagtattgtgggctttgagatggtatttcaaggaaacagaatttcctactctgtttaggacttgaaccaagtaccccctaacctctccccaacccctcccaacaaaaatgcacagattttatttaatttttcttttcagaatctttatcccttagaacctagacttctagaatgacaaatatatttaatatggtttcacagagtttgtctggacccctttttgaggagaattctggggctgatttcagacccagagaaaaaggatataatgattgatgagtgatgtctgtcacgggtgcgagagaagggtgggaggtatgtgtgccatg

SEQ ID NO: 80390 - DNA, 1053 bp, Homo sapiens
gagatcctgaagtcagaggacagcctgaaaacaggagagaagaaacaacaggggtgcagtctcagcatgggagtccctcccttctctgacccccaccttgagctgatcgccatgcaggttaatagctttcactccgggtttccttgccttccccctgcccacccccaacttctgcccctgccctggtgtgccctggcaggcgcagaccctgcagtggctgcacagtggcccttggggacattccgtggctacagccactttggctactctgacatgttcgtccttgttctccaggcagccgtgttggaggggatcccacctcagccatggacggtgcctgaagcggccctccccaccccacagcagctgatgggggtccttggataccaactagatgtcttctttcttgtggcaaattctcttttgaggctgtgtgtgccaggcacacccagatcctcagagacagtccacaagtgttgagcttcagaaggtctttgagttccgtttgtgctcgagtttttctgttctcttcctcccgactggcccatcttgcatatagaagggtcttaagagacagcctttgccatatgctaaaaggttccattttacccatatgccagagcctttgtgcttactgggcatgtattatcagagctgggagggaaaattatttcttctctggacaaacaaagtccacccctaaatgatctgccttgactaagccagtggctcatgcctgtaatcccaacattttgggaggcagaggtggaggctctcttaaggccagaagttcaagaccagcctgcataatatagcgagaccctatctctagtaggtaggtaggtagatagatggatatattagatataaagagagatagatggatatgttagatgaattagatagattagatagaccctgtctctactgattgattgataaataataaatagcctgccttgcccgctgtattagtttccagggtatgccatgacagatgactgtaaagttagtggtttaaaacaacaaaaattattttctaaccatctcaga

SEQ ID NO: 80391 - DNA, 1004 bp, Homo sapiens
taaatttaaattattgatttttgtggatacatagtaggtatattatggggtacatgagatgttttgatacagacatgcaacgtgaagcaagcacatcatggagaatggggtatccatccctgagtcctgtaatgatcttaatgcagtccttcctgctttctctgcagggacttttaggaagatgtaggaaggaatgatttgtccactgtggctgcagttacctccattaactctagatggcactcatgcattgattgggaaaccagtcactgataatattaactgcctggtagaaactgacaaattcttcagtcagggtggtgaaaagttaaatataggtggctcccaggcatggctgggtgaatagattggtcaaaggagaagtggtgaaaactggggactggctgtaaacacatttcatgagtacatacaaacccccttgccttctgttcattctccctcacagcagccaaagtgggcaaaccagaaaatggactggccagccttaccagtgtgcctgtctgaccagcgggcgacctggtcactgccccagagggtcaagggaaacctattctccttggccacattccttgagatggtgatcacagaggacactcagttgccacatcaggactttgatattcagatggaaaaggcttatatgttgatttgagttagtaattagggcttttaaactgctcttgtcgacataaacacatacactattattcagtacttctggtttaaaactcttgttccactgaacacattatttgggggtacattgatactgtttctatgtggcatttcagacactggtgaagaacatgagctttggagtcagacttgggttgctgtctgggttccatcacctactaactattgtgtggtcttgggcaggttaattaacctctctgcgcctcagaaaatatggaggtgataataaaacctacttcacagagtcattgtgaagatggagataattctgtgtagtacttacagtg

SEQ ID NO: 80392 - DNA, 1050 bp, Homo sapiens
tccatctcaaacaaaacaaaaacaaaaagaaaccccactctttcctctcttgcacctctaggaaagaatttttttctttttaaaggtaataaaccttaatacttaagttaaacaaggcattttctgtatgttgatgtaactggatagctttgaaaagaagggtgggatcatccctggcctgggtcttggagtctggccaccaaagaaagaggtggcctggcccctctcccagctgtggggctccagggccaaggagcccgaggccccgcgtgtgacacctcgctcttaagatactctaatttatagttaacgccttttaagcaaacaagagggagaaaaagaatctggttcatattatggcaacttgcaatgaagggaagtctggaagttcaaagaaaaaatgtcccaggaaaagcacagcccgttaaaattcattctaagtggtcagaaaggtaattgaaaagaaggctttctcagtgcagtgttggcaggctagtttccctccctttgcaatctcagctctccaaacatctctccctgacactaaggtcattccaaagaggaacaaaattaacaagaattcattactaagacatgctaaattgactgaatcaataaaatccccaaagcccagttgaagagatcaagatgggaggaataaacactctctccttccaaagccagaagcctgtgggacccctgctacagctttgattttcaacatgaatcttctctgatttgactagaggctccctctcccttcctatgcccacctttgtcacccacaaatggctgcatcacctgctgatcacgtggggctggattttctaccatgagaaaattcctgcctggtttctctgggccaaggcatcttttgtggctgtgtgtatttgttggaggtctgcagagcaggagaaatgagggctagaaaagagcagaactttgctttccctccttctgcctgatgtagaagtcttgagccccttgaggctagaaggttttcatacttgatgcagcagcggcaccacaatgatgaaatcagaagggctt

SEQ ID NO: 80393 - DNA, 1051 bp, Homo sapiens
atgtgtgtgccttctgaagtatgagttgtatttgctgagcaattgagtcttccctgggtttctgggatcaggtgcctgcagtttgataaaataacctctagatggagcttttgcaccttttggttgagctgggttgcccgtggggcaaatccccggtaatctgagcaggatcaaaataaacttcgttactccttcttattacgtaagtattgtgtgtttgtggtgggaacactaggaaatatagatttgcaagtgggagaaaataaaaatcaccgtgcagaggtaaccagcattaccatgctggagaatagccttctgatcactttttctgtgtgtaatgaaaatggtttcatcctcgaaatccccttttgtaactttttttcacttagtaaattgtcacatcaatacagcatacaccaatcagtgtcactaaatattacaacaccttagttttataattaaagagtatctcagaacatacagtaagatgtatttaactcagaccttgtgattaaatgtttacattatttaagatttttcaccattatgaacaataccaagatgaaaactcttttttagacaaattttggctcatgtccacgattctcagagatggaactggtgttcgttgaaaatgtatgcattatgaagtccgctgatattgcctgcttagagcaggactcccacctgactagtaggagaaaatttaatcacaagggtccttaaaggtggaagaagaccaaggcagatgagggaaggttgtgagaagaactcaacctgccattgctagctttgaagatgaaggggagacctactgatcgggtaggagatgtgctctaagtaggcattattggcaggcttagtaatgcatatattttgaactaaaataaccccaatatcattaggggttattggaaatccaaagtctcaggccccatcccagacctactgatttaaaatcatgttaagatacgaagtgatttgtatacactttcagagacagggtcttggtctgttgccctggctggagtacatcagcgcgatcccagct

SEQ ID NO: 80394 - DNA, 1101 bp, Homo sapiens
ttctgtgcttattgaccatttgtatgttttttcctggagaaatgtctattcaaaccttttgcccatttttaattgagttttcattttattattaaagtataagaatacttcataggttctgatacaagtctcttatcagacatgatttgtacattttttctcccattctgtggattgccttttcaccaacttgatggtatcattagcagcaccagggtcttgaattttgataaagtcccatttatttatttttcctttttcacttgtgcttttggtgttacacctataaaaccatcacctaacccaagctcatgaagttgctcctgtgtttccttctaagagttttaaaatcttagctcttatagtcaggtctatatattagtgtcctatggcttttacaacaaattaacaaatttggtggcatcagataacaaatttattatcttacagttccagagatcagaagtccaaaatgggtctcactagactgccatcaaggtgttggcaaaaccgcaggccttgtggaggctttaggaaaggatccctacttctggctctttccagcttctggaggctgccacattccttggttcccaggtccccttcatcttcaaagcctgcaatggcaggttgagttcctttcacaaccttccctcctctgcctggcccttccacatttaaggaaccttgtgattaattgtgcctaccttgataatctaaaataatctctgtattttaaagtcatcagagtagccatgttaattccatctgccaccttgttttccctttgctatgtaatgtaacatattcacaaatttcagggattaggacgtggacatcttggtggagacattattctgcctaccatgatctatgatttatttgtttaatggacaagtaaaaattgtatatatttatggtgtgccacatgatgttttgggtttatgtacacattgtgactgagtaaatcaagctaattcacttatgtattataagaacacttaaaatctctcttagcagtttccaagtatataatatattattattaattatagtgaccatgatgtagaatctttgatgtgttttgagttaatttgtgtg

SEQ ID NO: 80395 - DNA, 1023 bp, Homo sapiens
atttattttgtcattgatataaattagagaaataactttactcctcaagtggctggccacattcccaaccctttgccttcctttccttgatgatttgaagtgactcattgattgcacacgaaatccctctacatgtttagtcaggtaaatgatctgtctcttctgtcgctggttgtttttgccactgttttcattattacggcttcgtgctatgttttagtatctgacagttaccttttgtaagaaaataagatttcataaaataatactttgtgcaatttgaattaaggttttctagacagataattattgcttgaagcagtggttcccaaaccagcaggcatccacagggcttgttataacacaaatcaatgggcttaacccccagagttcctaattcataagtctgggatgaggcctgatagttgcattttaaaacaagttccctgatgatgctgatccagggaccatagttgagaacctctgccttagagcaaatacttgaaacaaagaatacagtcaacatgagaatggttccaatgcattgtctgaactagctcccctgtgtgctgtaagagttaggatgggcctgtatggtttttttgagcatctccctgattgtgtctctggcccttctcctggccccactttaaatccctgagcccagttgagccaagtaacataaccctcctttcagtgaacctgcaaggtgctcagcctaactgcatggctgccctgatagttacaagtgctgatccagccaggctttggcccctttcagatagaaatcagagaagggtaaggatgcagtgacttgctttgttgtagattctcatgattgtccttatctttgaagagaagggagagcaatcaccagaaatgcagcagagaactcttctttgctttcctcatttcccacctctgtggctctttaatggcttcttggttttgtacaaagggagagttaattactaacacctgcttctgcttctcctttcctgcatggccagctccctgactgat

SEQ ID NO: 80396 - DNA, 1101 bp, Homo sapiens
atacaaaattagccaggcatggtggtgcaagcctgtaatcccagctactcgggaggctgaggcaggagaattgtttgaacacaggaggcagaggttgcaatgagctgaggttgcaccattgcactccagcctgggcaacaagaatgaaactccatctcaaaaaataaaaataaaaaaagagtcatggatgtgtaaagcattggggccattggaaggataggatggcccaacaagggcagatagagaggagacagggcctagaatataggaatttaggagctaggcccagggtgtgtcaaggagtccagagcaatggtaacaaggcagtgctgtcattaagagtcaggctctggacaaaggcttttagggtcagaatgccgactgccacctaccgctgtgtgacatggagcaaattatttaataagactgttgtcatggttacatgaaactattttaaaagtttttaaaataattttagtaatactgggctcatagtgctcaacgaatgttggctgattagaggcaaaggaaatctagagccatagccctggaagctatggaaagagagtggttcaaacaggaggacatacgtttcacacccattaagatggttattgtcaaaaaagtggaaaataataagtgttgtcaaggaggtagagaaattgaaccttcatgcattgctggtgagaatgcaaaatggtgtcaccactatggagaacagtttggtagcttctcaaaaagttaaacatagaattaccgtatgattcagtgattctactcctagatatatatctaaaagaattgaaagcagggattcaaacagatacttgtacagccatggtcatagaagcattatgcgtaacagccaaatggtagaaacaatccaagtgtccattaacagatggatgaatgaacaaaatgtggtatatccatacaatggatattgcttaaccttaaaaaggaatgaagttttgatacctgttacagagtggatgaaccttgggaacatgctctgtgaaataagtcagacacaaaaggacaaatactgtagtgtatgattccacttatatgaagtacctagaccaggaaaactcatggaga

SEQ ID NO: 80397 - DNA, 1043 bp, Homo sapiens
agttgctacttgagcccacgtggtctgtaaaacctaaaatatttaccatctggccttttacagaaagtttcccaacccctggctagacaacactcctggtctttcaagaactttggctttcttaaataattcctgcatttctcatgaggttactcggtagataactttgcccctttagttaggtagcagaacagaaccaaagctgaacagtaacaatgactaagaaggaggaagaggaaaaattcattcctttctttccttaactggagatattatcctcactatacctttttttctcttacagccctgtaaaaaggaatgaaagttcttccctccctgtcccccaccaaaaaactccccactggtaaatggtcatgtgactggtgataataaactttctgagatggctacgaactgcagttaggtttaaagtttcctcattaatgcaggaaaatgctcataacctgaggcttttcaagtgtttattaatttactttctggggctggctgctgatacttatttcagatcaaagagaaagcctgtgtctttagtagttactgtgtgccaggaactatgccacattttgtgcctaggtgagctcattgatagtcatcataaccataggatggcatttccctatttcacaggaggggagactagggctcaccagggttaaatactcacccagagacacacatgaagagtttgaagtacaactggagtttaacccacacctgcctaattccaggacctcagggtgtttccactgcaccgtgcagtcatcctatcctctgtggccaccaagagcctcagaatagcaccttgagcccactctaggcagaatacagtacttgatgggttctaatccattttaaaccatggtctctgctatttcaggataacaggtgaccatgtaaagtgtatctcaagtgcattgtaggctttaggaagacccttttcccagcctgctccccatgctcccaagccccactttgatggtctatgtgagtctactcagaggtagctcttatttctttaaaac

SEQ ID NO: 80398 - DNA, 1067 bp, Homo sapiens
gatgcaggcaaagagattgggatagatgatcattgagtccagagagggaagcaccttggtgtatccaccctcacctgcaaacaagcctgcaacgtatttccctcatccactcctttccctccttaccctgatgcctgagtaacgaaaggacagcctttctcctgcatccatcttcgtctttgaaaagccaaatgaaaagtgtatctcctaaaaaggccatgaggccacttcacagctttgccttttgttagccttgtcagggaccaagcaggctctgaaagcctaatgtaattactttcccttgtctaagaagagtggaagtgggagtgctcccaagcccacggctgcaaggctagctgtggtttcagcaggcttgttgctctgttcaaaacagacatgcagctcagagacatgcagcaacgggtcacttgttgtaggcttttcacttattagttactcatgtcctctgctctgtagacattttctgggcctgtggggggattgagcccttgaatgggagcaggaggaactgaatgggtgagtgatgctggaagctgaaagcagaccattgccctctagttgtagttgaagttcgcaatttccctgttgatttttttcgtgtgtagagtgaatgacaaatgggctggcctcactcagcctggagcatttaagcaggcgagaggagagctcatatggaaaatatttctatcaccgctgcatgcacatatggtctggggagacccccgaactgagcaaatcacagtgctccagcagcccctcagtggtgtgccaattattcttattaacagcaagcaaagggcaggctttagttacctgcacacagctgactcgtggggaaggccacgccggaatctgtgtgcccctagccttgtgtcacatgcagagtggcaaatggctctgcttcacctgacaatcagcaaagcagatgaaaaatgaaagggattatacaggctcacccaaatcttggtgcttttcagacagtgctcagcgtttgagagaggaaggcagaggttttgtcttatgagttaaaagtatgtgtgcttaac

SEQ ID NO: 80399 - DNA, 1052 bp, Homo sapiens
caacaaccatgtattgagtgctattttttgtgtcaagttttgtgctaagtgctgtggaattcataaagaggtgagacccaatctgccctctaaagacaggaaacaacaaataggttagtgagggctaagatataaattactctaataaacatatcacactcttttgtgagatcaggaacagcctatggagaaagtagcatttgagatgggattgaagaatgcttaggggtttcgtaggcagatattagaggaatgcattccaagtcatttttgtaaatgttctgtggaagcttgtaaagatgtactttccatttgtgttataaatatagttgtatataatacgtgtgcaattttccatgtaattgtatcatttcttttctctgtgtgggtatgctcttatatttcttaggttctactagaagtaactaaaattaagtgacttcctaagtatgttccagccttaacattatctgaatgtaggagtgaccactaaactacaaacacatatcataaaccccttgaatagagttgatgtcttttgtatagtgggagaaagtccatgagctttcaaacacacaggcctgagcttgactctctggttcttgcttaggcaggctacaagtaagttcactaagcatcattctctttatcttttttttttttttttttttttgagatggagtctcgctgtgtcgcccagcctggagtgcagtggcacaatctcggctcactgcaagctccgcctcccgggttcacgccattctcctgcctcagcctcccgagtagctgggactacaggcgcctgccaccacacccggctcattttttgcatttttagtagagacggagtttcaccgtgttagccaggatggtcttgatctcctgacctcgtgatccacctgcctcagcctcccaaagtgctgggattacaggcgtgagccaccgcactcggctctctttatctttaaaatgggaggatcatgtcaatatcgtagagttttagtgaagattaaggaggtgatttccgtaaagtgtttggtatgagaatatgc

SEQ ID NO: 80400 - DNA, 1105 bp, Homo sapiens
gacagaggaagtgagataggaagggaagcggcctgatacaggggtgtgatcaagccagtagccactgtgggcaccagagctgaatcctgctggagacatctaggagtcagtgaagcacacacctcagaattacccagcaatgaagcaaggaagcaggcatatttgtccaccagctcctttttcattgttagttgagtaccgctataggagcattacctctttagcacttccaacttgctcctggacaagaacaaagacacccccccacacacacacacacacacatgaaagagagtcacagtgtttctagcaaactgccttcaggagctgagagaggaaggaatgtagcagtgcatgggcagaggatccacaagaggaagcgccatcagcggtcaaaaccagggaagccagaacagctggagagagaaagagagagagagtgtgtgtgtgtgtgtgtttgtaggtgtgtgtgggtgtgtgtgtctgtcttccccatgaatcccatcatgcttgcttcttgattttgtccatttggaagctcagaaccaatttacaccccacctctagctgttggataagaccttaagggaatgtcatctcttcacccaccttaccctttatttctcttatttatttcccttctgcctctctttctttgtatacttattattatcctgtttgtgcctttgaaagtccccttaagttcctttcttggtataggatgagtataaataaatacaaaagccaattacacaccaaaaagatacaaacttgggactagtcacaagcatctgccacactgctagctcttctctagttttacctcagaaatattttttttaacgaggactccctggtcttcacatgaaggccctgactgcatgggaaaaccacagaattcttgcccatacatcaaccttgcattgagaactgcaaataaagcaaaatgcatgttttcttcaaagtggccacagagacagatgcccatcatccccacaatgctacaaaataggatgcagcacatgggtgacatgatgagaggtccttgaaggccaagtaggatcccgggattctattttgctgaatcaggattcaggatcccatg

SEQ ID NO: 80401 - DNA, 1062 bp, Homo sapiens
ttatctcagttaataccctattatcatgcctgtctttttttttctttctttctttttttttttgagacagagtcttgctctgtcgcctaggctggactggagtgctgtggcgcaatctcagctcactgaaacctccacctcccgggttcaaacgattcacctgcctcagcctcctgagtagctgggattacaggcactcaccaccatgcctggctaatttttgtatttttagtagataggagatttcaccatgttggtcaggctggtctcaaactcctgaccccaggtgatccacccgtcttggcctcctgaagtgctggcattacaggcatgagccactgtacccaacctatcatgcctatcttaaagatgaggaaacttggttttggtgagaataaataacttgcccaacaaccagtgagataattaaatgataaaatgagtgcatgttggaagcgagatttgagtccaggctcatgtgatgacagagcaagagccattaccattctgttctactaaagactatcatttaacacttcctgctgtgtgtgagagcagatcctctccctttattgcctcaatgattggctgggggtagtggggagaattgatgcatttatgaaatcagcctagaatggaagcctttagcagctagagaaagcactccaggatagctactctcacaccactccaggggttgctcccttatggcctccatggagcttccaagacaagggggcagaaaactgggtgagcatgtccaggctgccggactttgcaaggcactgtcatgggcctgccaagactctgctcctgttggccgctttataaatgactgtaattgcaccagtctttggtgaaagactttgaacttaataaaaatgtcaaactcattaagagcgttttcaagaccaaataaactctgaagaggctgtaatctttgatgacttcagatttgtgaatcacaaggacgtggaaaaaatctagctgccctgtacagagctactgaaatgtcactatttattgcttcagcgtcatctggtaatggaagtttggttgcga

SEQ ID NO: 80402 - DNA, 1026 bp, Homo sapiens
atttctcccttaacatcagtgctggtcggttgtgtctagactgcaaaacggaggtggtatgacagggtgtgtccaaccttccatcctgtcatggccaggaaatccatttttaaggtttctctgggggtctccttggccaagaggaggcccattcagtcagctgggaggcttaggattttatttttagtttacagtaggcgaggcatctaagaaggtcttgtagaaaagggttgtggagttttctagggctcagatccctgccccagctggtgacatgcatgacagagcctcagtctcatggggctgatcacaaaggctgcgggctccatactggcaattctctcccagagctgaagctgctggttcccctgacgtcagtgtgctgtgtttcagtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaagggtgagtgtgatggcgggcagagcgccggggaccgaggtctgccaggtgcctccaaaaccacacaaagatgagtcactagctcagaatcccaagactgatttctggctctggggggaaaaaaaaggcccagagaggaattatcgtaggctttctatccttatgtgaggactgagggtctccaaaggtgaggagggtgtatgcaaaacttgattgaattctccttagcactccatgtggtcactccataatactaggtgaagtgaatcattacatcccatcgttcatatgtcttgtaagtgcctggtgtctcatagacactcagcaatggcaggcccctctactgctttttgccaactcaaaacatcccacaccccgttccctccccagtagcctggcctcccatgggaagtctcaggtgtcaaagaataactcaaaggcatatatagtcaaccattagcc

SEQ ID NO: 80403 - DNA, 1033 bp, Homo sapiens
agcccttaatatgcatcacatttgtggttccatagtgcttctcctttgcttgtttgatctctgcatggcagcagtggggcagctccacatttggagcccatactccaaaatgcagagcactcttctcacagcacacattcccagccccaaacaaaacctgaattttcaactctgcccattaaagtgaatgtatccctgtaatttagtatgtacttattatggaaaatgtaacaaaagcagagaagtgtgatttcattctgtatcacaaattgaagcaaatcaacagcaaatacagcaggattcagggaggcttagtttacaacgtactttgtacctcctgccatttaaattattttgccactctgggcttctgaaaacacaaagggagatacagccctccaactatgagccttgcagagagagacaaaagggccagaggtcctgggatggaatactagagcccccaccttctcatgctttggaaacctgccagagcacttaccctgctggaagattaatgaagactccattctgtgtttcataacagtagcgttgttttctccatcaaaaacagagggtcacagaaatgtgctgaaaagatgtggtccagcaaggttctgtagtcccacctcagtgcctgtgggctgtgtttttcactgtaacaagcactttggtaaactagaaagaagaaaggattctcaggatgtgttcaaagctaagagagttttcattttaaaaagaaacatacatactcactccatggctttcctcatcctcctctcttttttcttcttggtgggaagctggatgcggggcatgcatcattctgtatggacaaatgtgttatgtccacccatactcttgtgacaactccccagcactgtcctgcaataccatgctggccttggtagtaaaactccttggtatctgtgagagtcctctttttctatgccctagactacttttaaccacttttctctggaatgactcccacatttgattgggtattgaaagggtaacagcaaaatgatga

SEQ ID NO: 80404 - DNA, 1768 bp, Homo sapiens
aggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaaacaaaaaaaaaaaaacaaaaaaaaaccgtgattgtttccattaagccatcagagcgtgtctcagatatcttgttatacagtgaagaagagaatacctattttttttgatgatgtttgatgtcatagtaatcagtgctggtttaactcctgtttagttcctgccaaatacattgcatgggctgaagtgtcagtagccatactgttctcatgtttcttggtcctaggatcagattcttctacattattttttagtttcccagagacatggtgatccctaaacttatgaaggtttcatcctaagccattcaggcttttctctttgtatagattaaaccgaaaaccgcatatgagcctgttcatctgctggtggattcccaccacagactcagactcaaacaaacaaacaaataatgtgaccgtttagttagtttccaaaaacattcacatacaatattgcatgaataagtaagtaagtgttacagaaagctgccaaaaaataaaaaggtttttaatatgacctatctaactaactaacttttatcttccttttctcagactatcagtattaaatagatggaaaaaaatcaaggactacttgaagctatttttgttaatattctggttactgaagtttattgtaaatatgtatgtatagtaggcatatttctttttaaccttgtgcttccctccttcccatggaatttcttcccacagatgaggggccactggacagggggatgagagccattcgtccctgggttgagggaattagtaagacatcattttcaccactgggtggtcttcatacacatgagttataatagcattttaagtatcttagcatttgtgggattagaaatctgtttttgctatttataatatataaaaaatgaaacatgatagcctttcttgagataagtatgtgaaatgtttatttttaaag

SEQ ID NO: 80405 - DNA, 1063 bp, Homo sapiens
cttgagtttggtttataaggggatataagactgttaaaatactttcttggtctctcatgattgattctggaatataggccagctaaaaaagcagctggggctcagctgtaaaaaacatgataaggcaaagatgatgtacattgaccaggggctatttgctagaagagtgatctgaaaagaagacccagtttggctttgatgcagatgatattggcagtcttgaaggattaataggaattttcaaggaaggggagagtctctagaaaaagaaagaagaacgagcagagtctcagaatgcacatggcctcagacaattgtaatgctggtgatactgttcttgaaatgattgttcatggatctcaagccaggtaaaggggaagtaaaggtaaggggctctgttagggaagagacttgattagaaggtgagtaagaattggaaggataaggaggttgtgaacagggtggagtgttggattcagagtaatgacaagctccaggatctgtgcattggagaaagtagcttagataaagtagaggagaatattgttagaagttgcagacataaaggaacttcagtgttagaatattcagatgagtttttacaaagatattaattgaatagatcaggtgatgtcaggcattagtgaaaaagcaagattaggatctgagtaccaaagacctcacagaatgtggggcattactgagaggtagctgggtgaccgtgatgaagaagggagactagagaatacgacaactgaagatggcataagcttcaaaggacagaaaagatcaatcagtgtttttcttcgtctagaggtctctgtggtgaagatagagggtatcgtctatagccagttagtaagcttcatggaaaatagtttaagagctggaaggaatcttagaggttatctagtttaatctctttgttttgtggtaggaagctgaggtccagaagagaaaggtactttcctgatgcattatggatattatgaacaaggttagagccctgatctcctgcttatcagtccagagttcattttactgaaagatctcaccactacat

SEQ ID NO: 80406 - DNA, 1002 bp, Homo sapiens
tgagtttttatgtttcttagcaggagattaacctaaaaagtttagtttgccactaccagaagaaagtcatatataaagtaaccaatgtttaaaaaaaaaaaaaaaaaaaaaaaaaggaagaagcagcaatgagattttcacactctgatctcaaggatagaagtttcctaagaaaatatatctcactagcaccctgtgttctataaatgactacattttgtttttgtttttcaaaactgagttttagaacatacttctatggtcttcctagagagattatgcattccaaggctacagttatagagcactgttatccatcagaacttactatgatggtaggaaatgtagatctgtaccagtcagtgtgggggtcacaagctacttgtggctattgagcacttgaaatgtggctagtgtgactgcagaactgaaatgttagttcaattttaattaatttaaaaataaatacccagatgtggctattttgtttggaatggatgcagcttatattaaaagaagaaactcatctcagtacacaatgggttcttacactcccacctaccaaagtatccgttttccagtactcctgcaagaaatattttaacttaaatgtgttgtatgaatatgtctcactaaatatcctaggcctcgcagagtgtttccatttattcttatcattcacctggtgtgatggaaatacacttgttatcctaaaagagcaatgtaaaactgatgcagtcactcaatttactttctaacatgaatttttctctgcagggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaagtgagtatccaggaggaagggg

SEQ ID NO: 80407 - DNA, 1678 bp, Homo sapiens
ttgaacccacaattgcttgtatgtaattagtacagatgtcaacaagtgaaaatggcaaatagcatcttagtataattatgaaaataattttgacattgtagaccctgtgaaatggttttgaggacatcatcacaccccagcatctttgctggggatctgtgggctacactctgagaaccactgcactataatacatataatactaccggctcactgcacttcacagaaatatttgatgagaataattccttttcatatgcaagatataaatacctacaaacagatactagctgtatttaaagtgcttactaaccctgattatctggtgaaccataactgcaggcattgggatatgatttttgaacaagcttggatacctagttataataccacacaaaacaaccagtcttttcaaaaaaaagccttggataaaggatctctccttatcaggaaagcaaactcctcaggaagtggtctgataattcagttccttcctatttttgtgacttaacaaaaggcactcaacagtgatcttccgtcttgccctgaagtgctatttttgagtaaaatttcattaggattctgagatttgtgttttagctagttatattattattctgtctagataatgcatagttcctcctcctcacacatttaacccatagacaaaccctagtaacgtgtactttctttgggtcttcataaagtatcatgactttctgcatgagggtaatatatgtctttttctaaatagtcatcaggtttactaaaggcaatgcaattcattccttcattatcaccatgagtctcttttactgtttaggcttacttcgatttatagtatttaatttctttgtgcccatcaatcatgccttgccattccttcttgcattctttcgctatcgtgagccttacagaattttcagaagaaatcaaagctctcctcataggccttattcattctaacactggagtatcttctatttgtttccactgttatcttcttaaagtcttaggagaaaatgaaaaagtgagtttcaactgattccctcaaatagggtatcctgtttccctcaaataggtatcactcagatcccccacattagagcatttgactctcaatatttttgttacagtctgagaagcctgtaatggactggtctcacagaattctcacccaaattaaataattaagactgtctgtttcagaatatcattcttagaaaaaatagaccatagaatcatatatagacttccttagacagagcatggcaaatctatatgattaggtgattgaatgtgggtattagaaagcctgtcccaaaaggaaggagggagagatggattagacagtactgtgtgccaaatatggtgagaatactaaggaagaagtacttaattctgcctggtggcacagggaaaggctgtagaagtgacatgtgagctagctcttaagggatgagtttaaattaagcagatggagaaagaactaccagttggtaaaagtcaacaaggtttaattctgtaaaaagctatatagcttacatataaacttgtatatataattgtgcagaagggaaaccttaagttaaaaccaaaataggctttgttttgaagcaaactctaagacattagtactatggggtcttgaagagtgagccaggactcacaaagtctc

SEQ ID NO: 80408 - DNA, 1026 bp, Homo sapiens
gcacagtggttcatgcctgtaatcccagcgctttgggaggccgaggcgggtggatcacctgaggtcaggagttcgagaccaacctggccaacatggtgaaaccctgtctctactaaaaatactaaatcagccaggcatggtggtgcacgcctataatctcagctacttgggaggctgaggcacgagaatcgcttaaacctgggaggtggaggttgcagtgagccaagatcatgccactgcactccagcctaggcgacaagagtaaaactccatctcaaaaaattaattaattaattaattaaaaataatacaaaataaagagcagttacaaatcccaatgcccaggctacacgctacaccaattaaatcagactctctggggatgggatccaaatattgatatattttttaaagttccttttgcagtcaagattgaggagagcaaaagaaaaccatgttagaaggaaagcagagcctcaagaaaaaagaccaaggtgaaatacaggaatactgaagtattaagaccaaaggattcagagccattaagaccacagttagactagattacaggaagatactaagtgtccataatttggtaaaatggaaatttaaaatctatttagaaactacaagcagtcctaaagaaaagccagattttaaaaataagatgctttaagacaaatgatgctcagttgaatccaggagtttgcatcctcagcataagaaaacccagcagtgtccaacaatcttcttaaaaacacctgaatttatgaacccattcactatgtttgatatctggatacagtgactacatagtcagaagtccctgaggtcttgcaaaggttatggtaactggccttacgtggtagtcttactgatgtcctgtacactttgtagtgggtcagtggtgtcagggcagcggagaatgcagggcgcaaacacaatggccaaagcattagcagacattcgattagtgtcttcctgcagagcaatcctaagaattaaaacaaaacaaaaaacaaatga

SEQ ID NO: 80409 - DNA, 1050 bp, Homo sapiens
ctgggattacaggtgtgcgccaccacaccctggctaatttttgtattgttagtagagacaaggttttgccatgttggccaagattgtctcaaactcctgaccacaagtaatctgcccacattggcctcccaaagtgctggattacaagtgtgggccaccgtgcctggccgattctgcattctttggacatgttcatctagtgatcttggcctagagcaggtaggtcacaaatttcccttgggaagctatcggctgacctagactgcttcaaggaaagaacaagtgaaaatacattttccagagacaaaggaacaaaggaacaacttgggaaaagtctgcagacccttaaacttaatggatatccttctagtactatgcagttcatgtcatactgtcttcttttgctcatctcttctgcctatttccctatggtgctccctttttatcccttactcatttgttttttgttttgttttaattcttaggattgctctgcaggaagacactaatcgaatgtctgctaatgctttggccattgtgtttgcgccctgcattctccgctgccctgacaccactgacccactacaaagtgtacaggacatcagtaagactaccacgtaaggccagttaccataacctttgcaagacctcagggacttctgactatgtagtcactgtatccagatatcaaacatagtgaatgggttcataaattcaggtgtttttaagaagattgttggacactgctgggttttcttatgctgaggatgcaaactcctggattcaactgagcatcatttgtcttaaagcatcttatttttaaaatctggcttttctttaggactgcttgtagtttctaaatagattttaaatttccattttaccaaattatggacacttagtatcttcctgtaatctagtctaactgtggtcttaatggctctgaatcctttggtcttaatacttcagtattcctgtatttcaccttggtcttttttcttgaggctctgctttccttctaacatggttttcttttgctctcctcaatct

SEQ ID NO: 80410 - DNA, 1987 bp, Homo sapiens
aagacgtattctttcaccacagttagaagcacagttccaaagcatggaattacattgtggaaaataggttagtcagtttgactaagaaacatgaagccggccgggcatggtggctcacgcctgtaatccctccactttgggaggccaaggcaggtggatcacctgaggttgggagttcgagaccagcctgaccaacatggagaaaccccgtctctactaaaaatacaaaattagctaagcgtggcggcgcatgcccgtaatcccagctactccggaggctgaggcaggagaatcacttgaactcgggaggcagaggttgtggtgagctgagatcacaccattgcactccagcctggccaacaagagtgaaactccatctcaaaaaaaaaaaaaaaaaagaaacatgaagccttcctttaatgatgatagtttctaaagtgaattatttgaatctctttgcatgttttggctctgttaatctaactcttgtctctaaatagatgctgagagtgtaaatctagatgactataacatacacgtcattgcaagtgtattcaaacaatggcttcgagatttgcccaatcctctcatgacctttgaactctatgaggaatttcttcgagctatgggtaagcataggcttcctgggttagagagaaggcctatagttgggaaagaaatgccatcttgagtatagattatcaagccatcctctagtggtttaattcttatagattcaaaggtaagcttttgacagtgaatacaaaacggctagtatactgtcacctattcaaatgttgactttttagagactcatcaaaacgttagtgtcctaaaaattttctgagtgagacacttggttgcttcttacaaagaaatggaaagactggggttataaaacagattaaaatattaaaaataagttttaagattaggcttatgttcatttaaattggaaatctaggcaagaactatgtgtaaagctggctgttttatgccaagcttaacaggtttcagagtttagtttctcagtgctgtaagtgcgtaggatattgataaaggccttcctagaggtatttaggccctgaggattcataaattatgttgactttaatggtaaatcaatctgctacacaatgactgaaaaactagaacatctctatccccttgctgttattaaggattactgtgatataggttcaaactaaggagactgtttatgaatatagaactcaagcaaaaggagttaaatagttactgtgagttgctcttctcctgccctacaggtacaactactcctaaaactctgtagccagccttctttgcttcatagtgtctgggaggaagatacactgtataaggggggatatttagtcttagtttctgctcttactgtttttaggccttcaggagaggaaggagacaatccgtggtgtatactctgtgattgatcaactctcccgaactcatctcaatacactggaacgcctcatctttcatctagtcaggtaactttaagaagcaagggaacgatttttaatagtttctcttggattattttaaatagataaggaatttctccatttggaagactgacaggtatttattttttcttctatttataaagtcagtgtctcaaacaggtggttaggataccttggagcagaaatattcagctgagctggaatgcatggcagttgcttttctgcccttgtttgaaccatgtaacagcttcagcctcatggtggcagtgtgtagtttagcctgttttctaacagctgaactagaaaggatatataatctattgaaatgacctaattcatatgaggggttcagatcattctcaggaattgaccaaagaggcgtcaggagtagtgtctcttcccctgtgtgtaaatatcagcagtagttgagaagaaagccatctttatttttggttaaagcctctactctgcattctttttttttttttttttttttttttttt

SEQ ID NO: 80411 - DNA, 1828 bp, Homo sapiens
agctgtttgcatataaaatccaacccttttccccacacccaaatcccacctttgcttttgaagcaattttttgataggagaagctgtagccctttgccactgccttcattcttcactccattattttcttttggagattctggtggaaaaggattgaaactaatatctcatttatacttacttaaacataattccctttctcccaactcttctaactatgctcataaaacttcagagaaataaaaaagtagctcctggtaaagaaatggttaaacatgtttcaagatgtttgaatgcatttggaaactaaaaattatctttcatttagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacaggtaagatagtgccctctaaatcataatgaaatacttttatttaaatagttcctttcatgctcttaaagttttcattacatgtcaatcctttacttagcagccagaagaatgcattcttttctgtgatgctttgttatcattttttggctttctaaagagtctttggtttcatttggtcaactcagcagacatatattgagcatataatttgcacttgggacagatctcatttaatttttgtaataatttagtaagattgtgatacctctgattgacaaagagaaaaactaaggtatagggaaattaaataatgagctgctgatgatgatgcaaggtgctgtactaatgtttttataatattcacaacaatcctatgaattagggatattattatccccatttacagaaaaaggaactgaggcttacagaagatcttgcccaaagactgatcgccaataagtgaccaaattggagttaaccccagatcttctgaattcataatctatttcccctttctctttattattctgactccaaggggtactctttcctgtgtatcatcttcttgcctgcctacactgatgacagttactcaaactgataattagtgagttgagcatgtatctttgtagagctgtagttttagtactggaattcatgcaggggactgactctggtttcattctcaacttctacattttaccactgttgggaaggaatagatctttttgaactaaacagagtaaagcatgtccttgtgtgggcaagaacctgtgttcagtgctgtttcttatgaacaaatcaatgagaaatgaattgagtatgaaaataataacaatgactggtaagactcaggcaggaggttccgtctacaagagacttggtctactttggtttacaggcagttactgactttgtctctgataccttgaaatagcacaagtgaaaatcaatcatcctgaatcttccccagtcatctaatctgtatatccttagggagtttataagtgaaacgggtgaaggtgtttcctttacattttctaagctcagttatcactgtccttttatctctaagaatgacttaaaattagccttactttcagaaagtgtcctgtatgcgttttttcatttgtcatgtaaaccattgttactcaaagtgtggtctgtggacaaatccaaaaccaggtaagtacagaaattgagagcaagcatgtagagacgtttatagcagtataacagtgcttcagcacgaaaacattcattcattcattcattcattcattcagagacagtcttgctctgttgcc

SEQ ID NO: 80412 - DNA, 1050 bp, Homo sapiens
tgtttccataatagttaatctatttataattttacttatctccacacactaacactactagtctttttctttttttttcttttgagacagagttttgcccttgttgcccaagctggagtacagtggcgtgatcttggctcactgcaacctctgcctcctgtgttcaggtgattctcctgcctcagcctcctgagtagctgggattacaggtgcccaccactatgcctggctaatttttgtatttttagtagaaatggggtttcaccatgttggccaggctggtcttgaactcctgaccttaggtgatccacccacctcagcctcacaaaatgctgggattacaggtgtgagccactgtgccgggcctaacactactagtcttaagcagaaggccttgattttgtttccttggtacctaacacataaatgacaaatgtatgaatgtaaggctggaaagtagaaattagaatcagttcaagtaagttcttgagtatgagactcaagaatgtttgcactttagtttgctatatactaattagccgctaaaggtttttgaggataataaaacagattatatatactacagaatatattaaaaggagacatatgaatatggggaaaactcgccaagaaagtgttgaaatagtctaattggttagtgatatagttttgagctggggtgatgacacttagaacagaaaagaaacaataaagaggatgaactgattgacttggcaactggttggatgcaggttaaaggagaaaatggaatatatagttagggaaggacaatggtacaggagaaggaaagacagatttgcaaaacaattttcagtctcagagataatacctgccatttttcttttcagtgaattacttcaaataatcttaagggtaagctgttatgttgcagtcacataggatataaagtaacctataggttaataaagtataatattggctggacacagtggttcatgcctgtaatcccagcactttggaaggccaaggcgggcagatcacttgaggtcaggagctcgagaccagcct

SEQ ID NO: 80413 - DNA, 1022 bp, Homo sapiens
attgcctgaacccaggaggcggaggctgcagtgagctgatagcaccactgcactccagcctgggcaacatagcaagactaagtctcaaaaaaaaaaaaaaaagccaaaaaaagaaaaagaaaacatactttgagaactgctgcttttaatgtaacattagagtcatgtaagacagctattatatgtctgttgcattgctttctgtttttcatataatttggtcatgtttatctagattgttagcttttggaaagcaggaaaaatatattttattttatgttatttctcaaaagatcctaattgtccccctggaattagtgcctagtgaagacttaacaagagattgaaggatttcccaccacgttagggcagcatttactgtgttggctttaatataagtagctaaattttttcattcaggtggaagaacacaatggtcacatctttaaagccacccaatatagcatccctacatactgtgaatactgttcttctttgatatggataatggaccgagcctctgtttgcaaatgtaagtatgagagatctttgaggaatatttttaaccactgacatttctgtttccttgagttgtcttatatctcctttaacataaaggagttatttacactacctaaatttttaacctcatctcttgctatactctcttcacctactctttgtctctaaaccagatattttgatgttatttggtcactgagagtcttgtacatgtaattcactctgtctaaaatggtcttgtcccagattttagtatgacttaatatttcaattacttcatgcctacactcacatctcaccttctcagagagctctcttttctacccccagtttaaatgccaccttgtccccaaattcgctattcttttttttgtttttgagatggtgtcttgctccatcgcccaggctggagtgcagtggtgtgatctcagctcactgcaacctctgcttcccaggttcaagtgattctccctgcctcagcctcccgagtagctgggatt

SEQ ID NO: 80414 - DNA, 1026 bp, Homo sapiens
ccagctactcaggaggccgaggcaggagaattcacttgaacctgggaagcagaggttgcagtgagcctagactgcaccaattgcactccaacctgggcgacagagcaagactccgtctcaaaaaaaaaaaaaaatcaattaatgattaaaataaaacaatcatttaaattaatatggcggtggcttctgggcagaactgaggtttaaaaaagaataatctctaaagtatccttccattctgttgctgtcattggcaattatgttttatcagattttaaattttttctcacatttgcttattagcactgcacagttcctcttggagaataaagaaatgactattgtgttacctgttgagcaagtatcttaacatttgcaatgaagtaagaaagtatgttagtctttgttatcacaatttccatatatctcctgtccccctgtcaggtgccaaaaacagaaagaaagaaaagaaggaaaaaggaaactgatttggtaagttataatctgttttttaaattaaaaaagtaattttcagatcagttgtctgaggtatatcatacaatatatatgtggatatatttatgaaataagtttatcaggtacctaggcaataatcatatttatatctttacaaaaatttagaatgattagatgtgactggacttgttatcaatgatagcttcctaaaatggcagaaaactgaaattgtttactcatgaaagaaaaaatattatttcttttcagaactaggggtggggaaggagctcttcaggagttttctctcccttctaaagaaaacaggggttatttaggattttacaattataaatactttcaattcaaaagacatttctgaaggcatttgaacaaattttatcattgttcatgtttatatacaatcacacaatatatacaatcacactttttcacgctgacatgctgacatgtatgaggttctttattgaagaggactttgtaaaagcaaaagactgcaaacaacctaaatatatagggaaatgattaaat

SEQ ID NO: 80415 - DNA, 1073 bp, Homo sapiens
tcttaaaagatgaaaaaaacagctgtaaggtgggaaaaagctactcaaggaaattcaagggagcttttaatctgaaaccattcagtttccttgtctatccctaaaacaaaaaccattcattttccttgtctatccctaaaacaaaaacaaggcactggagaaatctcttacgaaacatggcttttgtattatcttctacagcgctatcaaatttttcatatgttgaactactaaatatctcctaacatagtccaactcaccgccaatgcagatgaataaaagctgaagatattctgccgaaattccttcagggcttttttaaatacaacatccactagtgtatccttcttgctgtcttcattatctaggtcattcacctgggaaccacaaaacgagttttagtacacaatcaactaattgaaaagaagtaaatacaacagtaggcatgtattgttgcttccacaatgactgtcctcaaagtgcaagccacaggctattataggactcaggtgaaagttatgactagacagtcaaactataattactactctatgatttctaaggttccttctaacattgtatgattctatagttctgttacaagaaaactcccgtgtgcaacaagctgtaccttcccatatgaaatttgacaattttaggaaaattaaagtcactactaaagcctacaaccttaaatcctgtctacccagtctaactaatgcatatcctattattcacacctttctggtaaagaacagatcatctaaagcatggaagcatatgtaattttgatatctagagagtatatcctgatatacacaagtattccatacacagagctgctccagggcctgacgtggcaaataaagtgtacctttttcagaagaaattcatccatgctttttaaatcactgacacttgctatgatctggacagagtcattttgccaatgcatagaatccaaagccacgttgctaatcttcacacttcgcttgcgcttagcctttggagaaggttctttgttctctttgaattccttccggcaactgccgggcagttctgggctcaaagga

SEQ ID NO: 80416 - DNA, 1008 bp, Homo sapiens
ttctctcccttgaccaagcttctcactgtgagctagggcctgcacccagcctgggtcaggcctctcacagtgactccgaaatggtaattttacagcaatataagaaaaatagcaagcaaatctgatggaaatagtctttgctaatctaaagctaaccttcacagcttcttcccatgtaatggtttgtgcatgggaaacctcagtgaacacagcaactaagctaaaccttaatttaatagaactcaaataaagggcactttaaaaagccacaaattaggcaaaattaagattatttgacttggcactaatgtagaaattttccatgttgtatcctaaaaggtctagagcagtggtccttacattttttctgtaaacggccagataacaaatattttagactttgtgggtcatatagtctctattgcaactacctaacttaactacttaactcacccactgtagtgtgaaagcagccatagacactaagtaaacaaatgggcatgaccgtcttgtaataaaactgcaaaaacagacagtggattgtatttgacctgttggccatagtttactgatccgtggtttagtttactgatccttggtctaaaataatccagtagcttttagctacaatgcacttttacattttttgcctgtaaactttcttcctccacctcactttccactaataagaaataaacatgaattttaaaacatatagtgagcaaaaagtgtcttcctggaccaacccagccaaatagaaggctatatgtaatgtgaatttgtattaatcacacaatataacattggtgttgtgtttgaataaagctgcaccattttaagctaagaatataactatatcatcttctcagcccaaatcaggtgtatatgtggtttgacaagtattatagtatattgatgggtatattaatgcaaagaattttattttggaattgtcctagaaatatataagataaagaccgtatgtctaatatgaaccagaacatcact

SEQ ID NO: 80417 - DNA, 1941 bp, Homo sapiens
gatttaaagctttaaaagaacaaaggctaagagaaacaaagccagaagttggattggtgaatattaagggatatggatctctggaaattcagggttcagacccttcaggatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagatccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattcccctgtaagtgaaatgtttatttatgtataaatgggaaacttcttggagtatttttattaaggtgccttgttctgctccaactatttgtgtaaagtggctgctcaacttggccattttctctttgtaaaaatattccctaattgttgactctaccatcacctgaagttggatgtagttatatcctaggaatccttgactgatcatgaatagcagagtaaatactgggttcctccccattaagtgagaagcatttgtgaagggcagtacagtgcctataaacatagtaggcattcaccgaatactggttgctttacagctgtgaagtttagtagttgaaggttgtttgtttcaggctttaaagaagttaattt

SEQ ID NO: 80418 - DNA, 1114 bp, Homo sapiens
ttcaggtacactttctgcttttgtagaaaactagtttttttatttttatttttttgagacagagtctcactctgtcacccaggctggagtgcagtggcgtgaattctgctcactgcaagctccagctcccaggttcacgccattctcctgcctcagcctcctgagtagctgggactataggcacccaccaccacgcccagctaattttttttgtatttttagtagagacggggtttcaccatgttagccaggttggtctctatctcctgacctcatgatctgcctgccttagcctccaaaagtgctgggattacaggcatgagccaccgcacctggccagaaaacttatttttaatcaccaagaatttagctgcatagccacttaacctgtaattatgacataagaaatttattctctttttttcctgtgaaaatgcagtgtaagatatgacaaccagtttctgttattttgtcttccccatagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaaggtaatctctattactataataattgctttttttcttcttcccaagtactttgtttatacctctgcattaacacttgtctaatttgtattagaattggttgtatacaatttgtcttttccactatactgtgataccgattttaacccacattgtattgtctataatggaagttaaataaggttttattgaattaaattggattgaaaatctacatggtctgtgatcataactgctaagaattaacttctacattaggctgaatcttataaaattggcaatattcaactgttgttactttcagaaactttaa

SEQ ID NO: 80419 - DNA, 1011 bp, Homo sapiens
cagtgaggtctagttgaagatggaggttgggaggagggagaggagcagaaaaaatagctattgagtactgggcttagtacctgggtgaaataatctgcacaacaaacccccgttacatgagtttacctttgtaacaaaccttcatgtgtaccccctgaacctaaaaataaaaatgaacttgtacacttctaggccttcagtccagtcacccttgtattttctgaagttaatgattcaatgaaagaagaaaatatttcattattaaattttctaattgggttcattgttaactaagatctatgacagttatgagacttgggtcatgtaattatttagatatttctgaaatatttagcaaatactcgtgattaaattttcgtttgtctttagaaaaactatttcacgtttcatttttctttgcactgatttgaaattttctgttttttaaattttgctaggtataacccggaaaaatcccagaacacctctttctgatctccagggcatgaatgctctaaatgaaaaaaaccaacagtaagtgtgtttggtttatgttttcaaggacgtatagaagaaataactaacattcttattgatatttttgtgactttaaaagtttgaagtaattcaggcttgttttgtttttttatttcttgaatcctttataagtgatgtaataacacattaataggttaaagttaacaagatttgtctacagttgcttctggtaaaatggctttacaattttgaaaaagtttcttcagaataacttaaaatgagctcatatattttaattgctgagacccttcttgcattttatgtcttttacaaaatttaagggttattccgctgctttctgtggagaaatcttattgggaagtaataattgaatagtttgatttacatcaaaccatccaataccttttttgggtgagtgcgattaccaaagcttaccttttactattttcaatgatgaattcctgagaacaatttgacagtaacaaatataaa

SEQ ID NO: 80420 - DNA, 1016 bp, Homo sapiens
tcaaacattgctagacaagtttaagcatcaacatgaagataattcttacatcgaatttccagccgtgatggagcctgctttcattataaaacattatgctggaaaagtaaaatatggggtaaaggtcagtaaatttctcactgaatatgcttacagggcagagatgtgttcttaactgtccccagcacactgccctctttgtagtttgtggaggcttttgatcagtaataactggagatattgtataaagatactactaaaacttagattctgcttttcagcacattactgtcttaggtaaggtaatgtttctgttggtttctgcctggagataaacctgatgttgtcagttgatcctgataaactttagatctgaaagaatagattgcatctgtatatcccaaactcacttgtttatgcacataatttgttgaatttttcccttctctgcactcataaggtcttcatgtctctgttcaccattagggatttgtcagttcgtacttttcatgaatatattgaaactcttatgtggagtggaatcttaataatgttgtccatttcttgtgtaatttgtgagtctgttattctttaactacttgatgtttaagcctgctatttcaggcatttaatttcccaggtaaggcagctgatgatatggagaatagtggaattaaatgttttctcctgggtcttgagtcgagtgtcttaagatcatttattcatccatttattgatttatttaagaagtatttgttgaacacagaacatgtgtcagactttgtgcttggtgtttggaatgatctaatgataaactagacagatgtagtcctgattctctatacatatgtgcatatatacatattgtgtgtgcatatatatatgtgtgtgtatctatttgtataacatagataaatgggctatgtgttataaataagttaatgggtcctatgagagaaagtagtaaaatagtggattttgaatttgtgaatacatgaacacttctctaagaaact

SEQ ID NO: 80421 - DNA, 1365 bp, Homo sapiens
gaatgaacctttgattaaaaagatgtgtgtgtgtgttttgttttgtttttattgctggtgttgattgtttttttcttttttctttttctttcacacaggggtttggaaacaatggtgttgatttttaattgctaccatgggcttggtcactgtgtgtaatgctaagtacagtcagtcagtcctccttatctttgggttttacatccaagcattcaacccatggctgatacaaaactactgatacaaacctgcatatacagagggctgactgtactaagccattttatataagagacttgcgcatctgtggatttggtatccacagggagtcctggaaccaatccctcgaggatatggagggccaactgtatgcttgtttgattgctttggtctcttagttctaggatgagatagaggagcttaacagaatctcaagtcagtacagagtgtagatacaaagaaactaggtatggagagaccaagatgggtaactagatatttcttatgaggatctcaagattgattaagttagtataaaaagagtgtgcttttggctgggagtggtggctcacacctgtaatcccagcactatgggaggccgaggtgggcggacgaggtcaggagtttgagaccaggctgaccaacatggtgaaaccccatctctactaaaaatacaaaaattagccgtgtgtggtgacaggagcctgtaatcccagctactaaggaggctgaggcaggagaatcacctgaatgtgggcggcgtaggttgcagtgagccgagattgcgccactgtactccagcctgggtgacagagtgagactctatctcaaaaaaaagagtgggctttcagtttccatgaaaattattagtgcaaagggaggggcaaacaaaatgtggactttttctccaaactaaggttgaaatcagtaataggtttacattgtaccccagaatttgtgtatgaggacataggcagacacaggtttcatcaaactgaactcaagggaaatagttaagaatagagaatgaacagaaagactacaacagctagcaggtctacagaaaagagggagaaaagatctttatatcatcaagtctcctatcattggatcttgttgctgtcttagctttttaaaaaagtgcctctattttgcttaaaggacataatggctggttaacaatagcatgacaatattagtcctggccaacttgatgaatgcttaaagttttaaacatataatctgttagctagatgctaccctagagctttggaaagatattatttgttataatattagctaacacttacgagttatgtagtgttacttatcagtcagtactgtttttattctagtttttcagat

SEQ ID NO: 80422 - DNA, 1048 bp, Homo sapiens
ctattcaacattttaaacctcatactttttttttttaataaatatttttaactttacgaaaccgtatgttctggccgggcacggtggctcacgcctgtaatcccagcactttgggaggccgaggcgggtggatcacctgcactcaggagtttgataccagaccggccaacgtggtgaaaccagtctctaccaaaaatacaaaaaattagccagaatggtggtgcatgccatggtaaacccagctgctggtgaggctgaggcaagagaatcgcatgaaccccggtggcagaggttacagtgaactgagatcacgtcactgtactccagcctgggcgacagatcgagactccgtctcaaaaataaaaaagaaaccatacgttctgacatctagtttcactcagtcttcatgaggctgataaaatatactagtttggttcttaatgaagaattctatttattgggatgtagaagtcgaaataggaaaaattgcattgtcctcttggtatagccaggagtaacctacctctcttgatccttcattgaaataaccttttgatttcctcaccctctgtttttttccattccctttaagatgttagggatttctgaggtttcttaagataaaaggccactaaccttgcttcacatatttctgtaatctatagattatatgtattaacagtttggatatatttttttaattaggataaaagtaagataaagataactaaaatacttttaagtcatgatatgttttgaatactggccaaacacaatcccctgtacactgctttagaggaattgagcattttgttacttatgttgtggatattattcattaaataaatttaaacattacttttaatcaaaactttctcttgttttacagacattgtctattggtgttcttgatatttttgggtttgaagattatgaaaataacagctttgaacagttctgtattaattttgctaatgaacgtttacagcactactttaatcagcatatctttaaattggaacaagtgagtacctaaatatgtatacac

SEQ ID NO: 80423 - DNA, 1104 bp, Homo sapiens
acctcatgttttcgctattttatttcttctctgtatttttaaaataactttgtgttatttttgtcttctgttttgtctttttgatactcctttttatttttattttattttaaatttaattttatttttgagacagtgtctcattttttttgcccaagctggagtacagtggtatgatcttggctcattgcaacctccgtctcctgggttcaagtgattctcctgcctcagcctcccaagtacctgggattataggcgcgtgccacaatgcctggctaatttttgtatttttagttgagatgggtttcaccatgttggccaggctggtctcgaacacctgacctcaagtgacctgcccttcttggcctcccaaagtgctgggattacaggcgtgagccaccaggcctggcctactcctttttagaaggcatttattgtggatatttgtggaggcctatagtttgatatatattgcaattattttctctcttagttatttactttttagatttatttataccatctttttctgattttatgttgtaatttttttgcagttaattctgtcatttttcttgtttttagttttgcattttgtatatgtattttacttacagaggaaggcctcttctagcccaagattataaaatatttattcttatatttttataattataatttttttatgtttagactttttctaactatatttttaatatggcagattataggtatttaatcatttcacatctagttgtgttttctgggcagccttcatggactagtccaccttgtcagactgattaaaaatgtcaccttttaaatttaatcctattgccttaaatgtgaaattgctcttatgttaatttttcatgcttcaggtaaactcacagtcataaaaattaatttaaattgtaatctaatttatcaaattgatttatttttgaagggcattattttaatttttttaagggcctagacttagcagaattaaacaaaatactcttagtacaggcttttaaaaaagatcttactatttttcattcatcatatcagtttgcccgttgtatctcttagcaccagtggagaaaaattattttcatt

SEQ ID NO: 80424 - DNA, 1012 bp, Homo sapiens
tggaaaacttcaattggctgggtgcggtggctcacgcctgtaatcccagcactttgggaggccaagacgggtgaatcacctgaggtcaggaatttgagaccagcctgaccaacatggagaaaccccgtttctactaaaaatacaaaattagccaggcgtggtggtgcatgcctgtaatcccagctacgtgggaagctgaggcagtagaatcacttgaacccaggagacggaggctgccatgagccgagattgcaccattgcattccagcgtggccaatgagagccaaactctcaaaaacaaacaaacaaaaaactttagttatagattttttattttgagagaaaaattcatttctaattcaggatagtaagtttctttcttgaatgggagcaaacaactttgtcatagtatcttaatcattgtcaattctacatgcacttgtaatgcttttgtttttcaggctgtgacagtgaggaactccatggctaagtctctgtatagtgccctgtttgactggatagtttttcgaattaatcatgcacttctgaatagtaaagatttagagcataataccaaggtaatgatatattggattataatatgtttttccctgaaagctattttaataaactggttaatacatgaaatttaaaaacacagaattatatagagtaataagtaagaaatcgcttttatttgttatttattaccctgttcagaagaattgttctgtgtgtctttccagaccttttttattatgtgtttttacctcccgaacgtgtatattcagagttgctttaaaaaatgtaaatagaatcatgctctctgtattctttcaaacataaatatatgtattttttttacctagaatctcttgaaatattttctgtctcattatatatctggacctggctatttaaaaaaagttataaatatatagtaagatgtgtaccataaatccatccattaaaaatagattttgttttattgttataaacaatgctgtaacaa

SEQ ID NO: 80425 - DNA, 1292 bp, Homo sapiens
attattgcctcttctaaaatttatttttgtgtcactaatatctagttcagtgccttacatagggtaggcacttgttaaatatttgttgaataaatagtatttgctggtagaattgagcgcccgtaaatgctttgaatttctgaaaccctttagaaccactcaaaatcaaacttagtatcagcacacttactgagtacagctaactctttatcttaagttaacttttgaaatcctaatcttggtgattgtgaaagggagaacaaaagtaacttattggtattttagtaagtatgtgtttagtttccatacctgtagtaagataagaggtctaatgaatttgactaggtcttactattctaccagctctaatttgcatttatacatacaggtacctatcctaaattaccatatttctgaatggcccacattattttaaaatatataatcttgatttttaaacttttattttaaataagcaggattgcttcacggtggaaggagaagatttgagacatgactttgagcgcctacaacttgccatggaaatggtaggatttcttcccaagacacgaagacagtgagtttacttgttgtatttttatatctctaatagagaacacatgatatgtctttgaaagatttctgccgttgacctttttaaatagttttctaagtggtattcttcatctagtacctcatccatctcgagcattatttctaattcctttttttatcataaattattttgagaatctgatgaaagctgacactgttgttgtaaaatgtacatccttaacaatttgcatataaatgcaggaatttatggtgcccctgaagcctatccatggaccttacttaaaacttttgctttgtaacactatttttatagctcttcattttgtatatatcagtgatctctaatcttattaaattatgcatacttatcagatgcatagtatttaattttcagtgtatttcctctgtatagtttatatctgtactatactattaagttttttaattgtaaatctaaacaatttaaaaatataaaaatttgagataaagatgagataaattatatttgaaacaaattatttaaaattaaagactcaaccttggctctcaccagaaagaaatagttacttataacttttttgaaggggagagtcgtgctgatgaatatgtcagatctgattatattgttaatttttttttctttgttttttttggagacagcatctcactctgtcacccagactggagtgctcactgcagcctcaacctccccaggc

SEQ ID NO: 80426 - DNA, 1012 bp, Homo sapiens
tcagcttctgagttttttcctccccagtttaaactatttgcattatatttgggtgattaaagattttcttttttataaagtaatattctctcataaatgagctgatagttgttagtattagagaagtctggaattttgctgttctttcagatctttttgtaattaatgaccataatatattcctgtcataatgtcaatattcataggatatgggactcagtttatataaataacagtcactggagcccatggtatatatgcgttcggtagtacagtatacagtctcccagcatgtgaatatttgcttcattatttcttgttttatgctgctatgcaaaataacttttcaatggagagcagcagtactacttgcacaccacatctaagagatcattagaagagtataataaccattacttctacctaactaatctgccttactttcagataacaaagaaacccctcagacagagctgggatgattattgctatgactctgagccggtcagtacaagtacctaaatattctgtgtttctgtcaaagggtcctcacattgcgcatttgcatccatctgaagatttagaatgcaaatcagctgaaatacaaagaatcctaggaaggaagataaatcaatgtttcatttcttttgaatgattgatttatatctgtatagtttgttgatttaaaaccagttaatttactttttttgggctattttctggtcattaagacttagtccacattcaatatttatttcgacaaacattaaattgattatattcctgattcttcatcattgctgtggatttgtatgaactatggtttttttccccttttattttttaaaattattttttagtagtttcattacctacatactatgagtagtaattattgtttatttcaaaaaattgcattctttatgttttatatatcaacagtctttacacataatgaatgcatgtatatttttctttgattttttttcccagtagccagagtctgtagcct

SEQ ID NO: 80427 - DNA, 1041 bp, Homo sapiens
gaatagggcaagtttaaaacactacaaagccatttttattgagatttagctctttttattgagtaaacactctctgggttgttgcaagctttcgattagtttccacagttctgaaaaggttaattatgacagatttgccagatttctcattggttttatggagaagagaattttcagaggtcctaactttgttaactttgctgccttcatccctctcttttgtattccacatccaaaacatcattcaatttttaggagtacttaaacgctgaatttatcacatttatattaaaaaatgaagcaaagctgatacattttactaattactgtttgcttcccccctccccctgttaaatgataaccataagtcacacattatgaaacttgtacttctttgtttcccacaggaactatcatgtattctattacctcctggcaggagcaagtgaagatgagagatcagcattccatcttaagcaaccagaggaatatcattatctcaatcaggtgagagttcataaaaagcattttgaagtatagggcagtattaaatttaatgcttgaaaaatgtcttttttctagtactttctcaaacctaggaatggattagctagcattttcatatatgtactctacaaatttaggtgatgcagttctcaaatttgaggatgattaccatcctcatataaatgttaaaagctcagataatatatgtgcttttcgttttctgtgagattctttgggaaaataataataagctgtttattgatatttctactgtattagaaaaatgctttacttttactaaagtgatttaccttttacaacccccaggatattaaatgttactaatgattaattcttgtcctttgcaagggattacttgaaacctaatttgcatgttttgaagtctcatacacatacgtctttgcatgatactatgacactgacttagagtatgactatttttataatttaatgaacaatcttcttaaatattcagtatgaaggtcatcaaaggcaaatgacttagagaatttg

SEQ ID NO: 80428 - DNA, 1060 bp, Homo sapiens
gcttcatttttaaaaacatttacatcttaaatttcattgagctatattgagctataacttacaataaaatctacacatttaaagcgtacagctcagtgaattttgataaatgtatatatccatgtgaccaccatcacagaattgagctatagattatctttatcacccattgtgcccctttgtagatatttctcaattccacccggattcccagataaccgctgatctgcttcctgttattcttgttttgccttttctagaatttcatataaatagattatatgatatgtactttgtgcctggtttcttgtgcttagcatagtgtttgttgatatcattagtttatttttattcctgggcagtattccattgtaaggtacatactttgggtgacgatttaggaagtttatagttcttattcttttgtaatgagtactctagctttgttttaaataggcataataaagtatagtacattatgtactggaatttcatttcattctattctaaaattgtaattattttgatgtaattattattttcctaactccttgttacttcagtttagcaaattttttaaaaagtaaaagtataaatatattaagacttttttgtaggggggctctggaatgtgaaagagaaatccaaactttaaagaacattacatttttaaaattatgatttattttggctgggtgcagtggctcacacctgtaatcctagcactttgggaggccgaggcaggcagattgcctgagctcaggggttccagaccagccagggcaacacattgaaaccccatctttactaaaatacaaaaaaatagccaggcttggcggcgtgggcctgtagtcccagctactcgggaggctgaggcaggagaattgcttgaacccagaaggcagaggttgcagtgagccgaaatcacaccactgcactccagcctaggcgacagtgagactctgtctccaaaataaataaataaataaataacataaaataaaattatggtttattttactgaatagcacaaaataaaatctacttgatcttctttcag

SEQ ID NO: 80429 - DNA, 1073 bp, Homo sapiens
gggcgcaatggctcatgcctgtaatcccagcactttgggaggcctaggtgggtggatcacctgaggtcaggagttccagaccagcctgaccaacatggagaaacctgtctctactaaaaatacaaaaaaaattagccaggcgtggtggtgcatgcctgtaatcctagctactcgggaggctgaggcaggagaattgtttgaacctgggaggcagaggttgtggtgagctgagatcatgccattgcactctagcctgggcaacaagagcgaaaatccatctcaaaaaaaaaaaaaattgtctttggatagaagacatttcagatattaaactataaaaacataactgtacttgatcttagccaaaaggctgagaagctatagaaatactgttcttgctattctgggcacactgcctgcagcgtagccctgctctacaaggagcagcaatttaaaaaaaaagaaagaaaaatactgttcctattcttaaacatatctttaaaaaatatttgatagatgtgagaagatgaagtaaaactaaatagaagtgtagacattatttttagtaaccaagaggacctggaagatgggaacgcaaaaaaggtggtgtggaagattgaagagtgtgacagtggtaattttttttttttaaagagaatgtctttgggtcattaatgatgcaaagaaagagatgactgtagtcattgtatatccccctataaggggagaaagcagagtcaggtcgtgtctaactgcattgtgatggttggtgaaaatatttttgctgatatatttgtatttctgcaagcttaacagctgtgcctagcatcgaaacttgtaataatgtagagaatatgggaaaaatgtttagttgtgggatgttttacaagtaataccatccaatgtcaaaaggaaagataatacagaaggacaagtactccacagtctcacttatatgtggaatttgaaaaagttgaatgcatagaaacagagcaaagtggtagttactaaaggctgtgaggattggagagatgttggttgtaggacacaaattttttagttatataggaggaata

SEQ ID NO: 80430 - DNA, 1045 bp, Homo sapiens
ggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggtaaatatatagaaatcttatttttgattttaattttgatttttatcctttgaggtgggggggtgtaccattcctggaggtactgcaataccaggtcgatgtgtggagtagatcaagcaagatactgttccatctcccagctccaaaaactc

SEQ ID NO: 80431 - DNA, 1106 bp, Homo sapiens
cgttacatcctcccttgggctgacgtgattacagttctcaggcaaagtctcgaccgccccctaacccattgcgtcccccatgtgcccctcgccctactcttcttagtagaacccctcccagctcgctcatcaccaagccgactagcactaaccctagccatcacggctttcagatagccgctgtcatggtgttcttactcccggtagatgtggtgtcagtccctctagacaccgtcacagactttggcttctctcccaccaccgactgtagcctctctcaacagacctctcctcaagcaaaccttgttatctttctccttagtcgcgatcctttctttggttgaaagggctttgccatgaaatcctgagggaatatttgcttagcctaatgtattccctccattgtggcttaaggggaccgaccgagacccatgtttggaggggttgggctgaaaaaagtgggaggcagagtgaagttatggaagcatgaggccagttgtgtgtgtgccattataaggtcacagagcctgcacctcgtcttgtctgttctgtgtagaacgtgtgaggttgtccagcactgatgttttagggacctctgtaaggattaaatcacgttgcactagtggatataactatgtcgtcttgtagtattacttcacctccttgtcgattgctgcagatactagaactgtttcttatttttatttttaaaggatactaggggactttttttggattcactgttttttggatttgctagaaaaataagatttgtagcattccttaatccctgaatgcttcgatgtcggtttaataataaacttctgttgcctggtgctgctgtcttgcttctccaagaagcaagtacagaaatcatgcagtgttcactgaggtcattaccaacaacagccttctcaatagcagtaaaatgttgaataaaatgtttgtagaagttgagctcctgagttgtcaagaaagaaatgtaatgttgcatcaaatgatcagtacgtaattttaatattggtataaagatgaaatataaagaggtctttgtagtcatacacacacacacagtaaaaaatgttaaagtaacaggagaaaatcac

SEQ ID NO: 80432 - DNA, 1072 bp, Homo sapiens
ggcgtggtagcaggcgcctgtagtcccagctactcgggaggccaaggcaggagaatggcatgaacccggaaggcggagcttgcagtgagccaagatcgcgccactgcactccagcctgggtgacagagcgagactccgtccccgcccccagaaaaaaaagatggaggtcatttaactacagagaggcttggagatggaatgagaaacttgagcggcgttatgtttggaataactggtctgggaaatgggagaaggagccactcttgcctttctcttcagcactgttcattcctcagtgtttatcaggtccaaattagttacttgtctctttgctctcccgttcccttccgtccaggattggtcagctgttgtctccagccttaaagctcaaaggccatccccacttctgtccccaaaatgatcagagctaagccaatttatgagatgcagagaccaacatccagagctaagccaatttatgagatgcaaagaccaacatccactctcatagagattactacatacagtgccttgccaatttagaatctttttctattatttatcatttaagttagtaatgagatataaagatatttaaaatacagctcaattaggatggaaaattaccgtattagggaaagcaggcctttaaacaaagaattcacttggcaggcagagaagctgtatgaggtaaagaccaagacagtgtatggctgctatctattaactagggttaatccaaaaacctgtctatcagacccagataagaacgagttattgttgtctagtatggctagagcatagtatggagagtagaggtgggacagagatgaagatgataaagtgggtgtgaacagattatgaggagccttgaattccatggtgaagagtttagattatattactagaagtaattaataagtacaaaaaaggttcttaacctcttttacccagtggaccttgttggcagtccaccttatagattcagtctcagaaaaatgttcttaaatatataaaatagaatacgtagtaatataaaggaaactaattttgttaagtttttaaaatatta

SEQ ID NO: 80433 - DNA, 1002 bp, Homo sapiens
ctagtcttgtcttttacagcattattactattttcttataatatgctttgttttgcactctcaatctgcatgtgacagtttattgctgtgtgattttcagaaatattgtcgtgctgccaggtcactgcataacagctaactctctgttaactctgttgagtctgttaggctcaaatattctacacccatcagacttgtctcactttgggtggtcacaggcatattaatttcatcacacaacttgtcttgcttctcctctaaattagtcattcttttatttagacaagataatgtgaatggatatttgttttcaaacctcattttctttgattggtttggagctctagctggattttctgattatcttactaatgtcatctaattgataaatattattgtacaactttttaaactcttttagtacttccaagtaaaattatttggtcttctctacaactctctagggtatgtaaggtgggtatatgccttttttacagatggcatacaaaaatgattaaatgattttatatgccatctgtaaaaaaggcgtatacctttttagaaaaacaaggacaaagtcatttaaatgactgctcaagatgataccagcaaatcagtggtaaaactaggactagacccaggtttccagaatcttatcccatactaccttttaaaagaagtcaaaagaagttctaacttatattgtaaacattacttcatctttatcataccccttgaagctaaagctatgaaacaggcaaacacatgttatatcactcatgctcatagcagggcagaatcaggaatgaatttcatttgtattagtctcatgattctctgtttttaaaattacagttccttttaactactaccgtaatcactgtcacgttccattatggaaggaggaagcaatattttatcttatcttttgaaaattaatgttgaggccaggcgcggtggctcacgtctgtaatcccagcactttgggtggctgaggtgggt

SEQ ID NO: 80434 - DNA, 1402 bp, Homo sapiens
gtgtgtttgtgtttctgggctgcaagggtggagagtgcagtttctagggcatagaaatcccaggctcttctccaacctgcccttgtttggattagcattttctcttagacacagaatcgccgaaatctggctcctgtgaagtgtgatttcatgatggcaacaacactctttccgctcctacctttatttagagagcacgggctgggccccagagcagagagttttaacgtttaacagttccacatgccctgtccgctgacagcgagagggtgggaggcatttaagcctctgaaatgatattctagagaaacctgagttcatccgcctgcgtgcctgacctccacagagccaaggaacacctggtacccagcagagccctgctttcgctgctgccttcgtgctggcagggctccttgccttcccggaatgtgttccttcttgtttgccactcagtgcctggcccaaagccaaacctgggctgctcggaatgccatgcccccactcacttctctctcaggatctgagacaaggctctcttccgcctggggaaaggccaggctctcgctgcagcctcgtcccactgcgcaacttctctaggcacatcagactctccaccggctgaaagcagaagcacttagggagaggacagcagggtccccaggaaagcagacggtgtggcatactgatatcctattggcagccttctaaactgggccagagttggcaaagtgttattcacaaggtgttcattaacttgctaaatgcaaaaaggttgggttgggcaccactctgggaaaacatgacacccctgctcctggattcagtctagcatgaaggtgtgttaattggtgtaggatttctatgcaagtttttctttgctgttagttccaaataccagactagtctgtgtggcatgctctccccaatatataaccacatttaaacaatttattaagcaccttctatgggctcctgaatgcatgcttctatagatactatgacactataattttctgagcacttaattgtgtaccaggcactatatagagtgctttttatactcattatctcattgaagagaatctcaatacactaatacagttttcacactttacgctgtgtaaactgagatcaataggccagaaatacaatatggactccttcagggagtagctgaggaagcgaggtagacagaatagcaatgtaacagtgtaagacgggtgaatccgtgtaagtgcaaaaggcagtggtatgggcagacttaatgttacaggggcatgcagcatgcgtgggcctcaaagaatgagtaagatttggatctgaggagagaggtggggaggatcttcccaaaatgtgtgtttgcggggtaacatcagttaaagtatggtagtgctgagggcgg

SEQ ID NO: 80435 - DNA, 1403 bp, Homo sapiens
tgccggcccctcatgaggtggctggctgcattatggggagatgctgcccacggcggagatggtggcagtggctgtgaagaacagaggtacctgaattctgtgtcctcagctgtcactttccggtgagacaagtggagcagggcctttgatcactgtggtcacagacctggtactgggttttgcccttgtgtgctcaaacatttctaaggtgtcccaagccctggaaatagggaagggaagggtggaggcttggatctgaggtcttgctgtccactccctgcctgcctgcccgcatctcaggcatggccaacagcagcccgttgaggggggcttgtctggacagttgcgtgtgatggtgttgagccatcacagggcagaggtcacttgtgtcacccccatagtcattgggttgcaggccatggaggagggacctccactccatggggcctattctccattaaggtggaagtgtccactgtgggcctagcacagtgcaggaaccaggccagggggtctatctcatacctctggggacaggaaaggtagaggatgaggaggttggacgtggtggtggctttgccttggatattcctcttcctctatcaaggccttctcttcttctctgtgtcccacaactctggcctcatcgccctgggactcccatctgctaagatagtggctttggaggttctggaagggcttagtgaggaggccagaagtatcagggaaagttgctggtgatggggtgggcggtgtcagaagcagccactgttttcccctcttcagacactgagagattaatcagggaatgaaatccaggtggaaattatttattgtgaagcagacgactgtctgtcctgtttatgacaaacccaaatgagaattggagggactaccagtaagtggtctcttcatgctctccccatcccagtttttaggatgaaatttagagcctggccttttgtgttgcttgcaccaaatctgtatgtctcaggtgaaactcactgttccatgaatggtcatcctttttttttttttttttttggaaccagcccctttcaccctttcatccgtcttttttttttaggaaaataacccttcttgcttcagcacttctccctggtccttgctgaaagacagagataaaaatccattctctgagccttgcttggttgtcagaggccatgagaggtgccagttataggtggatgtgccaagatgctggtgaacttggtcttcagctatacccaggctcagaaagggcaagagccatgctgcagcgtaggtgactttggaggtgcacttggggcccagggctttgagtgttgcgggtgtgcctgtccctccagatagtgctctgtttctctctgttgtccccctgcctggtcctctggggccactgt

SEQ ID NO: 80436 - DNA, 1023 bp, Homo sapiens
cagcgcttctcagacgcagcctgtgtgtttgcagataacactgaataaatacaaccagcaataccacaagctgtttaaggatgttcccttggaggaagtggttctcaaaggtgagctgtctcccggtatagctggttaggcacccagagtgcctggggccaggggcctctgctctggagcctccaaagcacgacttagaaatgggaactggctgtcctttagatgtggaccactcccctagaatgtgagaagactgggctggtgagaagactgggctggtttggacatagcattgcatttttgaaggttttcttggggaaacgtcagggctttggaatcttgtgtcctgctcttactggtgacttcttacctgctctggcctctcactgagcaggtgggggcatttgcacaatcaaggcccttggggcagagcagagcagggaaaggtcagggattctgcctgaggtggtgagaatgcaggcttggagatcagggcaggaacttgcctggaccctctggagcaagggtggagaaggaagaaacatccagcaggctggtggagtggaggagcagtcaggagaaggacccttcgacgctggggaatggactgtttggggtttggggcctgcggtggggaagggggagtctgaggaagacaggtcctgaggctggactgtggactccagaacgtgaggacccaggtcctggggcttcctgggctgaccttgcttatggccattttctctcctgtgacatcctagtgtgttcctgtgccctccagagggacttcctcctccagggccggctctacatctcccccaactggctctgcttccatgccagcctctttggcaaggatatcaaggtagtaatgagtggtgagggctgccatgaccctgtgaggggagccagcctcctgccccacgggcatgcctcaaagtcatgcctatctctctgcgtgctgggccccgggtgaagccccttgctggttggatgcgcagcttcgaggcatcccatccagtg

SEQ ID NO: 80437 - DNA, 1587 bp, Homo sapiens
caccccatgtccacctgtagccggctctaaagtctggctcctttcagagcaaagacttatggccttgctgggagaggtagaatagagggtgtctatcccattcttcagtgaggagtcagtatgcccctccttcttttttcttttttttttttctgagacagtttcactctgtcacccaggctggagtgccgtggtgggatcttggctcactgcaacctctgcctcccaggttcaagtgatcctcctgcctcagcctcccgagtagctgggattacaggtgcccaccaccacgcccagctaatttttgtatttttagtagagatggggtttcaccatgttggccaggctggtcttgaactcctgacctcaggtgatccacccacctcagcctcccaaagtgctagcattacagggactacaggtgtgagccacgtgcctggccccctccatagtcttctgatcaggctggctggagaccatgctgcagacactcttaggtttaagttttagtttgacaggcattgaggtagcctcagtgggcacctctgggacaaatgggcaggtccagaggggaaagctgacagaggccccatcgagcttccaggagagtttaggctggggccaaatagaagttctccttcccaacttccccttgggagaattttctgaatagcctgaagagggtagctcaagctccatctgtgccttgatgttgctggctgctttcaaatttctttctttttttttgagacggagttttgctcttgttacccaggctggagtgcaatggcgtgatctcggctcactgcagtctccgcctcctgggttcaagtgattctcctgcctcagcctcccgagtaggtgggattacaggcatgcgccaccacacccggctaattttgtattttttagtagagacggggtttctccatgttggtcaggctggtctccaactctcgacctcaggtgagctgctcacctcagcctctcaaagtgctgggattacaggtgtgagccactgcacctggcctcaaatttctaaatttagcaaggccccaaagctttggcacagaccagagagacttgtatgctaattcatccacctagggtgctcccgtgaccccctgaggttgaggtcggcagtacccaaggtgggttgctgccagctggcctcttggaagctctcccatgagctgctgcgctgttagtgcctcctgggtggctccaccccgcccctaacctgcttaggttcgctctggtccttgcctgccacggaccatgtttatcagctggagggaagagcctcactctggaatcagaagtgagttctaagcctcaggctgttcctgttttgctgcgacttgggacaagtcacttccgctttctgggcctgctttacaccataaggtaaggagattggactgtaggttccctaaaggccttctgcatgcagtcatccagtgattctcctaactagacacttctagcagcttcaggggaagtttgtctacactcatgctacagtattttcagcaaatgtgattggacaagtgggcctgtgccttatcttttggtggagtgaaaaaa

SEQ ID NO: 80438 - DNA, 2957 bp, Homo sapiens
catagaggccaagcgtgaagtgcagggacttctctgctgtgatgtggcttaagtttccctgacacctgttgagtgtcctcataacttcccttctggtgcccctccccagctcctgagacacagctgcagctacaagtgtgcagtgtcagtgttcaagaaagtgcctggcagaggggctttagaagggtcccctgccttccaaaggagctttggcaggcagagctgctcctgcagcaacactcccatttcctgttcttgcctgctgagtagcacctagatttctaagcctcatctagatactcagatttgattctgggcctttatagcccagttgctgggactgtttcaggagctaggggccatgtggggcagggagagggcacaaaagtagagaagcctgatgttgattcccagggggctggtcagctctgctactgctccttgcagatgtcaagagtcaggtgctagtcacgtgctgcttggcttgtcactgtcattggcagcgagaggaatgggtgctggtgacattgggccagggctgcctctctgtgtcagagttcagggtgtaggaggggttctgccaaccatgggctgtgtggggtaagtgggtgaggctgatcttgctgggtcaaggtgatcctgagcccttggcctgtggaatgggggtagagggcaaatggtaacctagcatgctgtgggggatataggatgaggggctgcccgagcctcgggaggggtcctagggagcagatgttgaagaggccagagccctcagtgagctggatgagagggtgagctgtttgaacgccctgagggtacttcctggggcctcgtgtaatggtctcttctgtatgtcccccatcccatctcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggtacgtggctggagcaggggctagagcctagaggagcttggggatgcttgagcattggcttctgtgggaccccgaaagtttggggaatagaaaggggaacacacagaccttagtggggcaaaaggcccagcgactgttcctctcccttattgggaatgttcattctgaatctctcattctccgaagtcctaagctgagccaggagggaaaagggtcctttgagttgtagggctgagcaattcagttcctcttctcttctagtctggggctcaaagcaaaattgtccattttttggcatctgctcattactgagagttttttttgttttttgttttttttttaaataaaattggccacagctcctgtgctgtggggtggcatacacagattacgtactgatgtggccattgtccctgtataaggtagggtatcatcagatgacaggaagcagctagctctgaccctgggcaaggctttgcaccctctccaggatagtgaatgatgtccaaaggtccctgccaaccctgccatctgagtgataaggacatttcagggccttcctcctgtttgcctgggctgtgagtttggtgccaccttgtggtgtgaggaagtagtggtcagccagcctagttcagtactcaggctatggggcagctgcccaggtgcaaacctgcctggcttggcttttactcaccaacctcccttctcttcctccaggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacctgtttcctctcttttctgctggggagggggaggtggttgaaccctgccctctgagcaggctgggaatggctgcagcctcgtgccccgcagtgggagctatggtggtgtcacctgccatcctgcccacctcctggtgcagaggcgctgggaaagcagtagcttactatcttagggttacaggttgcccccttcagtgctgcggggagactttaatggcttacgtgaaccgaagatgggaaagagcagggacaaggcctccctcccactctggtagataaacccaaattgcaaagtggccttggccatggttcttccactttggtcttcctgcattagcgtatcccttatgggggctgtaggaggagtcagctctgggcgcctgagactgggtttggctcccaggtcctcagttgtggacctaggctccccttgggacccctcctgtttgctggtgccct

SEQ ID NO: 80439 - DNA, 3542 bp, Homo sapiens
acagctttcagagaagagatgtcatttctattaaatgctctttcagtagcgaactgagttcacacttgactaaggatattttccggactgtctgtcatcagcatccttagtgggtttccccatatttaaattggtagaggccagggatggtggctcacacctgtaatctcagtactttgggaggccaaggtaggtggattgcttgagctcagaagaccagcctgggcaacctggtgaaaccctgtctctactaaaaattcaagttagctagctgggcatggtgatgcacttctgtagtcccagctacttggagagggggtgatgctggggcagcaggatcgcttgaacccaggaggttgaggttgcagtgagccaagatggtaccagcctaggtgacaaagtgacaccctgtctcaaaaaagaaaccaaacaaacataaaaaaaaaaacaaaaaaatcggtagagagtgatttctctcccaggcccacttaatgtagactgggcctggctgacacctcaccattcgtgtgatgtgattgctgttctgatgcttagatactcttggcgcagtctcacaattgccaccatggtaggaaggtgtcccaggagacggtgcaccttgaaccagtcaccactaaagtggctgcctttctgggtctctccacacatcccctctctctaatttccctacttaatcgtgtgacttcatggtctcaaaggaggaacagaggctgatcttgacttagatatactgaaccatgaaatcactgcatagaatgtggggacttgaatgtgtctttgggcaagtcatttaacctcttaagacctcatctgtaaaatggattagatatgtttaattatagccttagcattaaatattcattgctgttattattaagtgtctgataagtctctgtgtacatggatgtaatcttcctaactcccattacctccatttatagatgagggttatatggccaataaagcctgggtttgaatctaggtctactgcctccaaagccagtcttctctcctgcaacatcatgctctgtctagcaggagatgagaacaggtctccatttggagcctgtcagtggggtcagagactaagattcaggctcagggtctaaattccatatcctttcttccataccctggtgtttcctatgaacagatagatactttagggctgcaaggtttggattgcatggcactgctcagaagataagttacaggtctgggctaggctgtagctgcccctccaggtggctagacctttcctttctgtgtcaccagttaacactggccaacagttccttccattaactgttcactgctttctcctgtgtctaactgatgcagtttatgacccataactaagagcagtaccaggtatggctctgtttcctgttcatgtcccctgtcctctgggctgcatgcattccgttcttacagaaagaatacctttaacctagtacatcctgccacacatctgcttctactgtgaaattgatgagggggtattaccgattcttccctcacccatcatttactgagatgctggtgattgcattataatcctctaaagcttacattgtctttctgattcttggtcttatctgagcaagtgatctataaataactcagtggctttctcatgactgttttaattattagattttaatcaagtgtcttattaaatatatctgcatgcttccacaggcatctgtctcttcacatggctgttcagtgtgcctctcacaagttagcccacgttttctgttctcctgcttcaaactcagttgagctgccttgctttggctttgatcccagctttccagcgctgctcaatctgttgccatggcaggccattggaaaggctcagtgcatccccgtgcctgaagccaagtgagcgctcactccatgcatgcatggaggctgggcaggagcctgcctaatcaaccagccatgtgaggagggagggcctgttccttcctgtaagctatgtcatgaggcagcgtggtcaagtcctctgccagggagtggcctgggcccagcctgggcatgttttcatgccagggtgctagagcctactgccagattgtctccctccacccccaatgaaaaaatccttccagaagggaagagccaatttcccctgtattggaggggaagtggcagcacctcctgaagcagttggactttcatcaccctacctctgcatctgcctgaaggacagatttagccaattaacctaaggttaccttcctctctgataaattccccattctgtcttcccatgtgttgtgtctcgtttttttcctcctccttccctcttccttgccccctcttcccctaaaccttacagatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtagggccctaagggcaggtaacactgttaggataaccagcctcttgctccacctgctctaggagaagacagccaggcccaacctggcatctgggcacagagcctcttctcgtctgtaggaacaccgccagggaggtcatggcagggcaggaccaaagggtcctgtggctcagtaggcacagtagatgtcacaggcacttggtgaaggactggtttctgtggagtcttgatcttggctcagctcagaatctccagtgattgggctcctcttggcctttgttcccaggaacatgttcctcaccagctgtccggtgactcttcccctccctctccttttgtgacaaagctctgacaaagctctgtccccctctcgtccctctggacggatgttgctcccctagattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtaggaggcggcagcggctccctggaatgccctgctcagtggtacctcaccttgggggtcctgggagcagtccattgaacaatgctcaggtggcactgagccaaggtaagacccctctgcctgccaccttgggcctgcagggaaggattgagcagagccccttccctgggcccaaaggactctaggtagcactcataaggaatgtcagaacatttggatcaaaagcaaatttatgctggagatttattacataacagtgcacaggctgactacaaatggttatttgatattgaaaatttagtcctctaaaattgtaaaagataaccacttttgcttattccagttactatgtgctctttaaaaatttcagttgggaaatgaatttatttaaatgctgtttactgtgcctccatttggcacactagtccctgctgttttt

SEQ ID NO: 80440 - DNA, 5497 bp, Homo sapiens
agaggcaggagaatggcgtgaacctgggaggtggagcttgcagtgagcctagatagtgccactgcactccagcctgggcgacagagcaagactctgtctcaaaaaaaaaaaaaacaaagcgattgagaaaatcaggtctgtgtgaccttagcaatgagttatttagcttgggccactgttagcttaagtcaataacttcaagtttgcgttgtagttggaatcaatagaggaaaagctctcagcattaccacatatatcagaatgtgacattgattgccagaccagccttatccaaacacaagtcctaggctttttgccctgtttatgagctttatatgctgagggtatttgatgagtcttagggaaaaaagaacagccctggggacacagctgcttttatgatgagacatgtttgcacccataccttaatgggttttggtggcaatattctgaaatttgccacctacatttcaaagatttgccctttgggtgaattagtgctgtagtagaagtgggtggaggctgaggaggttggattaagcaggtagaggatttctcagtgcatggatcgtgctgaggatggagatagagctctaagacatccacgggcctttcctgagtgatcagctttggctcctgggcaggggaattggagctggattctagtgtgggagcacgcttgtcatcttccttcttttcccccagtaccatgcggagaccatcaagaatgtgcgcacagccacggaaagctttgcttctgaccccatcctctaccggcccgttgctgtggctctagacactaaaggacctgagatccgaactgggctcatcaagggcgtgagtattctgcggagagcgaggggaaggctcagtaggcaatatgccccagagacatgtcctccaaagcgctgggttgccatgtttcttcccagtactatgaaggactgcagaggagttgaggtctacaaatgaggatttattcatcactgtaaacaatgttgatttgatctactttgctaggaaatggtaccacaaaggaaccttttttttttaccctaaaaacctaaactttaggctttctaacttggagaaccatctctttgtatctttttccccatcattaagtagcataactgaaacatattcttttcttggattatttccgtgaagtatacagagttagagaataagagcaaaaaactgtattacttttagcagtgacttgagcattgttcccgggaggaaagagcttttccattccttctgaggtgatgctgctactggtgtctccagtttggactcttgcttactctcttgtccctagagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtacgtatgggagctggagtccagttgtctaaaacagtcttttgtctctaaacttccttgacacaaggaagatgggaaggttggttgcctggcagtgagattgagtctgtgtgttctcaggaatcccttttataactcatttatcctcaaagataggctttaatccagcatagttacattcttctggttctggagaacacaggaacatacatacatatatatatatatatacatatatatatatatatatatatatatatatatatatatatatatttgtttcgctgtgttttgttttgttttcaagacagagtctcgctctgttgcccaggctggagtgcagtggcatgatcttggctcactgcaacctctgcctccagagttctagctattctcctacctcagcctcctgagtagctgggattacaggcacccgccaccacacccggctaatttttttgtatttttagtagagatggcgttttgccatgttggccaggctggtctcaaactcctgacctcaggtgatctgcctgccttggcctcccaaagtcagaacagtcttaattatccttatttatgggtgaggaaagtgaggtacagagaggttaaatggcttgcccaggattacacagtgtagtaggttttcaactctggtaaaacagctccagcacccataatgcaccacttcccagctcactgtccttgcgggaaaggtgcctgcttcctgttgacctgtgccctcgtgctctgcctcccctacttaccctttttcatacaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggcaagtccccgttgtccctgctccagtcccagcgcagctctccgaagggcatggtccatcctgtgaatgtctgattcccagcccctagcccatcagaatgtagactcccaagccagttccaaacctgctgaatcagaatatcttaggagagtagaaggcattatgtttttttgtttttgtttttttgttttttttaaaaaaaagcttcccaggtaattgagatgctggcagcttgacattgttccctgggcctggggaccaacatttgagagaacagggtcactgctcacaggaccaggggccatgatgttctgttcctgatcagaaacactaccagtgtttgctggaatggggggaccagggggaaagatgacagcagacacttaagaaagggctctttttggcccttcctggggagccatgtggaatttcagggcctggtgtccatgttaaagcttatggcctcctggtcttcacttagaatgcagctggctcagtgatcatgctaactctggtatggtccattccactctcagaggaagatgtgtggttcttctccagtttcagattgccccaacttagcttaccccctccccaatgctcacaaagtagagcccagtgggcatggccaccatttttggcatcctgctaggaatacaactcagcacaactaagatgctagacacactcttgtggattagaagtgtgtttggggagggtgggggagcaaccctgtgcacccactgtagtggccttactgtctgagctttgtgtagatatcctctgtaccaggcaatttggggtcctcccctttgccatcctgataagccataggctagctgaacttggccctaggccaggcaaagccacattccctcttgccttcagcaggttggagtgggccacctcaaagggcagtcctcaagtgtccttgactagatgaggccatgggtctttgtggtggaagcagtcatcaggcctcaggttccctgtcttgaagtgctgattggaaaatggaggccctagagagacccctaacatgcatgggatttggagaggagaccttgggaatgagcccatttggatttgccctctcccctttcttccgtcaatgaagcatccatattggtgttgaagcccagcaggcagaattgttggcccactctgggggcctaaggtagctggactgccttgccatctgtgtgcacccatgatgatatcatggatgtctgtcctggtacaaggacatctaagttagggaatcccagggaaacttcttgtctactgccatacttgtggcctctgttctatataacctctctccccccaactttgtccatcaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcaggcatgtgcccacccttccccacattctcatgtgcacactcgcatgtttgtatgggaaagctctggaggctgtctgatctcttcccatggaattgtcgcacgtaacacacagataatccccttcccccatgtacctacacaaagccatactctgtgtacctactcactatccagaggatcagcttgctgtcatttgtctctgaagacagctcaagctacatctcactaatgctctgtcccctcccagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctggtgagttctggggcctgccccatcccccagggcttcggactgggcctgggatggatgcaagctctggtgcagagctttttaggtttctccatcctcttatgcacagcctttcattatcctccaagttacagcagcaagagggtgggggtggaagtggaggtggcttttttttttctcctgttctgcattcctgcccacacccccacccctccatttccttctgctctggaggcatcctccttcattggacaccacacagtttatttcacttctgacttcaaggttgtgaattcttcccatggcttaagtcctgggatacttctgcagtgaaaggaggtcttgtacctcttcctcagagtcagaagttctgagtacctttgccctattctgaaaagggctaggggctcctgctcccagctgccctcttcctttggcttccaattcagttccctctgccccgcatcctgcagacaggcgctcccgcagggggcccttgtggacctgcactggagtctgttgccttcactgagctgcctgtgctggccttgcatggtgcctgtagggggatttgctttgctgtgccattggggtacagctgctgctcttactctagaccaaaaagtcgggttgagtgactggtggcagggccacagatagagacagcggggagggtggctgaccctggcggccctggactgagcgtctggaggagtcgtggaggctctttcccttctttctcctctgagagctcgttcttcaggctcttccagcttgtcatgtcgagtgcctggccactgctcagggttggaggctcagtccctttgccctgtctgttccagctctggagctaactcagggatccctgatcagggttacataggtttggtaaaatgagtgctggaaattaactttctcccagtagtcttaggtcatgctcagtgaacttaaactttatccagatatggttttccttcagcctttctattccctttctagccagtgaaagacccgctgccctttgacctcagcccctccaagccc

SEQ ID NO: 80441 - DNA, 1233 bp, Homo sapiens
ataggtaacatttattagataattaccatgtactttgtcctaatacttcatgtattcttttactcctcacgtcaactctgaaggaaaggcaccacctatccccttaaaagaaaacaactattactattcttttttttttttttcttttagagacggaatctcactctgtctgtcgcccaggctggagtgcagtggcacgatctcggctcactgcaacttctgcctcctaggttcaagtggttctcttgcctcagcctcctgaatagctgggactacaggtgcacgccaccacgcccagctaatttttgtattttaagttgagacgaggtttcaccatgttggcctggttgttgtcaatctcttgatctcatgatccacccgccttggccttccaaagtgtttagatgacaggtgtgagccaccgcgcccagcctctattctattctattttgttctatttctattacaagccagtaagcaagaaaatatcataatttataaggaaccctataaaaaacagacaagccaagggtctgtcattaggaagtatgcctgaataagaagctgaagatttttagacacaggtttcaggcaacactgtctttagaggctaggctctggctccagctccctccagcctcctgtgaataacaggcaggcttacttgcaggtgccactttcctggacagtggtggttaaaggacaaggcccagaaagtgctgaattaggtgcccttgttaccgctaatgtcttattgatgacactatcttagagctcttttgacatcttggctctgcgtcttttttttttttttttcttgagatagggtgttgctttgttatccaggccggagtgcagtggtgtgatcatggctcactgtagccttgacctcctagacataacccacctcagcctcacaagtagctgggaccccaggcacgcaccatcatgcacagttaatttttgtgttttttgtagagacgaggtttcgccatgttgcccaggctcatctcaaactcctggcccaaactgtcctcccaccttagcctcccaaagtgtttggtttataggcatgagccactgtgcttagcctgagtccctcttttaaacaaacaaaatggtaaatggaaaggaggaaaggcttaagaaaaaagattgaagccaggatttgttgtaagcaaggagtaataaagggcagttcatttagagaaaggcatatgaccacctttcccc

SEQ ID NO: 80442 - DNA, 2470 bp, Homo sapiens
caggagcctagtaggactgtatttgtgctgggctctttattagctggctttacctatggacagaggccttgcccaggagccaggtagcagctgttgggatggctccattcctgcctccattgccagatttagaattaacccattctgaggagcttggggttccctgaggtaccatgacttatttatttttttattttataaaacaaaattttgctctgtcatccaggctggactgcagtggtatgattatggctaactggatccttgacctcccaggttcaagtgatcctcttgcctcagcctcccgagtagctgggaatacaggcatgcaccaccacacctggctaatttaaaaatttttttgggggaaatgaggtctcactatattgccttggctggtctcaaactcctgggctcaagtgattctctcaaatgttgggattacaggaatgagctaccatgctcagcctgggattgtgcctttttaaaaccttcagacttaaccataggtttcccatagatcatgggatttcgtaatggcattgataagaggaattacagaagaggcaaactttgcacctgtcttggcttctgtatttcctgttgagagtaaagaaaatgctatcctgtaaggccaattgccttacagaggttgccctctggcatttggaagttggtattaagtttggactaaaaataaagcctcaggaaatgcaatccaagagtgaattcctccttttgggaaacacaagactcttcatcatagattccctaacctgtgttcataaacagcctatggcctggctagtggctggcccttaaatgtcatggggacctgaccaagtccagcagacataccatgtaggttaagacatgtccctgtaccttttggaaaattctgtagttttccaaaagcaaggggtccttagcaggagtcaccgagaattacttgttagagaattaagtgttagcttagcttagagagagctgaagacaatgctggaggtctgttcgctgttgatccctgctgctgtagtctgccatgggctcctgcattcaggggaaggagcagaaatagatttttaagaagttgacctttaagtaggctttatggttccttcatccagtaaaataacaccacatagctctaacatggcaagggcgagtgatacctgccacacctgctggatgagagctggctccgattttggtattttaaactttaagaggcttttggagattatctctactttcactcctattcccagattataattaagatttattttttattttttatctatttattttttaaagatgtccctcttgtgtgttcattttgaagttttagaccaagatgaggttgtgtgtgggctcagcttggaaactgatctgaaattattctaatttatataatgtaatgtaaacagtttcagccttaccatacgtcagggctatcgtttcatgtgcacctttgactaggggctggggcgtacttttccagtttctgactattttaaatgctcttctgagcagaacgttgagattactgtcttccctctcactctgacagagggacatcaaatgtctgcatctgatcttttaacagctttttttttttgagacagaatcttgctctgttgcccaggctggagtgcactggcacaatctctgctcaccacaacctctgcctcccaggttcaagcaattctcatacctcagcctcctgagtagctgggattacagacctgtgccaccacgcccagctaatttttttatatttttagtagagacggggtttcgccatgttggccaggctggtcttgaacttgtgacctcaggtgatccgactgcctcggcctcctaaaggcgtgagccaccacgcccagccctcttttaacagctttggcaactagtcttcagccctcacttttggcagttcacatgggcaagatgcattcttgctgaacatgtggttccatatgccatgttttccagatttatttatttatttatttatttatttagagagggagtctcgctctgtcatccaggctggagtgcagtggcacgatcttggctcactgcaacctctgcctcctgggttcaagagattcttctgcctcagcctcctaagtatctgagattacaggcacctgccaccacacccgactaatttttgtattttagtagagacttggtttcaccttgttggccaggctgatctcgaattcctgacctcaagtgatccatccgccttggcctcccaaattgctgggattacaggcgtgagccaccacacctggcctagaaataatgacttttaaacaacctaaatgtagagccttccacaggacagcattgatggatgctttaccacataacatcccaataaagccacagctgaagtggaagactcagtacacctcccagagatgctctaagagattatgatatatgacatagattt

SEQ ID NO: 80443 - DNA, 4733 bp, Homo sapiens
ggagttgggtgtggttcgtgcctgtagtcccagctacttgggatgctgaggctggaggatcgtttgagggtgcagtgagctataatataatataatcacaccactgcactccagcctgggtgacagagtgaaaccctgtctgaaaaaaaaaaaaaagaaaaaaaaaaagttggagggaggagtgttgggtattttttatgatttttgtctcctggtttctgaagaatggccaaaaaattgtgtctgacacaaaggaaactaatataaaaagccaggagctgtctgagatgagaaaggaaagggagaatagggcacttggagctgagctgtgattgtgcctgttccaacctgtcactccagactaaggcctcttagagatggtgtctcctttctcacagaggagacatggctctgaggaagatcttactgcaggggctcgggctcaagaataaggctcctggacctgggcatggtgtgtgctgctatcagtggatacgccaggcttccactgctggctggaggttggctctgcatgtctgtgccttcctaggaggaggatgcaatagtgagtcagactggcatgggtggggccacatgtcctggcaggcactgtccaggcagctggcatgagggagaggagtctttcccagaagtccgccctgagaaaccaaggctgggctgctctcctggagccaggggagtccagtgagtgttttacatacaactctaggtacgtggttggtgggatgggcagtttgtgctgggaagaggcttgtggaggattttggagaaggcaggagagctctggccctccctgcaagggaggcttcaggtcagagcctgaggaaagacctgggcatgagatatgaggtctctggctgggtagagagcatgaaggacacatgagatctggagtctggatgaacttgctgacaagcaagctttttttgactgctaatgcgtaaatccactatagaaattttcatttgtcatttttgtacttattggcaaaaaattagagcttataggcatcagatttaatttgagatagttgaaatagggtttgtgtttgaggccaatataattttatctgctaatggcatctcgtggacttggaggcagcccttctgtaccagaacattgtcaaaagcttttactgtaaagcttgagaacaaactagtttgctggatttgggcatgtaactaacaggtttgaggcatgggattatcctgtggacttttttttttttttttttgctttgaggttctgaatgtattaaggttgaccttcttaagccgttgaaactgttctgcagtacatttgtgatgtagggcctaagacttgtatcgttttttttttttaatcacaacccagtgtacagaacttgagacatgcgtcttttctctgccaccttttaaaagcagattattcttgaagtgcatagagcagcaattgattaatggaattggtgtcttcacatttcatttacttcctcccaacaattttataggatgcatataaatatttccaaaagaggtacacataatttcttactataaaagtatttttatatttatatcagtaaatttgttaataaagaggatttttttttttctgtaatcctaccaccccaatgacgtcctattaaaatttcagtatatatcctcccaggtcttttaggtatgtttaatttggtgtcccttccccgctcccaaaaggggagggaccaggttcttgtatagaatagtggaatgttagtaaatcacaggtttaaagagacataacagtggaatctctagagcagctgtcacctggatacctggttattaaggtaatttttccattaccccaaagagctttagttacactcagctttttccttaatccttgtgcagctctccagggcacaccgtattcagctctgagcggtctttgctagtgaggccaaggagccaccctgagccaaaaggggagcattatgtcaccggaagcccaaccccagagaaccaaaggtatgacctgatattcagtggccccagccaggtctttacaggaagaccctcatatctcaggtctaagaagagccagctgatggtttttaaaaagagtggaattagttactccaacccacttattcagatcttattttgttcacaatacagtccctagattgtaggcccattggaggccacagcaaagcctttgtgttccagttggcctgatgtgccatctctcagtaatgttcccttaacagccagacttccctaagcccagctgggagctctgaaggtatgcgagccctccctcaaccatgagtgtagggaaagggaccaggggccccaggctttcctgtcagtaatgcagaagttcctcagatttagggaagggggagcagaggcataactttgattctgacaaagaggcattcagagagactgaaaggtcatttaacaaacactggaatgcttccacatactaggtgctaggagatacaaaaccatataggtcctggaagggaggattgattttttcattttggtacgtagtagatattaggggcttaggaaatacacatcgaaatgaagagtgcatttgccatgttgaaccgttagccggtatcttatttccccattttaaaagttttagaatctgtggttgaggacttgtggccatcagttttccatagccaacagactgttcactactgccttcagagctccttggacctcagcgggccttctttggagatggcagagatggatttagatgtatactctactcgagccacccagagagcccacaaagtcagagatggaacagggtaaaggagtaagggtcatatgtgtgagatgccttgatttggaactttgagatttaggatgaggtggggaagggctaaagaggagcttgttcctgagccttgcttggccgaagcatttaggctcaagcgttttagaaagagtagcccttggtctgagaactcaaggaaacagctttctgatgagacgtgtagcaagcttctggttcacatccttacctgatagttcttcaaacactgcctggtctggttcacatccttacctgatagttattcaaacactgcctggaagcttctcctgagtttttgtctctaatcagctaactaacaggctgagtgagtttagttgtaagtcattaatgaagaaagcaaaggttggggccattgtcagggttgtgacctgggctagttaattacctggaactgatggtctgtgttacagagtggtggtatacttgtcaggcttagaaaagaaatcaggatgtgtatcaaaaatcatttggggaaaagatttgaccagcaactttaatttctctatgtttgcaactatcctgttaatgtagttgtgataatttcagaattataccagtgcccttatgttatccttgctttgcaaattgcaaattgctttgcgtgtcctgacatccttctggccaacagtagatgtggttttaggtttagactcctgggatggaagcttttgcattcaggggaatgactttgggtttgggtgaggattgtaaagaggcaatatgggtgccccacgacaaagcagctatttgtagctttgtgacagcttgacatgcagagatctaggcttatcaaggcactaagctaggagtcagttgtttgtatcactggaagattggttacaacttccttcattggaagctccttcagtgcatgttaaatgatgttatttatagatagggtggtgagaaagctgtctaggtagatgtcagtcagcccagtgtaagagagacctgcttactgtgggtgcttgggactatgtggagtgggtgggaggttttaacttgttcagtaaggtcctttccattgttcacaatctggtgaaccctttttctaacatgaggagcacccacataaccagatcatgtctggcttccctgtggcttgtgtacaaagcgtgcttattgagttaatgtgtaagcaggagacagccttctgtgctaaatggtatattaaccacttctcagtcttaccactctctttcaatttgtctcgacccaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggtgagtgggtgtgccccttcccccaaaaaagggcttcatgggcagtgacctttctctcctgaaaagagtaactaaatgtcctaacaaacctaggtgctacatgggatactacacagattcttatgaaaggactcaggtcataggaagttgcagtaaagaattagtatgtgcataggatggcaaatacagttaataagagagtattagacatttcaaaattgctaagatggcgaggtatggtggctcccagcactttgggaggccaacgtgggaggattgcctgagcctcgaaatttgagaccagcctgagcaacttagaccctgtctctccaaaaagtgaaaaaaaaaaaaaaaaaattagctgggcatggtggcatgcacctgtagttctggctacatgggaggctgagacaaagatcacttgagtccaggagattgaagttgcagtgagccatgatcacaccactgcactccagtctaggcaacagagcgagatc

SEQ ID NO: 80444 - DNA, 1140 bp, Homo sapiens
cgggcgcctgtagtcccagctactcaggaggctgaggcaggagaatggcctgaacctgggaggtggagcttgcagtgagctgagatcgcgccagtgcactccagcctgggcaacagagcgagactccatctcaaaaaaaaaaaaaaaaagaaaaaagaaattaaagaaaatacagctcagcctttatttgtgtttttttttttttcctttttttctgagacagagtttttcactctgttgcccgggctggagggcagtggtgcgatctccgttcactgcagcctccacttcctggattcaagcaattctgtgtctcagccacccaagtagctgggattacaggtgcgcgcctggctaatttttgtatgtttagtagtgatggtgtttcaccatattagccaggctggtctcgaactcttagcctcaagtgatctgcccgcctcagcctttcaaactgttgggattacaggcgtgagccaacacagccagccatggctcagtgttaatggtcagttctgggtggtagagaggcagatgttaaaacttttttttctttaattcgtaacatagaagcaaacctataaaggctgccgtaggaagaccagtcatagtaactagttcagtgctcttggagagttggcactgcctttcctcctttatccccccgactagaatgcagggcagcccttccagtaaatgttgagccagtgcctcactttgctgaggccatcacccaccttagttgcacttaagaggaccctaaatcagggtcccaggtcccttgctgattttagagtgtggatatcatacccagaaacaccgccctacttttaatcctagtaaggaggcaccatgtcccaggacaactaatgcttcccccaaaccacctccttcaggctgaaaccagttctctgcactgagcagctgggatggaaccaggaaatcctcggcatctgaggacattgaggggtctctgacttagggcttcttcacctgaagttgagtggtctttgagggaagtaggcccatttagcatcagctgctcttccctattccacactctagttggaaataggaccttaggttcctgttgacaagtcatttactttcagccccgaagaaataaaagagccaagattt

SEQ ID NO: 80445 - DNA, 5231 bp, Homo sapiens
cccggaggagtggggagtggcagggcggggccgggagaatgctgccccggaacccataaatctgggccctgcccaggtaggccgggacagctggggtggcctgggccgagagccaagaaaagacaccccatctggcagcccaacttggcggcaacaggtggcccggcgcccgggggtctgggaggaaagtcgctccgggggcgggccccgttgccccgccgcgtccccattggtcatcaggtttcttaaaatgtgactctgaatctgtgtccttccgccgcagaatttagtcccaccgaaagggcaacctgcccgcgcgttccgccgccgccgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggtgagcggtgcaggaggctacgccatcagtccccaccaagggccagtcgcccggctagtgcggaatcccggcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcaggcgggtccgccggctcctttcccgccccagccctaccccctcattctggtcccatcctcttcctcctgccccaatcctcaatgcgcctccatcctcgcctgccttctctcggtccctcgtgattgattccacccttgcttcccctttctccgcgccgcctgttccgtgctcgttttcccctcttcctccttaagtctggtccttccaccccctcctcttcaagctgtgcgtgtcccctgattctaatgctttctgtgtaactcattgaaactgcgttctggttcccctcccgcgtccattctccattcatgcgcgaccgcccttcccgcgccccagttccctctcgccgcccctccccctgcttgctggtcacgtccgctcccccgcatccccttcctcgcctggcgtgtccgctccctccctccctctctgctctggtcgcgcccgcccacttgctccggtctccgagcgcggtcccaccccccttttccatcaccgcctcccagctcccagcaggctcgggcggtgctgaggccccgtgtccggggcgggcgggcggagggctgggctgggtgccccgcgcggcgggcgggatgcggcggcccgggggcagctggagacttacgtaacgttggcctgccccgctgccgggaggcagggcggttgcccctgcggcgcggtgccgtcccctgtggccgggattagatgggcggcctgcgagggcctgggaatggctcggggcccgagagctcgaccggcccttgccgggtggccgccagggaccacgctccatctcgccgcggccgggctgcacgtagcggccgcgcccagggcccaccccgcttcaccgggcgatggccttgggcctcgtaacgggcgggataaacctctgcaggctttgctggggcctcctggccctcgcccgttccgcgcctctccggcacgtttctttcttttcctttcttttttctttcttttttttttttttaattatccggcacattttttaacaaatgcgtcctgattgtggaacgcggaggccgcggggtggggtggggatctggttacggagggggcaggaaatctgtcgcgttcactgaacgcaaacggtgtgggtcaagggctgtttgggggtcagagttagagaccaggatgactagacgagtcatagcccaccgagctcacaatcttaaaatgtatctcctgtaatgctgggagtggggtacgagcttcctgctgtgggagggagggggacaggaagcctcgtaaggtctcaccaggtggcaagcacactggattagaagatgcaggaaagcaccttccagtctgaagatcatttaaagactcagtcatgtaagggcatcccttggcttcttaatctacgtactccagacccagggcttggacctttgctggtacgggttaaagtgaggccgacagtgaaggtccacgtggagagagacattgggaagttgtcaaaaaggcgtttagaatcaggtttgactcattaatttcctgagactctgaaggagttcagcctctacacctcagtttcccctgggaaaactgggagtaacattttcctcatgatggttgaaaggattcatgcttacgtggatgtggcacactcagtaagtgtctaatctctggcgaaatacccagaagaaaagcctgtgactgaatatattatttttgagcacaattacttagtccacaattgagcataagggccttgatccattgtcttcctactgtccccaaacgcctacagctaatcgtgaggaatcaggctctctgaataaccacgtgtctcctggaaaccagttccccaagggatctggtttaatattgacaaagtaactgataatgtaactttccaactctctgcttggagcagatgctttttggtcatctgagattgggacctgtagacaaaggcaggcaaggaggggctgagttaagcctttggtgttccgctgtaagtagaatactacctaccagaggaacattccagcccttgacttgctctgcctgctggtgagattaggattggagccagggtcagtagcccccagttggccgtcttgagggtgtggccactccctaggtcacagaggagatggaggtcaggactcccctgctgcagcgttgttagcaaataatttgccctttggtggcctgaggtgctgtgggggcaggagtgggctgtcttgtggggaagggaaatgtaacgtatcaccaaatctgtgggggagtggggctctgtggggaagatgactcaacctttcaattattctgcttttgagagaattatcttcgctgggtgagtggggaaactacattgtggttcttgcaggcttaaaaagtcccttctcccctttcagtgagtcagataatgaagcatgcatttcccctaattaaaaatgcctcaactacggagcttgcagtgagccgagatcgcgccactgcactccagcctgggcgacagagcgagactccttctcaaaaaaaaaaaaaaaaaaagccacaactaattaaaaaatgattggtccgggtcacctggttctctgtactgccttaagagcttaagtgtagactggcagagcccggtgcccagctaatgccgtctgtgcagcttcattcctggcccttttgtagcgggcacagccgcctctcctgggacttgattaatgatgacttaaagaaggttcttgaactcatttctcagttactgacttgagccaaaatgtatggatgttggtctcctgtctagcacaactgctttcattttaagcattgcattagaaataatgttgtattcatattttagcaaagagcatcattagctctttaagaaccgtacccccagtgacttagcaaatttggtggcggtgactctaaacagctagcactttatgggagttgcttctgtgccttgaatgttgtgacactgatgtggggtcacaggaaaaaccattttatttcctaaagctgtttatttcttaatattgaggcaatggaagaaatgaggaaacggccgtgggcaggaaggtagaagaaaatgcagcacttacattacaaactcactttacttgggttttagtttattttgcttcagttttttgttttttttttttttttttttttttttttttgagatagttttgctcttgttgcccagtctggagtgcaatggtgtgatctcggctcactgcaacctccacctcctgggttcaagcaattctcctgcctcagcctcccgaagtagctggaattacaggcacttgcaccacgcccagctaatatttttgtatttttagtagagatggggtttcaccatgttggccaggctggtcttgaactcctgacttaggtgatccaccggcctcggcctcccaaagtgccgggattacgggcgtgagccactgcacctggcctgcttcagcttttatgaaggcaagtcaggatgtgttatcttggccaagagctaagactgagaccggagtagaggaaaatgactcatttgacattacccttctttctgaatcactccaaaagtccacagtcaaatctcaattagctggtataacacaagaatgcgttgaccctgtgagcagagttttattgcatcttcaagggtcttcgtgagattggtttatttggtatgaggtcttaaggattttaagttgtccctttaagcatcagttctgatacagatgggaatagagctaaacaaccagatatatgaagaccatttttgataccaccatacttgcggggagcttgcatttttttaccaaggggcagactggataattgagtaatttaaatacttgggactttgttaaagaagctgttgggggaaggtgagcctgggtgagtggtggagggtgatgtgcagcatctgctgggccttcctgcctcttggtatgactgctcagctcaggagttgggtgctttagggcccctaccatgcagtgcggtgaagccccgcccctgcagtggtttgtgcttgtctgcacgtaggagggaacaagccggctgcagtaccttcggtggcctctgagactcacctcccccacttctgtccatagacaaagctcctggggagccctaagcctctttcctcatgccagcaagcagtcttggaagcaggctggggctgcagtgggagagatgccaagaccagttattcaagggcagtgaggttgccagtcctagcatttcacactgtggaccagcacagctgctggctgaatactgcagtcaagattctctgaagggagtcctatcccttccaaacatcttcagtttacttgcagataatgtttcttcattttttattttattttattttattttatttttttgagacggagtctcgcaccatgacccaggctggagtgcagtggtgcaatctcagctcactgcaagctccgcctcccgggttcatgcc

SEQ ID NO: 80446 - DNA, 1090 bp, Homo sapiens
gcctccccagccatgtggaactgtaagtccattaaaccctttttcctgtataaattaccaagtcttgggtatgtctttatcagtagtgtgaaaatggactaatacactatattagactgacagagtaggccttgcttgaatgacgggtctctgagggccctatagatatgtgagtatgtataatgggatgttgggggaaatgtgtgcaaatgttccacttactgtagttactccagcatttgaccaactgtcttgtatgttttcttctacgctattctgctctggttttctgttttttctttctcacactatctttagcctaatggcattgagtgccctctggaagtgagggttggtgtaaatagcgttcatatatctagttccagtgacttggctataaagttcaggttgaaataggggacagtgaaaaaggaggtgatatactccatctgtttgtttagtcttgtttagggacttctgataagtgcatactctggacacagaacatctagggattattctagccaccatgatctcaggttctgggctcaggaaatggacaatcattggatcagtgtggaaaggatagtgtacaacaggattgagttgggacaagatttgggttatatcataagggccatctctaagacctgccagagaaatcagattgttctttattatcttttatgtgcctcctctggagtataacctgaatgggaattttactttttgtcactgacatacccagtttgagagaaggtcatgatgtttgggtggagagctgaacctagttaaggctaatggggaaggtgaaaacaggggttatgagtacctgtcctgtaaaaggaagaaatgggcaattcaagccttgaggctcttggtgtcctgagttttgttcaggccctacctaaatctgtcacgagacttgagtgtaaatgcatgatgaattgacagcctgagcagtgaagaatgtcagttcaacagctatcagtctatttctacaccatggctatgagaaaaccaagaactgatcagagtggagttaatagtaatagaaagttccagggtagagtggtgagagtgcttatga

SEQ ID NO: 80447 - DNA, 1176 bp, Homo sapiens
tcgagaccagcctgaccaacatggagaaaccccatttctactaaaaatacaaaatcagctgggcatggtggcccatgcctgtagtcccagctactcgggaggctgaggcaggagaatcgcttgaacccgggaggcggaggttgccgtgagctgagattgctccattacactccagcctgggcaacaagagcgaaactccgtctcaaaaaaaaaaaattacatgtattgtgtacaacatgatgttttgaaatatgtgtacattgcagaatggttcagtagagctaataagcatatgcattatctcgcgtatgtattttttgtggcgagaacacttaaaatctaccacagtgattttgaagaatattacacattgttactaactatagtcaccaccaataggtttttgtgtcctttgcatgtagaaattaacactgttaatttcaactaagttttctttgcatccagagacgtctgtctcctcctgctatccccttgccctgtctctgggcctccttgatgatatagaatgtccagagccttgaggcactattgctgtgctcttctcctagccaagattttgactgtccctgctgccatccattcctgatctcaatttctattgttttcctgacatagctttccctttttagtttgcctccctcttcctagtcagccttcagtacttcctcagtgcaacagctttctccctcttagcctgaggaataaccaggcatagaccatctgaggtggcatcacaggtacatagatgaggcacaaaaaacaaagacaacagcaaactgtatccacatgggagatagtgctctcttgctgagccctcagtgttttatgtctgttctcttctatcttctgtgttcagcctgtatagagcttagtctgtccttgactcctaaggaagttcattctagtttcttctgtttctttttccagcctagacagtaactttctctccgtttctccccattcctgagagctttcatgttttctcttaagctaaggaaggatggcttctgagcccaggtctgaatctgagtctaaatcccaggtataagttgtcaccattctaattcagacctcttgctgttttttcttttctttttttgtaggtgacctctgtgctcttccttttgttctaccctttttactccctacttgtag

SEQ ID NO: 80448 - DNA, 1042 bp, Homo sapiens
tttgtgtctcaatctttacctttgctgttaattcctttacaagttgttcatatttaatgttttgccataattcttagggagttaagaagtgaaggaaagacctctgcccagggttgggagggtgaggaggaggggggcttgaaggtaaggaactagacacaggggcctacatcttctatccttctaggggtggggcagccacatggagcggtgaccatcctttgactcaaggctgtccctcaccagacttccccacccctcgtctgcaatctctgcatgaatagacattcatttgtactcatttacaggtgggcctcttctcagcaaatcctgtatatcacagttgagatttacacataagatacacctaggaggaatgatttacttgtcaggaggacgctttgcattatttaaagatttaccacaggattccttagcctaatcttcttgggacattgattttatttattttttgatttataatcaactttttagggctgtaggaattgcataaaatgagggagacccacctgcatgttgttttgtaagcatcttcagtcattttcatatttatttatgagtcttcccagcctgactagggctccttgagggtgggaaccctatctcctttttcctctgtgtggcctttggtgcctaccttgccctggaccctaatagtcactctgtgaaaagcagaaagcaggtaggctcccacctctccaaggagataacgttatggccattgtcttacagggctcatatttggaaatcaagaaacagatggacaagttggatcccctggcccatcctctcctgcagtggtatggatagaatggctcatccttcttgggttatggggagggagggagttattggacatggaacctgtaccttcttttagtggtggtttcaacatccttcccaaggttataggcagtaatgggtgctttttcttggagtttgttggcataccttgccttgaaaataacacatcctacaaaacgcccacaaattctgacatgatttttctttcaaaaaaatt

SEQ ID NO: 80449 - DNA, 1004 bp, Homo sapiens
gggtgcttttgtaaaagtcaagacaagagatgctaaaggccagagctaaagtgtgattataggtgagaatggagatgagagacagattagaaagatttgtgagatataaaatcaataagacttgaagactgatttagatatattgaatatagccataagggccaaagagtagtggaaaatacatttaggtttccagcctagatgtctgggtaaattgtgataccaccaatgtaaatagggatatgagaggggagcaggtttgtaggatgatgataggtaattagttccatttttgacatgttatttaaaggtaactttcagatatgcaggtagagatgcttatccgaaatgtcaatttgctacttaccagagtatatgtcaatttgctacttaaaggagaggttagggttgaagatatgcatcaatgtgtgtgggaagaagttacagtcagtgaatatgagattgccaaaggaaggcatgatagtgggaaaagaagataggatcaaggacaaaatacccttaaacactcagatgaaatcccaaagaaaccagcagggtaggcagaggaagaagaaacactgcaggtaggtcagagtagaataggaagataatggtggcacagaagacaaaggagggcaggttctgcaaggagggccagatgccagagaagataagagaagaacctgggagtttccatcggatttagcatcaggatgagaacaattatagtggtgaaggtaggaaccagaatacagaaagtttggaggtgagtggttggcaacaacatagaaacaatgagtatgggttgagaaatttgtatggggatgggaaggcaacagggagaggttaactagactaaggtgcagaaagttgacatcttttgttgactttgggaaaggaactgacaggaaaggggaatgattgacacatcatggtccctaaaaaggcaatcaaaggattgatcttaggtagaagggtcaccttacctccagagaatggaggga

SEQ ID NO: 80450 - DNA, 1113 bp, Homo sapiens
ccatcactacccagggcacagtcctgagcagaagtacccagactctcagaatgctcttcacttagaaccaatcttaggaaacctgtaactcttcagcctgttctgagttgtcatagaaggtatcctggtcaaggtctgagagaaaagctggagatttaaggaagtgaactccaagcaaaagcctacatttggtctgctgaacctttttaaagtcatgatgagatggagacctctgttaatgaaatcccttgctagggtcaccactgagaaccccttcacataagtggcttttacttcccctatactgctgtctgatttctcctgttcctggtgtcttttcatattctttttattatctctctctttccctcgtctttttccacctctctccaccaccatttttgctgctatctcaggggagctgtgcagctgacctgtatcgacacccacagcttgatgcagacattgaagccgtgaaggagatctacagtgagaactctgtatccatcaggtgggactctacttcaggggtggcaggggagcaagtcacttctttctgagttgttaaaaggctagaggtttttctttttatggtatgatagtgggataaattatgaacttaatgatagaaaatgctcagaataaatgagcttggctgagagtagagagtaaggccacttttcttaggaattccctcttatcctagacccctctgggccagtagtttcacctttcaggtaagaaatgcttttggcctggaagtagatcctgatcaggtaagtggtgtaaggctatagctaagaccctaggtacaaaactgtcatccactcttccctttcccctgtccccaggctcagttctctttccaactcagtttctattcccttctttctcccttaatgagtctcacctgttgtcacctgtatctctatagagaatatggaactatcgatgacgtggacattgacctccacatcaacatcagcttcctcgatgtaagtggggctagtacctgccaacaacatgtctagctggacttgtggaatttgtcatgtaggccaggagtcttgttcccgagtgctgtatttggagcacatattcttcatctctgtc

SEQ ID NO: 80451 - DNA, 1145 bp, Homo sapiens
tggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggtgaagttttgctttttaaaatcatttttttgtgtgatttttgtctatgtgtagaaacatgcaggttattgtatatatctcccatttgacttaagtatccagcagagggttcattcatttattctctcattcaagaaatgtgttaagggactaagaatgtagactgaaagcagtcaaagcctctgccaccagaggttacattctgataaacattttatatgttagaacatggtaagtggaaaaaaataaagctgggaagggagatagagagtgctagtgtgtgggtgttgagttgtttctgttttaataaataggatggtcaaggtggcctttgagcagagatctggaagagtgaaggaacaagccatgtggatatctgggtggaaagcattccaagaaaggggaacagcagggacaaaggctctatggcgggaatatgcttgggaatatggtgggaagatgaaggccctatagtgggaatatgcttgatgagtttgaagaacagtaatgaggcaattgtggagtgttggttaatcttcctgttaacatttagacttgactttgaggacagcccattagagtagcttctgattttttttttaaactttttattttgaaacttttcaactttacacaaaagtagggaggtagggattaccagaaaaccatcatgtacgtcacatagcttcaccagtaatcaacattttgctatttgctgtatttatttcatctgttatcctccctcctttttttatgtgtgtgccagggtagtattttaaacaaatctcagtaatcgggtcattccatctctaagaactttagttatactttccgtttgcatgttgtttctgaaggatcaggcaacactatgagctggaagactcctatgctggctctgctctggcatggtgtcttttgtccccatcctggcttagttaccagacttaagttggtatctaaggaatgaacc

SEQ ID NO: 80452 - DNA, 1242 bp, Homo sapiens
agaggtcccctaaggagattggtcaggttatagactgagacccaaggacaggatttcgcatccatgttcatggacaggacagcacctaagtcccccagtgccaccatatttacagcattttagagtcaggaacagagggctaagtagaccaagagcattggctgcctttcagacatccatctatattctaaagggattgagttatttggggttagggtacagagatgggcaggatataaatagatgtcgccaacgtttctggatctccaagacctgtatcagaatcacctgaggcacctgttcagcttgcagattcttgccaatactttgccccaccccaggtgagaatctctggaattgagattcccaggtgcatttggtgtacagtgacagtttgagagtcaccgaaatggggaaggagagactgttgactggtgtgaaaagtgttgctggggccccttctgaggggcttatcttgccatttcttcatgtcctcttgcaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaagtgtgaatggcgttagggtaagggcacagccaggctggagtcagtgtctgcccctgaggtcttttaagttgagggctgggaatgaaacctatagcctttgtgctgttctgccttgcctgtgagctatgtcactcccctcccactcctgaccatattccagacacctgccctaatcctcagcctgctcacttcacttctgcattatatctccaaggcgttggtatatggaaaaagatgtaggggcttggaggtgttctggacagtggggagggctccagacccaacctggtcacagaagagcctctcccccatgcatactcatccacctccctcccctagagctattctcctttgggtttcttgctgcttcaattttatacaaccattatttaaatattattaaacacatattgttctctaggcactgtggtagtgggtttttttgttgtttttgtt

SEQ ID NO: 80453 - DNA, 2269 bp, Homo sapiens
tttttcttcctaaatcatagatgagggtcttctgggtctgtgggaccaaggttaccttctcctttattgttgatcagtaagatcccagtctcctgtcacatgcaaggactcttcaggaaccttgtcccgtccccagaaacatctggagacttttggacatggcagctcctgggtcccactgcttgcctccctcagctcacagctggtattactagctctgtgtggacagggaggctgcagagggacggggaggagagctgcagggaggcctcttagggccctggattccttggcctctgtcctgaggtgtgagctcaatggtcaggagtcacagagacatactttgctgctggggaacagagggagcacatacctgttgtcccatgttgcctgtgtatgaataaggcccaggaatctcctcagctttgtgtccttactgccatttgaccttttataacagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacatagtggaacccctggcatttgaaggtgaaagcagagagctctccttgctaaccaaaggaggctgggttggggcacaggatgggaggcaggaaggtctgggccagacatttccagttagtaaatgaaacaacttagctggggtgagggccacattgggaaggtggttgagagggaccctggagttaccccaccatcaccagactgttgttgcttgttttccctcaggtacccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttctttcaggcctgagagagagcaggccgtgcaacgagccttctgaagatttgtgtgcaatattcactctccacatgacttccgtctatatccctccagctgccctttggtatgtgggatagggattgttaaccttacttcccagagagataatgaggcctggagaacataggtgagttgctcaagacccagcacaagcatccatgattcctgtaataaggcttccctctgctgttttcactgcagccttaccaagtatggttgggtgtgcaaagtttacattttaaggacctctgctgctgccactgtcattgtggttaatgatggctttaaggtttattcttattcccatatctttgagagaggaagagagtgggattgctacccacattttaatgaaggtggagctgagccgtagaactctctgggagccatccaacctggctgtggctcataacaaggtattgatcacttcctttggcctgagtgagtccagggtgcctagacaagaggtagcagcctgtggatgtccagcacctttgcagggaatacagggcccaatctggcacatgccccttttcctccaggcccagagcaggggctgttgccgaaaggctgtggagcaacaagttgacatctgacctgacatttgcctatgaacgtttgtcacacttccgctgtgaattgctgaggtaagcaagctgtggggccttcgcaaggcggagcaggccagatccagggctggggaaccccttagagagaggaagacaataattaacaatagctaacacttacagaggcttatagtcagccctcatccacggattcaaccaactgcgataaaaagtattcaggaaaaaaaaaatacaacaaaaaatggtacaaataaaaaatactgtataacaactatttacatagcatttatattgtattaggtataagtaatctaagatcatttcaagtatatgggaagttgtacattggttatatgcaaatactatgtcatttttatataagggacttgagcatccttggattttggtatccacgggggtcctgaaacaaatcccctgtggatactgagggacaactgtattttgtggcaaacactgtgctaagtttgttacaaatattgtctcatttagtcttcaccacagccccatgagacaggtgcattttagagatagacactgaagcacagagttcaggaccttgcccaaagtcactaagaagcag

SEQ ID NO: 80454 - DNA, 1130 bp, Homo sapiens
aaaaaaaaaaaaaagcctttcctggggaagttcctaactctcttgagtttaatgtgcagtcttatctgacagttcccaatccagttcctgtgtctgccttttcctttgctcctgtgacggaaccaaaggaggccacacatctgccagcctttgcttctgagattatgagttaagaggctactaagttcccaggaggtctcacagttgggcttaacatcagtcagacaaccgaacacaaatggcaagaggaagtattgatcttcaggcttttggaagattccaggctaccacagtagctgcagccctcctcttaatgtggccagaatttatttcaagaagaggaaagaccacttctatcatccatctttggatgtgttctgggaaaagtagaagtgtgctgggccttccctccatgccatccctccctgatgggaaggtttgatagaccccataaatacttaattgagagctgaggcaggtcaagcctgtaggggtgtgtggagcggcctgagagctcgcccaacatcgcaagtttgaggctgaaaccggagagactgtgatgggttcacagtgtgcactttaacctacaggatgtcatggcgtacaataaattgaacgtgttccactggcatctggtagatgatccttccttcccatatgagagcttcacttttccagagctcatgagaaaggtatgttcccgtttcactcagaccaagtttatgggtcaatgtctgaatctggctgtggccctgctggcaagaacagggtctctcatcctaaccagccagttttagaccaatataggggaaggacactggatttggagtcaggagacttgagttcaagtccaaaactttgccgataatttgccttgtgaccttcaggagagaatctcttctggccttattccctttttatgtatttatattctgttaaatggacatagtattaatacctaccatgattatctcactggcattatgatactcagataaaacagatgtgataacttctgggaaattatgatcaagttttttgaagatagtccctgacaccaaagggctatgggcaggttttctgatatctggggagtcttgtgggcattttgagtatcttctactctgcta

SEQ ID NO: 80455 - DNA, 1520 bp, Homo sapiens
tagagaggggttcattaagttaaggcttggggctataacaccagagccaccctgaaaatcacagggaagaaccagcaggagggtgagaagagacagtgtattcatattttggctttggcattttttctgcatagacaagggtctgtaaagctatattagatactatgttggttcaaccctccactattagggtaaaatctaccttggatagagaacctgtttgggaagaggaaggaaggaagcaagatgggtgggtgaccctgatcttctctgaggtatcagttgcatcatctcaggcctcctctgcctgatccttctgtcatctgctccattagctcctaggcttttgcaaaactggaaacccttcatctggagccctcaagagcagtactacttaatatgccaatcttcaatgagataagaagcatatgtaccagaatgtaagactgatctcttcatcaagaaaatcttgtatgaaaaaatgttagaactagacagtgtgtttactctgacataattgatttacattcaggcttcatataagttttctatatagtgaccagccagtaacacagtttgcaaattggcagctaatctgcagaccatacttggagtagcagtgctctagagctgcctttcattcagaagcagttgttgaggtcatggagttgtttgtttggtacaggccaagggcagtcagaaatatagagccctggttaagaagagctgtcacccagagcattcagacatgggtcagggcagctactgaggagaagaggggcacaacgagagtgagacagctgaacagatgatcaggcactgcctatgccaagggtaaatgccatgtcctccctttcctttaccacaggcgtgtgagctgagggactagagctagggtcttggttttgcctgttgcttctaatggcaggttggccgcaccaagcttaccctgtcttcctagggaaacggcatacactggagaagaatgtgttggttgtctctgtagtcacacctggatgtaaccagcttcctactttggagtcagtggagaattgtaagtaccatcctgttccctgtcttagaagagcaaacacttgtctgaagctgtaactctggatggcctggcctaaactgctgatgctcggcctggagtcccccttgaccctggggaccgagggtcaccaagtgctgagagccatggaagatgagtttttcctatgcagaaacttaaccagtgctaaaggttggctgtggaacatcacactggctcttcactgagtcccacaggacttctacctggtgtactgaatacatttctattttaggaaagtgtatactttgctacttttctctaatagaccctacactggggaaagcaggggttctggtcacttatactgagatgaagttaagtcattagtccagtgactgcctcctgtcttccctgagcagcatttggggacttctcagtctccaaagtgaacagttgagtttggctccttcctcacattcttggagga

SEQ ID NO: 80456 - DNA, 1016 bp, Homo sapiens
ctaccactttataaccgaaaccaatgtgttttttttccatagtgctgggattctgtgaatcaaacacattgatacgatggaagtgttttgattcaggagggaacgggtggtagagggaaaggctattgtgcactgaggtaaagattgatagtttccaggttaccctaatagttattagtgaccctaatacagcaacgagttcttcctctcagagaagtggaaagacctaaatcttagaatttatggatccagaggtcttcagagcagtgtctgaaaaggcactttgtgtaagtctgggcgtcttcttagcatcgcccaccccagtctcaggatttcagaaatactaggtttggggatataaaagtaatctctacattaactacttgctatttatgcctgattatcacatagcacaatcataaaatatgcattttttgaattccaacatcattcattttttcagcaaacatgtactgaatgactgctgtgtgtcaggcactgggaatacaaagacactgagattggtccctcctgttgaggaactcacaacctaggtgaggagatagacaaataaacagcatatcttaagaaaagtgttttgaaaaatgtatgtatacattgctgcatgatcacataggagggtttcttaggaaagagggggggaataacagaaaagtttcctaaaaggaaaatagagctgtttcttaattaggggagatgtggcgggaaggcaaagtttgtttcaattggaggaagcaatatgtgcaaagaaaaatatggagaaaatatggcattttcagggttctgttaagagttcattgttcattgtgagagttcctgcacaggagcagaaaaagacaaggcattttcttatgattacccagtgaattctggactgtattctgaaagctatgggagccattggaagattttaagcggagactgtcatgctcttatcttcatattctaatatctctgaggatagtagattgacatgggtattcctggaggcaggg

SEQ ID NO: 80457 - DNA, 2050 bp, Homo sapiens
cctaaaataccttctttggccatttcttctgtatctggaacgttgtagatatgtagtaattatttgtaaaatatattaacgttaaagagctactttgtgtaaacatttgtaagaaggctttatgggtttgggttttgttttcttttttttttttttttttttttcttttagagacagggtcttattttgtcacccagtctggagtgcagtggcacaaacacagcccactgcagcctcgacctccgaggctcaagctgtcctcccatctcagcctcttgagtagctgggactacaggtgcatagctaatttttgtagagatggagtaccaccatgttgccccagctggtctcgaacccctgggctcaaccactctgcctgcttcagccacccaaagtgttgggattacaggtctgagaagatcatcaaaaagatatgatttgcaggttttcattgaggattacctttcctttcaggttaccaatttggagtgtaagtgtgtgattccaggcaaaggataatcacactatgctgcttattgtgtgatcccaactcgtgctgctcttaactcagcatgcagtgagagatgcattgggattgcatctaggagggaaacagataaggtcaagcagctgggctggggagaaagaataaggccgattagttctctccactttaattgggctagcggctaactatactttaacctttcccacggcaaagacaaggcatattcctgccaaagatgattgccactaagtttattgttttaaaagcaaagaggaagaaaacaacacgggaagaaggttttgtagtagaattactttttctcatgaaggggtttctggagaacgagggatacataggagaaatacagtgatgaataaattgtctttagaaagaaggtgatggcagaagcacagtttttagttgaagggcaaaataagtgtcatatttcattttgaatcccagggcctagattagcttggcctgcagtcttccaccagcctctcttctcacagccctgtttttttcttttcttttctttctttttttttttaagaaacaggtctttctctgtcattcagactggagtgcagtggtgtgatcacggcttacagcaacctcgaactccaggactcaagcagtcttcccgcctcactgatgagtagctaggactacagacgcatgccaccgcacccagctaatttttttattttttgcattttgtagagatgggggtcttactgtgttgcccaggctggtcttgaacccctggcttcaagcgatcctcttgtctcggcctccccgagtgctgagattacaggtgtgagccaccatttattacctaaagcatgatacttttctagtatccctgtatagtactgagtccaagaagctaaacttgatcaaggtgtatgtgggtagcctgggcctggtttatgaaaaatttgagttttatttctgtgagctgtaggtgttcccctgctttggatattctgtttgaacacagtatacattggaggactcaggatgtggaacatgattcattcaggagtcagctgagaaagtgtttattaaccccttaactctgtgccttcagactaattgcctaatttccaagctgttgctgctacttccttttttttttttttttttttaactctgcctgccttccagacatttccgaggataacaagaaaatagttatgaatgttttttcagtctttaagggagggtataatagtgggaagaacttggtgattttaaaaataaaacaataaaaattaaaagtccaagccccagagatgcctttccttccatttccttctaccccagttccttacctccaaacaggagcgagaagcatagcattggaaggtttttgacaatggataccttgtcgttttgttgttgtttgtttttaaccgtctcatgctagggcatgttgtctgtttcttagcctgttcaaggcataagcctcaatccctttcctgttgttatatagagggaaaggagttttacagccttaccagtacttcttttaagaaa

SEQ ID NO: 80458 - DNA, 1484 bp, Homo sapiens
gacttgtggttttaatcctccgtttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgaacagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacaggtgagtcggacttgtcccgccctgttcctgggccctgagagtgcctgcctggggacagttcccccagggctccagagacgccctatgggcttttgtccagccctctgatcacaggcactccacttcctcctcgagctgcattaggttttcatccaaagataactactataggactacggttcaatcaggagattaatttatggaaaatactgtgccagcagaaatctaaggtgatccttctgaccgtgttcaagctagccagggtcctagtgagactgtgagcaagggctgagtagagaccagagaaaacactcaaaattggggagacataatacaagaactatgcaaagttacatacaagtttctggcacatagaatgtttggcgggcggatcacgaggtcaggagttcgagaccagcccggccaacatagtgaaaccccgtctctaccaaaaacacaaaaaattagccaggcgtggcggcgcgcgcctgtagtcccagctactcgggatgctgaggcaggagaatcggttgaacccatgaggtggaggttgtggtgagctgagatcgcgccactgcactccagcctgggcaacagagcaagactccctctcagaaaaacaacccccccccccaaacaaaacaaaacaaaacaaaaaaagtgtaaattgtgaaagaaatcatagaacataaggaagtgagtttccagcggccacttggaatgggatggtagatgtaattag

SEQ ID NO: 80459 - DNA, 1046 bp, Homo sapiens
taatatttgatggtttttcttttttttctagttgtcaaatgatcctttattgaaatattttcctttgtgcttaactagctgggcattccacagcaccactgttgatgtcatctatgatgtcatgagggtgctggccatcaacattacagcccacagactgggcagtccccaggatctctttaatggttccagagagttctctggctaaggatcagtgccgcatctgttgagcaatgttgacgatctcatcaaaagtgatattcccactgtgtttaatgtttttctgtttctttctctctcggtggttctttgagggctttgatgatcagagcagaggcagaaggcaccacctcaatctgggcctgtctgttctgagtggttagtttcactgtaatcctcaggcccttccagtcacccgttgccttggcaatgtcatcaccaaccttttttggagacagacccagggggccgatcttgggggccagggcagaagtggcaccgacttcacctccagtgcacctcaggtatacaactttgatctcgttggggtcaaactttggcggcatggtggaggcagctggtgtcgaatgaacccggattcgggatgaccgaagaaagttgcaccttggcctcctccgagccaaaagctgagagctattttttctttattaaaggcagcttgttaaatgaataaaaacatgatttaattttcatatctatagcttctaataaaattaatttacatatcagaaaaataattcactgtcagacaatgtgttcaggtttttggctcataaattaagggatcagaaagaagcaggaaataaataatttgcctcaggaagtcttttacaatggaggtgaactttgaattgactcccaaagcatgagttagccaggcagggaaggggagcataggcaaagcacagagatgtgaaagagatgacatattgaacaaagggtttatggggctagcaaaagaaaatgtgccacgattacctcacttcctggtcctctaccatactctcttctctctgcaatgcctt

SEQ ID NO: 80460 - DNA, 1802 bp, Homo sapiens
ggagcggattcaggcggcacgcgcggtcccgagggacaggcctgggcctggtgcgcagcctagcccggtgcctcccggccttgtcttctccgctgcctctgctggggatagagggtgtcgaaagcagaggttcgccgattagccgggtgtggggaggtgcgctgggggcggtgcttcccaagtcctgctatggcggaggccttcggtcgcctaagccttctcttgcgggcaatttctgccagtccctgggccgggtgtcctttctctggccgggcgatcgcctactggggcggggcggaggaggtggggtggagaagaggagtcaggaagaattgggccctgacgggacttaccccggccgtagcctcatttgagcacttttggaagggattagagtaggcctaagagcagcttggtgtacagttgccccaagtgggcaccagttaataaagaaatggatcttggcagtctcaagtgcctacttaaaggtgggggaagggaagtatttctcggaagaggtgctgatgggccttcttttcagatggtgaggcttctgcttacatcttttttatgtctttgctgtttgggacctaattgctactttttctagtcgtagcagatgacttgcttgaagctgttggaatagttactgcatattgcatacccttccttgtagctaaaacaacaacaaaacgcagtgttgtctaatattggacaagactctattgtgagttagaaagcagaggttttctgcttgtgaactcctttctctgatattttctattttgtggtaagttaggcttggtgtaagttgataaccacatctcatttaaccatgtgcgtcagattttgcatttttgagctttagaaactcaaaagttttcatttggggaaaaaaaaaacctcagttctcctgaggagtcagggatatggctgaagaataaaaatgaagcttgattcagtgcaatttttagaaaacctggaaggaaacatatatgagcagcaagttactattgcctcttttatcagtattatttcttttttgtttaacttaaattggttggctaaatattcattgacaaattagaagtatgtcactgtcaactcgttgactttctattattaactgatttttatagtattataagtaacagttttaaaaattgaagcatctattcaggcactgtttcaatacagtgttttgcataatagaaaaatctctgatatctagtgccattactaaatagtggaagtcttcatttttaatctagagaacacagtctaagaaggaagttgaggattgtagaagataattttttgtttgtttgagacggagtcttgctttgtcgcccaggctggagtgcaatggcgcaatctctgctcactgcaacctccgcctgccgggttcatgcaattctcctgcctcggcctcccaagtagctggtactacaggcgcgctccaccatgctcagctaattttttgtatttttagtagagacgggtttcaccatgctggccaggctggtttcgaactcctgaccttgtgatccgcctgcctcggcctcccaaagcgctggattacaggcgtcagccaccgtgcccggcctgtagaagatgcacatgtaagaaaaatctgattaggtaagaaaaaataaaaagacaaaacaagcctgccacccagagacgtacaacaaaatgcgaactgtagttatttttctagacctttggatagccattaatatggttccacgttaataacagtggaaccatactgtatgttctgtttgtgttttcagtggaaa

SEQ ID NO: 80461 - DNA, 1277 bp, Homo sapiens
acttcaaatgtgagaaaatatgtttactttttaacctgttcaccacttcacctcttatgaaggggaaaacttagggagtgggcctcaaattacttgtcatttaatttggaaatgttcctttgaaatttggaaacgtatgtacataattttagtcactgatttgttacagaatttttaaatgtagtaattacatttcattggccctaaaaatgttgtctgtttttaataatcatctctaattgtattgcattaatataatagctgggtccttaggatatatgataatgtatgaagcttgattataatgttgcattccacccagctataaagccaaagtggtgaaaataggacttttaaatatacagaagtattctagtcacccttaggaatgaaagtataacattaagcaatatttgaagatttaaggatggcagtaagcttgcctaatctttgattcataccactgtcaacacagtttttgattcatgtagagtcaaattaacaaggttggaaggatcctaatggttatcctagccaaccacatatcaagtactacctccctggtaagtggtcctgtagactattcttaaatgtctactctggctaaaccttcacagccacttccagaagacctctgatttagagttctttcatactctgattttgtcttcctgtagctttttacctgaacctacctggttctaacccttctcatgatagcgattctataattttaaagacttatttaacatattggagactagcagtgcaataacctaatccagactaacactttttggggggggaggtcagaacccagaataaagctgctgcttattctgggtttacttcttatggattgttgattagaaagattattctgcactggtattttggattgaggcctgtgcatgtctgttcaggcaaagtttacataaggtagaacactacagcagcacatgtgcaccctgctcaattaaataaatatcaggcagatctgtttgttcataccctcattgcagatactgaagggttggtgggttttgcagtaacgaatgaataattcatcttgatattactatattaatagttttgggttctgtatatttcctccgactcagaatttacaaaaataaaagcactttctagacagttaactagttagctctgagtagaatgttttctactacctttttaaagattctagatcattttgagcaaagaatattgaaattgcattgcaaacttatctttgtgaatcaggtttttcttcattc

SEQ ID NO: 80462 - DNA, 1069 bp, Homo sapiens
gatttaaaaaaaacatatatatctgcctttatacctcaactacgtggttccctccctcacagtattattgatgtcttagtacttttctcataaatgcagaacccttccctaacctgatttttatatttcttataagatcctaaataatcgtgttatagtttatgaatttctgaggttagtgggtccctaaatataatgcttcagtttaattgggaaccatttgtaaattgagtacttgatttatttttatcagctgagatttctttagctgccacactgctgggggaatacagataatggacaactctttaagaaataatgtataaataaattataatgcgacgctttgtttcatagtagaagcataaggtcgagaaggaatatttaatgctcttctctgggaggaccgacttgctggtaggaatggaagctgaattttgaaaaatgaatggtagcttactaggcagatggggttagaggtggcattccagacaaaggaggaagaggaatggaagaagttgtggtatgttgaatgaacaataaggaattgaatattgctgaaattactgggaagtagagtggtaggagctggggctagacaggcagtgtgatcagattatgaaagcttttagcgtagtgctgttgagatggacttaattcactaggactacgtgaaacaactttaaacttttaaattaataaggaattagagtttaaaaggccactctgttggtactataggaaataaatgagaacaggacgggattaggaaactgggagagtagtgagtaatccattagaataacctgtgaaagaaatgggttagcaaggctggaatggaggagggaaggcattcaagataccgtgagaaatgatgaattattaggaaaaaaaaaaaaaacttagtgattaagtctttggtgtcatttagaaccacattcagttccagctttgccttttaccagctctgtgacttcgtatgtaaatttgattttaataaattctgtttcatcatctgtgagtattgtaattgtgtagttgaagctttaagcaactttcatttaactaa

SEQ ID NO: 80463 - DNA, 3058 bp, Homo sapiens
ttgacacaactgtcacaattctgtgaatataatcaaaaccactgaactacttttgagagttaatttcatggtatatctcaagttgtcacagaaaaaaagtctaattcagtattccccatttgtccaatacgtcttttatagcttttcttcttttggtcaaggatcatggattgcatttggttatcatgtctctttatttgtccatgttcttgatgggttaaaataataaagaatatacaaatggttagatctcctataaacaaaagaatatacaaatggttagatctcctataaacaaaagtttcctgaaacttccttaaacatgtagcatggatctagtttattttagttgcatgcaaaataaaacaattgattaaattaaaattgttctttcatggctgtaagctcttggtgaagacaggtcagacaggtatttgggttaatgtcaggcaaaaatttctgtatcaaaacacaatatttatactggcttgagctagaatgttgagacattgttttaaggtttgtttttttaaaatagcttttagaagcttattgaggtgtaactatatatgctatataaactatgatatacaaatatatatactatacaaaaatatatcttacaatttttttcctcaagagatactgtttttctgtcacccaagctggagtgcagtggtgtaatcacagctcaccgcagccttcaactcctgggctcgagcaatccttccgcctcagcctcctgagcagctgggactacaggcacacaccaccacacctaattaaaaaaaatttttttttggagatggggtctgttgcccaggctagtctcaaactcctggcttcaggcagtcctcccacttcagcctaccaaagtgttgggattacaagcttgagccactgtgcctggccatagttttgtatataaatgtcttactattatagtttggtaatcgacctaaataatactgttacatattgttttaagcccccaaagttgtcttacctagatgtggtgctagcaaacgtttttataaaggcaggaatgtagaatggcaaaatgctgaaatacaaacatactctaagcacacagaccttagtgtcacagtagaaacttcctgcttgcaataattgccattttaattttggtgcagaaagccttctatggatgtgatagtttatgtaccaaagagcaatctctatttgaagaaactgtgtggcctggttacaaaagtgcctgctgtatctgtaactgtcagtggtattaaaaatactgatttattttgcctgttgtgataatcaagaatagcttatttggatatatgcatgggatggttgcaaataccaagttcaggtattttactatggaatatagataggggtgttttcttctggttttccccacccctttatatataccttgattttaatttttatcaagtgtgtctctttggcctttgccgctgtggcccattgatctgtccatctgtctgttacagtgcatattgggtacttccagaagtatgaattcagtgatgcaaaggacaggcgggctgcagcagcaaaggtaggacagaatcattccaaagacaagtcattaaaagaccattaaacacacatacttacacacagacattggcaaccagtacctcattatttaagggcacatcatttatcctataaatctttgtgggaaagtttgttttgacatgacaaatgtgatgtacttgtaaagggcacaattttattattatgttttaaaccagaagcctacttggcacttaggcaacaaagtaaatggcatttgccactgtctttaagatgccgaataatagaagagataattaaatggaggatattaatggtattaattgattcatggagctggctgattttcagaaactatgataaaggatcctattttgtaaactgggaggagaaacagagaagatagattgagctatgtgtgtatatttatgtgttaatgtttatttatattcctgactctggaatattttgatgaaaataatctaaatcttcctgttatttcgctgacatcactatgaggaagattaagaaattctatttaaatgtttgtaccatttacttaagtatttgtatcagtttacttgctaaatgatagcagttataatagcaatttctggcttaaaaaaaaaacagggttaggatggaagggcaatagcatttttatactgaatcctaaaacatcagttataggcaagttttaaaacttaatcatacgttgcaaacacttgaagatgaaatggaaggcttataaggttaagtgttaggttttatgtgtcattctagtattggctgaaaagtgagtgctatagggatggtggaatgatgcagatatttgcatcattttctatgctgttatgcttctaaaaagaagaggctatgttttcctaaataggttagtagagtgcttctcaaggcttcccaaatgaaaagtcagacaaaaatatgtatttgttcttcagtgaagattgttgggttttcaaaccagcaatcttagctgtaaaacctaagatcttaccacagcctaaattgtgactcaaatgctgatgttagttaatacttttataaactccatatactatattgaggagatctagtttcttgaatgtggaagtgaagcttcataatataccatagtagggatgtttcgaatcaatagtgttaaaatgttttgggttttttaaagattttttttcagctggtcttggaaaccttttcagttatctgtttttgattctaccaaaggtattaggtatttaatgctccactaaatagatcacaaaaggggagtcttaaggaggtgaagatgtgaacttcttgactagatgtaaatcactgctcagaaagatttgacttttttaaatgatgcattcttatgtcaatagactttaatctgcaaccaaaatgttttttttttaaataaaaatgaggcacatttgtgctttctcacttctgctccaattctaccttattctgcaagttgctattttttcctttagcagtacactataga

SEQ ID NO: 80464 - DNA, 1447 bp, Homo sapiens
cctcccctctgttttttccctttttgcaagttgaggctcttaacaattcctgaaatagtttaccccaagcaccctatccagtggtagaaaatacagtgtactggatgccacaaagttatagtcatgcaattttagttaataacaggagacttaagtctcttgattgatggagagacttaagatttagcttattttacatatagctaaatctaaattagtgactttatttcagttgtaggcaaatcctcttgttaaaacttgtttttaatttctgagttcttttaaaaaaaaagttttacatcacatttctaagagctggagatgacagtgtctctgttttctgttttctctacaaataaacgtataacttaggatcagttaaaatatttcttttcacatcttaactcttatagatgggtggtgtctatcagcagtgctctgttaaagacagattcttaggggagtgtgggtccagagaagtaaggagtacctagattagcaaaatgtactaaggtgagtaagtgagtgtctgtatctttggcttttggaggggagtatgcatgtgtgtaaatttttctgtaacaaatggtactgtcgaaaacaattgacatacatttctttcatgacactatttttatacaagattactttaaatctgtagctaactacggtctgcttgtggtgaagtaaagtggttttagtccacagagatcttttttggaaggttatttgatgtagtaaaattatatatgagataaaaataagcagacacatgtttgagttccacttctgctattgtaactagctcttgtatctttgaatgagtcaggccttgctgacttcttaggccccgttgcattttgagttaaaattttgtgcacaaatagtgagctcactagtttcatgggaaatggagatatttgtgacagcattgaatgataaggcagtaaactttggttttatttcatagtggtaacttttctttcttgaaatagcagcctaaaagtatgccctgtaaactactatgtggtacagtattttttcattttggttaaatatctctgaagtatccttctaacttaaaagtgatttgaactcatttgaactattcagtgtataaggtattaaattatttttttaaaagagactgggtctaactatgttgtccaggcttcactcgaactctggggcctgagatcctcctgcctcaacctcctgagtggttaggactataggcacatgcgatcgtgcctgagtgttggaaattttccttttttaaaacaaatttttttttttttgagtcagagtcttgccctgttgcccaggctggagtgcagtggtgggatcttggctcactgcaacctccatctcccaggttcaggtgattctcgtgcctcagcctcccaagtagctgggactacaggtgtgtaccactacacctggctaa

SEQ ID NO: 80465 - DNA, 1282 bp, Homo sapiens
tatgcctgtagttccagctactcaggaggctgaggcaggagaatcactttaacctgggaggcggaggttgcagtgagcagagatggcgctactacactccagcctggcaacagagcgagactctatctcaaaaaaaaaaaaaaaaaaaattcttgctcacaaacctttaacctgttattagtagcatttattcagtagaaacaaaattgagaagttgcttaggcttttctggccaccagaccaggtgcttggactggttctctggtttcagggcaggattctattccattgggtttttaaaaatattttctttctgaaaatctttatagttttaaaagagaagaaattagtgggactggagaatgacagtattaatgtcattcttaatcttgttctgctctttggtttggaaatttgtttgaatggaaatttgggacacttgttaatggtgaggttgacaacttatgtttatttcattatcaattctaaatttaataaaaaattaaacctagttgttgggaactgacaacccatatattatagaaataaatggaaagtatttcccatttgattttaaaattcagagagtactttataaaacataaataataccgagaatatcaccccatttcatacaccttgtatctattaaattacattgtaaataatatctattgttactattaaattacaatttaatagtaacaactatctcaaaacaaacacatactgtataaagctttcccatggttcatgaaggataacatgttcaactagtttgatttttctttttatgcattctgaccatgttttttttgtttttttttttttttttttttttttgagacggagtttcgctcttgttgcccaggctggagtgcaatggcgtgacctcggctcactgcaacctccacctcctgggttcaagcgattctcctgtctcagcctcccaagtaactgggattacaggcgccctccaccatgcctggctaatttttgtatttttattagaaatgaggtttctcagtgttggtcaggctggtctcgaactcccaacctcaggtgatctgcccgcctcagcctcccaaagtgctgggattacagttgtgagccactgtgcccagccctgaccgtattttttgacatcagtggtgtttcttaattttggtaacatttactttcaggtttttttatttgatgacacctctactaggagaaagagtttttatcgtttacttgtgaaactctaatgaattaacactgatttactcagagtttctct

SEQ ID NO: 80466 - DNA, 1029 bp, Homo sapiens
gctcagtttttctgggaaccttaaactgtctaaaaaaataggtggtaagtgtgaatttaaattaaaaggaggtttctgggaaacttctgagtatgtgaacgtttcagtttctccttgtagtttctgtagagaagctattggatacctaaaagatttataattcagtctttaaatagtgtctttaaaatcaatatgcaatatctttttgtctcatttaatgattttcacattatattttatgttgtctgctattagcactgccacactttttttttttttaaagcatttgactgatgtatcttttccattttttaaatattcaacctttctgggttttaggagtgtcttttgtaaataccatgtaggtgccgtttaaaaaaatctgaatgaaaaaactattatcttttaatatcagagattaacatattcatgttttataattaatgtttagattaaattactgtcattttaagttgtgctttatatttgttatgttttctgttcgcttattctgttggcctcatcagattttcctttttctcgaataatttcaaatttatatatgtattctatttcagtttttctagtcacttttacaatttgtacatgcctacttacaactatataaaagtttctaacaatatttacttgaagttttaatccatcctctgtacaagacaaaaactgtagcataaatttttttctttgtcctttccttgtccctatcagcttgataagttgatgtttgaatttttttttttcttttctttttgaaacagggtctcactctgtcacccaggctggagtgcagtggtgagatcatggctcactatagccttgacctcctggactcaagcaatccttccatttcagcacccccagtagctgggaccacaggcacgcatcaccatacctagttagtttttatatttttttgtagagatggggtttcaccatgttgcccaggctggtctcaaactcctggacccaagcaaccctttcaccttgaactcccaaaatgctggaatt

SEQ ID NO: 80467 - DNA, 1377 bp, Homo sapiens
cctggagggatgggaaagtgaattgtgtcctctgtttaccttgctagctttttttttttatctccgtatccttatgtctgttctcatattacactttagtagtacaaaacttttgtgacagtcaccaaattcatttttctgctgcctcagctttgcaattgtgttttgacccagggcttctgtttactgtgcagctctagggagcatctttggaattgtactgtcattggcccaggcctgacttgcctttcttactgtcttttttcctaattttccttcaaaactcaagttaaccttttcttctgagacagcttttcttatctctcaagatctacttgctttgcactgtattgtttatttgatttagtattttaccacttctatttgaggttctttgtgcagaaactatcctacttttcttgtattcctacacataacgcagttcctaatatatagccattgtttactaagtattttaattaaatccagccatttataggttttcttttctgtaatagaattttattgaagttatgacatgaatgtaaatcagatttcattttgggagcttttagaaacagcatcaacaatggagctacttttaagttgataacaagtaaaaaaaaaagtgtctttcttgcagctcagatttcttgtaggttattaaattataataacatttaaaaactcatttcagttgatagtatggtagtatatagggtaaatgctaatgaattaattggtgtgtttgaggtgggatgaaatacaggtggttgaaaacttaaccacctataaaacttaattatacttggacaggtataattaaagaatcctgaagaaggatttcagtctttcctggactctgttacaaatagcttttcacttttcattctgaagcattaatacccatttaatgggtaggtactagtgttaatacttggatgtgattatgataacatggaactttttgtagccacattattaataatatataatttcataattagcctcagggatggtgaaagtaaatttggtttttcagaaaccttgcctttttgatgacatttatcactattctacaatacagtgaaatttttcctgtttaaacaatccacggccgggcacagtggctcatgcctgtgatcccagaactttagctgactgtggcaggaagatcgcttgagcgtaggagtttgagactagcctggacaacatagggagacccccatctctacaaaaaaataaaaaattagctaggtgtggtgatgcacacctatagtcccagctactcagaaggctgaggcaggaggattgctggagcccaggagggtggagctgtgatctgtgatcatgtcactgtactctagcctgagtgac

SEQ ID NO: 80468 - DNA, 1555 bp, Homo sapiens
accccagcaacagcacaactttaatccttaagttttagttgcagtactgttaaaatactaatagcttaatttcccaagattcagttatttaaaaccaaagtttagggggaaaaaggcagcaaaactcagtctactagtttacatacatacacacacacacacacacactcatatatatgagagtagactgaatttttgctgtttgcaatatatatatatatgcacatgtatacacacacctttatttgctataatttgtaccatgtagcttttatttcctctgaataaaaaggttgttatcttgttttattttaattcaacttcttgcttttccctatagaaagtcaggtttttggagagctctaacagtgtgcaagttgctgggctcttatcctttctgtttaaataatgcaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcggtgagtatctggtagtttaaggctagtgctgactttgtatttcagagggtaaatcaacttccattatttaaacaaaggaaaatttgtgggtctgggagtagtaacctctaagccataacctatcaatgtattcagtgtgaggaaaggaagaaaaagagtaaaagcttggttcctcttacctccaacccccatttgttttttaaagcagcaacaacttgtccaagttgtcatttatagacctaaatctttctggagtttattctatcaccatgggagaattgtgtaatagtaggcagtaagtagaattctttctcatccaaattaaaatagatttaaactttaagtgttttttaaatatccagaaacactcataaaataccgttaatactatttgctagggaactctcagaattcttcagaagataagattttcacttaatcaaatccattcaaatggagattgttaaatatggtatgtggggacagagttggagcagaaccagtgatatagcaagagaaccaaagaactgatgttaatcccttaagtacaaataaccttcctaaaaatttattgaactgaagctggactcagtggctcatgcctataatcccagcacttggggaagccaaggtgggcagatcacttgaggccaggagtttgaggccagcctggccaacatggcggaaacctgtctcaactaaaaatacaaaaaaattatcctggcatgatggtgcatgtctataatcccagctacttgggaggctgaggcatgagaattgcttgagcctggaaggcagaggttacagtgagctgacatcatgccactgtattccagcctgggcgacagagtgagactccgtctcaaaatataaaatagaatttactgaactgagatgatttacttacttgatttacttgagtgtttactaaggaagtttagtcttaagatgtctaagataacttaattctatgataattacaactgtcttgttcat

SEQ ID NO: 80469 - DNA, 1093 bp, Homo sapiens
acttttgtagttttagtagagacagggtttcaccatgttggccaggttggtcttgaactcccgacctcaggtgatccgcctgcctcagcctcccaaagtgctcggattacaggcacgagccactgtacccagccctctcatagatttcttttcatgtccttgtctttgtatttaaaaaatatagttgatgtgctgtatatagaatttctgtcctaacgagatatttgtatctaatatcataagtaacatcagaaattttataagtacatgtcacataatggctaaatagaaaatctaagggaattttaaaataccctttataagagccacgaaaggaaagaataaaagagctaggaataaacttgataagaaatgtgaaagattgctatgaagaaaacttcaaatactaagataaaagaatgacttgaatatttgagatagaagaaataggaaaatattgaaaaagaagattaaattgacaggggagagctgagtgaggactagtcctgctagatacaagagtagacagagcggtggaacaggatagagtcaaatatgcatgaggagaatttagtgtattacagaggaggcatttcaaataaggtgtattatttgatacatggtagcagtggaacaggatacagtcaaatatgcataaggagaatttagtgtattatagaggaggcatttcaaataaggtggattatttgatacatggtgttagagcaacttggtagccatatggaatagaaacttaagattcctacctagcttcataaataaaagttaatgaattcacaagcggtaaatttaaacggtgataagtttcactgtgagtgaagagcttctgtatggcaacaaaatatgaacactaagaattaaagtgggggaaaagatttcccctacttataaatggccaatttcctacataagtaaaaagcctccgtaaataagtgaaaaacccacaggcaaagttggcaaaatatatcaagagagtatacagaaaaagaaatatacagtgtaaaaccttttttgaaatattataatttcatttataataaaaattcaaatcaaaactaaagaagttagtgtg

SEQ ID NO: 80470 - DNA, 1028 bp, Homo sapiens
ttcataagatcacaaagatgtatatatagtcaatgcagtagtatagtaggaaaaaaaaaggcagtgtaaaggttcattaatagtagactataaataaaattgtggtacctttctataaagaggcaaacccacaccagtgtggtaccatatgagaaatccattggatttatttttgtttttttaagacggagtcttgccctgtcatcaggctggagtgcaaaggtgcgatcttggctcactgcaacctctgcctcccgggttgaagggattcttctgcctcagtctcctgagtagctgggattacaggcatacactaccacacctggctagtttttttgtatttttgatagacacagggtttcgccatgttggcctggctggtctcaaactcctgacctcaaatgatctgcccgccttggcctcccaaagtgctgggcttacaggcgtgagccaccgtgcccagccctattggatttttttaaacaacaacaacaaaaaaaaacaaggtgcagaagagaatttgtggtactgttacagtgtgtgtgtaagtgtgtacgttagaacacctctggaagaatatgtaaaaaactggaaatagcagttgcttctgggtagaggaaacaaacaacagggatgggaatgagggaggcctgtttttttttttttttgagacagagtctcgctttgtcacccaagctggagtgcggtggtgcgatcttggcttactgcaacctccatctcctaggttcaagcgattctcctgcctcagcctgccaagtagctgggactacaggtgcctgccaccacacctgcctaatttttgtatttatagtagaggcaggattttgccattttggccaggctggtcttaaactcctgactgtaagtgatccgcccacctctgcctccagtagtgctgggattacaggtgtgagccaccgcacccggcctagggaggcttatttttcaacataaactctgaacttgtactgttaaagtaattgtttttagtaatgtctatttaactt

SEQ ID NO: 80471 - DNA, 1034 bp, Homo sapiens
caactaaagataataggctttttcctaaagtaatgtggcattccagttaaagagccactccaggtaacgttttctcagccggcatcaatattggtatatgttaacttaaacttgttgcacgattttgtcagattatctcgcttttgcctttaaaattgtgtgtttaaaaaccaattagtcaggttagcaagtctagttactttatggtgataaacatactctcacacacatttcctttaaggagaaagggaaggattgagatcctgtaaacattaaggtattcccagaacctagcaaagtgcctggcgatggtaagcattcattaaatatttgttgaatgaagacagtttaaatttcaatctttttcagactatttcgtgtcctgctcatggttgtgatatcttagtggatgacaacacagttatgtaagtatttttgatagattctgcatgtgaatattggttagttggttaaaccaaattaatttttacttagtacctcaaaggaagtgaaactttttaaagtctgaagaaactttttaatctgcgttccttagtagtagtacaaaagcccatttgtaacttggttaaatgcctgatcactattcttacaaacttagaaatgcatggtagctagattttgataaaccttgggattggagattagaatgtgtgtatgtgttagttgaggtgttcttggaagcagatcccaagatagaataaaaggtgaaactgacttattgtggaatagcatctgtgcaaggtaaacagcaggagcagatagacattgatataggcctgacatctgttaaaagacaaagaaggaagattcaataggaagagactttatatgatacagctatgagagtctttggcagccctgatgggggaacttcagtgcatagattgcccatagaggaatacctcaataagtagaaagagctgggcccagtacacttgatatgctcagttgttggctgggactacccagggagtcatggtctttgctgaaacactgctgctgatttcagatac

SEQ ID NO: 80472 - DNA, 1051 bp, Homo sapiens
ggagtacaagtggcaccatatcggctcactgcaacctctgcctcccgggttcaagcaattctcctgcctcagcctcctgagtagctgagattacaggtgtacaccatcacgtccggataagttttgtatttttagtagagacagagtttcgtcatgttggccaggctgttctcgaactcctgacctcaggcgatctgcccgccttggccttccaaagtgctaggattacaggcgtgagccaccaagcctggccaataactattttcaatttgtgatggtaacaaatctttgtcaagagaattgtcttattaatgaccagagtgacacttgctgccaccttcttgagaatgcctattcttgaagatggatgctcactttcttttacttccttatcaatatcagataaactaagggtggaaccttgtcctaataactgttggctgatgtttgctctcacgtcctggtggtccatgccaggtttagatagctttttaggctaaggccagctatcagaaatcattagggtttgtcataccagaaaagcattatgggtaatacatgtgtaaataagatgtgtgtgtttggcaatcaaggcatctgacttttggcctgatacattccttattattatttattgatataaaatctgtaatataaaactcattttaattacagttatccttagtatactggggattggttctaggacccacgtcctccaccctgaatataccaaaatctgcgcatgctcatgtcagcccagcagaacccatgtatacaaaaatttgaccgtccatatatgcaggtttcacatcccacaaataactatttttgatccctgtttggttgaaaaatattcataaataagtggacccatgcagttcaaacctgtgttgtttaagaagcaatggggttttttttgttttttgtttttttaagatggaatctctctctgttgcccagagtggagtgcagtagtggcatgatctcggctcactgcaacctctacctcctaggttcaagtgattctcctgcctcagcctcctgagta

SEQ ID NO: 80473 - DNA, 1212 bp, Homo sapiens
atgaaacttaaacttcaggattcctcactacgtgggatcctgtgaattctggaaattcttgtgagttatagtgttcagaagaggccaggatgcagtcagtgagcatttctggttaatttctaagagctctcagaagaagaaggctcttaaaattgtatcagctttaggtatcacaaaacctggatccatttcttaacatttctggcaacaatatctgtctcatttcgcatactgatttgggtggggtgtctgaaggaaggtggctgagaattgctgtcttaaggcatgatatgatatcagagtcaaaagaccctgaaatgcgcttatacttggcactagttggtaagtcattaggctgtaataaaaactgggtaaaagtagactatttaaaaaataagaaccatggaaaaaaagtctatgaaaataaaactatacaaactttgaaattattgttctgatcagtacagttatatttgttgatagcctatgtgcatttcagtatttacagcttagggcataaacatgtagccgtagcataaacagcttttgaaactatgttttataaatgtggaaaatactcttgactggaaactttctaatctatttttattcttggtttcaggcgcctgatcacagattcaaaagttaaattaaagtatcagcatttaataacaaatagctttgtagaggtaagtgatttgttttccttcttgtaagaaggaattctgtttattaatagaaatactattttaaaaattataatttattgacagtaaaaaacatctttaacatatttatgaagcatgccaaaatacctttattctcaaaagagtatgacaggccaggtgtggtggctcatgcctgtaatcccagcactaagggaggccgaggcgggtggatcacctgagatcaggagttcaagaccaacatggcgaaaccctgtctcttctaaaaatacaaaaattagctgggcacagtggcacaagcctgtaatccgagctactcgggaggctgaggcaggagaatcgcttgaaccctggaggcagaggttgcagtgagccgagatggcgccactgcactccagcctgggtgacagagcgagactccctcttaataaaaaataaaataaaataaaataaaagagtatgagaaaccagtaagtacatctctccatagatcttgaccttggataataaaattatttttactgta

SEQ ID NO: 80474 - DNA, 2056 bp, Homo sapiens
tttaaaaaaaaaaaaaaaaggcacatctgaagtgttgctatagaagaccacagcaagttttcataagcttgtgtaattatcccccatttgccccttgtaccagagaagcaatataaatagcttgatgtactaggaaatcttgcatcatgacctaatttaatttgctgtctttttttgaggcagggcctcattctaacacccaggctggagtgcagcagatgatcacagctctctgcagcctctacttcctgggctcaagtgatcctcttgcctcagcctcctgtgtagtcgggactacaggcacataccaccatgcctggctaaattcttttttcttttttttaaggtagagacaaggtcttgctatgttgcccgggctggtctggagtgcttgacctcaaacagtcctcccgccttggcctccctaagttctgggattataggtgtgagccactgtgcccagccagctgtcattttttattttctaacttgtatttcagtgcaatcgactgttaaagtggtgtcctgccccagattgccaccatgttgttaaagtccaatatcctgatgctaaacctgttcgctgcaaatgtgggcgccaattttggtaagcaagtgatttcctaaattgaaatagtgcacaaagcgtttccatttctcctgtttattcttggtagtaaaatagcagaaaaaaagtgtttaccttaggcagggagatgtttgatactggtttaaaatagtatatatctctttcagaattgaatgaaaaggtcacatcttaaaaaaatttttcctctttccttgatgttctaacttttttgaatttttttttatggagaaaatatacaactctaatcatatcttcctgtatgctccactgtaacttaatgggagcaaacttgtagatctgggactatacgtttttctttactctgccaaattttaaccttacttatgcaaaggaaatgtgcaggtaaattctgctgatggtctcctttttaactaagagttttcctgtggctcctctcgcccagctttcttggtaacttgggcttttggagttctatagtatactcttcagcctctgaattctagatttgaactgccaggaagtttccagtgccacatattaggggatgtcttaatcagttcaggctcctttataggtgttctagttttttccaaagtggataggctgaaaatttttcaaatttttgacttcttatttccttttgatgaacagtttatctctaggtcattcatctcttcttgcattttctataaacattcaagagaagctaagctgcgtcttcaacactttgcttagtaatttcctcaaccagatattcagtttcatttctctaccttccacaaaacaattcagccaacttctttgccactttatagcaaggatggcctttcctctagtttctaacagcatgttcctcattttcatctgagacctcatcataatggcctttactgtccatatttctaacaacattctgttcatggccatttatttaggttttctctatgattgaggcattccctgcacttctgtctttctgaatcctcaccagaattacccttaacaattcagttcattcacagtgatctaggctttttctagcttgcacttccaagctcttccagcctctacttactacctagtttcaaatcggctttcacatttttggttttgttagaacagcaccctcacttcttggtaccattttctgtcttaatgttcaggcttttataacaaaagaccataaactgggcggcttctaaacaacataaatttatttcttacagttcttaagggtgagaagtccaagatcaaggtgccaaaagatttgttgtctggcgagggcctgcttttctggttcatagatggtgcctacttgctgggtcctcatatggtggaaaggacaaggcagctctctgggccccttttttttttaaaaaggatgccaattccattcacctcctaaaggctccacatcctaatactgtcacattggttattaagttttaacatacacattttagg

SEQ ID NO: 80475 - DNA, 1676 bp, Homo sapiens
tacttcttttacaagtgtatatgtcatgaacttagaaaacaaaagtgaattactgattaacacatgtttagtgagtatttagtctttttgttttataccttgcccagtaccatttccctctacagggcggaggttcatttgtttaaataatgcaaagatgtgacctatttgcttcccatatattgtttactgtgtattagtactaaattatataagtaacctacaaagtcagccttttattcttcatttagggtgttaagtaaaagattaaaaatgcactgatgaagcatgggttgaaacttctcaatatagtctgaggcaccttagcaacaattattatgaaattgtcatcaaagcgtgtcttcatgcttatagtcattcttcacacatattgagtacccactatgtgctagttctactactaaattctaggtaattaactgtaaagcagacatgggttctctccttgtatttgccagtcactagaaactagtgacaatactgtggaactataaggcatgaaatgattggcttatttacttgcttacagtaggtaggccttaattctattaactctttgtgtcacttaacagctttaactgtggagaaaattggcatgatcctgttaaatgtaaggtgagtttgtctgacatttcaatttttaaataatggcacacttctaagacttagtgactaaaaatcatagctgatgattttgttatctatctattgatagatttttttttatccttttaatttcagatgatcattacatgtattcagaggtaattccttaggataagccaagtcagctcctgattgttattaggataaccatggctaaggcacctctttgtcaggctttgtaattaggggaatacacaccttgcagttgggcttctcttcaagctctaggttccccactcagcttctgccaaagaaaatcctgctttggttgattttatatatactggacattgtagctatgggatttccctggcttaagaggatgtgagcctagtgataatcttattcattggcttttacatttaagcttgactatagttaagtgctaaagtaatttgctatttttaaaagtcttttgttgtatcctaaccgttgttattttcaaacagtggttaaagaaatggattaaaaagtgtgatgatgacagtgaaacctccaattggattgcagccaacacaaaggttggtgttttccttcagtaactcttggtaataaaaatgataaggattggtactttggcattagcaaaagcaatgaggtgacctacttacaggctttgtttcatctttttctccattgagtctttttttttttttcccagaatgtttgcctgttatttcctttttctctttgagtttattttagagtattgagtactgtagtacagcatccacagttctctgccttaggtttcttctactggaaaaaaaattagtgttctgtagaggaaaaagctgataatttttcaagtgtgggatttgtgcttggctgccatttagtatacaaatgcattggagtttactccgcctagcttggttctgttaggctaatttacatttttgtttctaattttttgttttgaagtacattgctcttgatactagtttcaaaattcaatttcaaaattcactttcttaaccccagacaaa

SEQ ID NO: 80476 - DNA, 2260 bp, Homo sapiens
tattactatatatatgactaaaagtacttaaaatgatttgtctctcagccctacttaaaaagaaatcctaggaaggctgaagtggaaagatcacttgactccagaagtttaaggctttagtgacctatgattgggcctctgaatagccactgcactacagcctaggcaatgtagtgagactctgtttctaagtttaaaaaaacaagtccttaaattgttgtatgtcttaaaagccagtggtaataatggtaacagctcattttaaatagtgcttaagtgttcaacactgttctaagtgctttatatgtattaaccacaataaataaaatgtttaaaaacaaaccaaatctagaactggcttttccttaatgttagtaatgcaacctagtgtagcattgacaccaactttatagtttctcttcataggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtaggttggggaaattaagggaagaatgtgtttacataagtatgtgccatgtattatgaataacatttctacctcatagatatcaccatctaacttgcaagctaaataaatacatagtgtgtgattaatgttataagtctatgcaagacatagagggattagttagatatatttcataaaggaggtaacaatttagatgaactttaaggggaccaagagttcattagttataaaagtagtaggaaaaacatttagggcaaaagttgcaacatgagcaaaggtagaatgttgtgaaaatacatgactttttcagagaataactgtattatcaaatgtgcctctctaggccaaaattgaaaactcagatgctgttggcaaaacccaacctgcaggtggttttactctgcatatcattagacattgtggaatgctttaaagccttgctaaaaggctttgtcatattttttctttaaataagcatatatatgttgctttccttgttttattgatgacttacttgaactaatataagaatcttgggccaggcacggtggctcacacctgtaatcccggcaatttgggaggccgaggtgggtggatcacctgaggtcgggagttcaagaccagccctgaccaacatggagaaaccccgtctctactaaaaatacaaaattagccaggcgtggtggcgcatgcctgtaatcccagctactcgggaggctgaggcaggagaatcacttgaactcgggaggtggaggttgcactgaaccaagatcgccccattgcactccagcctgggcaacaagagtgaaactgtgtctcaaaaaaaaaaaaaaaaaaaaaaaaaaaaagaatcttacacagcatatgaagcagttttctcactggttaagggcataagcctccactgggtgacaggcaaaagtttaagctctgaaactctgtagttatgtgaccttaagtatgtttcccatcctctgtaaattttattcttcatcttctcaatgaagaaaataatgcatatttcataaaatgtttaagggattaaatgtgttagtacatttaaagtcattagccaagtgcatggtatatagtaagcactcatgaaatagctgctcccataatgtaggctcccataactgatgtatagtaaccactccaggggaagtgcaagtcttactcatctatgctctgagctgacctctctgggtatgttttccccttcccaccattctgtatatcatgcagttttaaatgactctgaaaaactgtaatagcaaagcacatagcacagcatctgttacatggtaggctgtcaactgttggttctctgtggtttataaaagagcagataaggtgaataatcctggaaaattagaaatatttggcttaagtaacagatggcctaagagataagattatctctttctcaaaaagttgagttaggaattcagacagtcaataaaggttctagaaggacagtgttttctaataatgataggtgagctgatttgaaatggactgcctcaggaggtggggaatttcctatcactggatagagaactaatttattatagagagaattcaaacactagatagggttagaacagttcctttcagcctgctaattctgtcattatagcagtagaaccctgggtgttttaacatctcaatttctctgttataaaagataacgttggtgt

SEQ ID NO: 80477 - DNA, 1019 bp, Homo sapiens
tcagtctagtctcgaactcctgacctcgtgatccactggcctcggcctcccaaagtgctgggattacaggcgtgagccaccacgcccagcccagggaataattgagtagaacttttcaattctgaaggatttgtgaaagacattccagtaaatattggatatctatttacatttagaaagggaatcttatccaaaatatttatcaagaacattcttatagtaagtttattttcttttcattaatgtagttacatagcacattttagcttttggtagagtcttgctttcaagatccctcctaccccaagaagaacagtagtgaacagcatttgttaaatggccctggtgctatttataggcaatatcttacttacttaaattttttttaaacctttttgttcatcaagaagcgctgatgattataggtgagctgatttggtatggagtgtctcaggaactgagaaattccctattgctaggtagggaaatgacccactgttatagaagggatccaaacactaggtgtggattagattctaaagcacttttcattcctttcagtctggtgattttattgtaattgtggaaccctggaatttaatagttcctacattcacccattccatattgaaattccccagttgtcccagaaatattcttttcaaatgattttcctagccagggtacaatctaaaatatggtttgcatctgtttcttatttacttgttaacatatcttcaaaatgtatttctaataaaaatatcatatatagaaatgagtatatatgtaacctagtctgtcatattgctagaagtgaaagttttgtctttccctttttaaaaagactgggaaatacggccgggcttggtggctcacacctgtaatccctgcactttgggaggccgaggcaggcggatcacctgaggtcgggagttccagaccagcctggccactatggtgaaacactgtctctactaaaaatacaaaaattagctgggcatggtggcttgcacttgtaa

SEQ ID NO: 80478 - DNA, 1503 bp, Homo sapiens
taaaatagattatttttctgtttcacatctgttggactaaactagaatcttctataactgtgggagtacaaagaaagatttcctatcactccattggttgtttggttgattgactaattgattgggagccacgcctccctgaaaggatcacaccattgcatgcctatctggcctcctcatctttccccactcccaagctcttggcctagcatttactgggagttgtagtctgaaaaattactagaaggttgacacatattcaaaagatccttgatggtaccttgactgccctgcaaaagatgtacctgtgttatagaaaattgttgactcattatattgtaccacagtgccgacagttgtggatatttgaatcttcttgtcctctagactagggtcagcaaactttttctgtgaagaatcagatggtgtatatttttagctttgcgtactacataatctctgttgtgacggctcaactctgcctctgcccttataatgcaaaagcagccatagacttaaatgagtaggtataactgttccaagtaaattttatttactggctgggcatgatggctcaaacctgtaatgttagtgctttgggaggccaaggccaaggatcacttgaggccaggagttcaagaccagcctgagcaacatagtaagacccccccgccgcccccgcccatctctacaaaaaaaaaacaaagaaggtttttaaattagccatgcatgttggtgtgtgcctatagtctcagctatttgggagctgaggtgggaggattgcttgagctcaggagttccaggctgcagtgagccatgatgacgccacccctctttagcctggatggcagagaccctatctcagaacaaaaaaacaacaaagaaagcaaaacagttttatttacaaagacaggtggcagctggatttgtcatgcaggccagagtttgtatacccctgttctaagcagtcaagtttgttgtcttttccacgctccccaaactgctttcaggtcgctgattacatttctcattccagattctggcatttgattggagaatttgtcttgatcaggctcagtggctcacgcctgcaatcctagcactttgggatgctgaggcgagaggattgagtgcgggagtttgagatcagactgggcaacaactgagaccctgtctctacaaaaaatttattaaaaattagccaggtatggtagtgcacgctggctgaggtgggaggatcacttgagcctgggaagacttcagtgagccatggttgtgccactgcactctagctcaagcaacagagcaagaccctgtctccaaaaaaaaaaaaaaaaaaaaaaaaagtcttattagcagtgatggtatgggtgttcttttttcatgttgaattttagtgagaagcagtttcagaattcttagattaagtcaagtcccataacatcatacatgtcaatatggtaagggagggttttcatttcatttggggaacttgacaggctt

SEQ ID NO: 80479 - DNA, 2245 bp, Homo sapiens
ccacccgcctcagcctcccaaagtgctaggattacaggcatgagccaccacacccagcctatcttaaattttcttttatagttggttcaaattgggatccacataggtccacaaattggatttaattgatatctcttgagtctcctctacctgttgttccttctcttcccccctccttgcttttttttctttgttgaagaaactagatcgtgttgtcctgtagagtttcccacattatggattttgctggttgcaactgcatggtgtcatttaataggttcttctatccctgcattttctgcactggtgattaattcaagaaacttgatcaaattcagattcagtggttggggggggagcccagaatacttaattgattatactttctattgtattatatcaggagttacatggtatgtagttgccactgtagttttctacttaaaaatatctctgctttttgcttgttttacatcttgtggcatactgtagaacagtgccatccagtagaacatttttgtaatgatgtaaatgttctttatcaccagtgtctaatttggtagtcactaagcacatgtgactattgagcgatgaggaactgaatttttagtttcttaaattgaattttaagtagtcaggtgtggcttgtggctactgtattggaaagtacaattaataggacatttttcaagagtattaaataacaaaagtagcagtagatgtctattcctgattttagcctagatcacagtactgtttcatcagtaaatcagctttttaaattattaatatttttaatggacaaatcataattatacacatttatggagtacagtggaatgttttgaaatatgtaaacaatgcaatgattaaatcaaactaattgttgtattgccttgccttaacatttttatggtgagacatttgaaatgatacttattttgaaatatatattattattgactatattcaccctgttgtgcaataaatctcaaaacttactcatccagtctatctgaaactttgtactctttggtcaccaactccccattccctcccttcctacccctctatccccgcaagcctctggtaaccgtcattatactctgtatgtctgtgagttcaacttttttagtttctacatataagcgagatcatgtagtatttcttttctgtgcctggcttatttcacttagtgtaatgtcctccaggttcatccatgttgtcacaacagaattccttttttgaggctgagtactcgtgtgtgtgtgtacatacatgacgttttctttctgtgttcatccattgatggacactttacatggattccatgtcttggctattgtgaataatgctgtagtgaatgtgagagtacagagatacctttgacatactgatttcaattccttttcatatatacacagtagtgggattgctggattctgtggtggttttgttttcagttttttaaggaacctccccataccattttccataatggctatactaatttacattcccatcaacagtgtatcaagagtctccttctttctttatctttgccaagacttatctttcatctttttgataaaaaccattctaacaggtgtgaagtgagacttcattatggttttaatttgataatcagcttttatgtacagtttatgtgttataattatatcacccaatttttcttaatgggacagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgaggtaggagtagttctgggtgaggaaaaagcccaccttgtatcataggtctacctgatctttcatatataagatacagagttttcagggttcttgtttgttcagaacatgtaggtagacgaatgtatttattacaaagatacaagaaatttctatttcttgtcctaaattatattcagatcgatgtggtttagccagctagtgattaggtatgcaggttctggagtcagccctagattttaatctttacttcattatgttttagctctgttgatttggag

SEQ ID NO: 80480 - DNA, 4876 bp, Homo sapiens
agagctttacaggtgcagttaaaccacctatgaaagttacagaatgagtgttgagagcagtctgtagtcaacaaaacagtgaaaatggtttatcttttagctttattttgaagccaaaatttactttcattcttcttacagaataaccaagcagatctagagaatgccacagaggtgctctcgggctaccttgaacgagatatttcccaagattctctgcaggatataaagcagaaagtacaagacaagtacaggtaatttttttttaagctgttgaataaaactttctgccagtgatgatccttactggtaaagttcagtgatagtgaaactgggtttagcatatccagcaactgagcttttgccatgtttctcacagattgcttctgtccgttgggcactaaattgcaggtaatagtattggtgaagcatacatagagaaggaattcagccatttattctattggctaattccacttctgttcagttatttagttgctaccttgcaaggaagaaagaatccaaaaaggccaagtggcctttaggatgagagtgagaattgaatgttggtcttagcctgagaatcctatgtatgggtcatggctattcacaaatgagctatggaaacttactttttagagtttttattacatatatatatatatatttttttaatctaaggagatacttgtcctaggagtcgatttttcaagatgtgccgcctcttaagctagagatgcaaaatgttttatttctcaacatgaagctctttctcccaaagtgacaaatgctagtgtcttttgaaagttgtaggaaacttggggagtttggaagacttggagatttagtcctaaccaatatcttcccttcccttagccaattttagctaccatattttgtttacagtacttttacagttgacagagattttaaggacgtgaataaagaacccatgaaattatttctgaacctgtttatctgcagaactgtgggattgaattatgatttctaaggtccatcagaacttgtaacactttattgctttaaaattaattcccatggaatcatggctttcagaaaataccattttaatattagaagcagtttgatgtgtctgtacatctagacctgaacatgtgcctattaaaataaaaaataggtgcttggttccgagtctggataaactatagggatgccttaaaaataagtaaatgcctctttttttattattagaggctgacaacaagtttttttttttttctctttgattacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgttattccattagttacttatgtttatttttatagttaaaaaatgactaaaggtggctaatagccacccgtattatgtgccttattcactgttcccacttaatataaaatgtcaaaaattggttgtttctttgcagggaactgtgaatgagcccattcccccaacatttaacttggttaatgaagctttcagagcattttctgaaagatttccaatttctgcatctcagatattgaatttaaattgtttgtgttgtaa

SEQ ID NO: 80481 - DNA, 1064 bp, Homo sapiens
cctgttctagaagaagtaatcacaacaagggagttgaaattttaagaaactgaatgaactaatactttactaggcattattaatactctaggtttttttacatatgattcttgtccacgtctgctttttcattactatttgttttcttttttttttcagacagagtctcactctgttgcccaggctggagtgcagtggcgctatcttggctcactgcaacctccgcctcctgggttcaagcgattctccttcctcagcctcctgagtagctgggattacagacacgcaccactactgcccggctaatttttgtatttttagtagagatggggtttcaccatattggttaggctgatcttgaactcctgacctcataatctgcctgccttggtctcccaaagttttgggattacaagcatgagccaccgcacctggcctgtccatgtccactttttcttaaagacacctgaagaaacttaaccactgctcagaagcatttttctccctctttcaggctgttatcaaagaacagcttcaagagactcagggattgtgtgaatatgctatctatgtccaaggtaagacacatacttcttgtcttcttgctagagaaatacacttttcctaggttcttgaaaaagatcaggcaattgaagaaacaagttcaagtacagtcatgcaccacttaacaatggagatatgttctaagaaatgtgttgttaggcaattttgtcattgtgtgaacattacatggagtgtacttacacaaacatagatggatgatatagtgtactatacacatgatatagtctgttgctcccaggctacaaacctgtatgagcaggtgttataccgaatactgtaggcagttgtaaaacagtggtaagtgtatctaaacatagaaaaggtactgtaaaaatatggtataaaagataaaaaatagtatacctgtatagagtacttaccatggatggactggaagttgctctgggtgagttagtggtgagtgaatgtgaaggtctaggacattattgtatactaatgtagactttatgttgtatact

SEQ ID NO: 80482 - DNA, 1120 bp, Homo sapiens
tgcctataatcccagcactttgggaggctaaggtgggtggatcacctgaggtcaggagttcgagaccagcctgaccaacatggagaaaccccatctctactaaaaatacaaaattacccaggcatggtggcacatgcctgtaatcccagctacttgggaggctgaggcaggagaatcgcttgaacccaggaggcagaggttgcagtgagccgagatcacgccattgcactctagcctaggcaaaaagagtgaaactccgtctccaaaaaaaaaaaaaaaaaaacagtctggccaacctcacccagaacagaaatgctctggcttttttgagttctcttgactttaaaaaaaaaaaaaaaaaaaaaaaaagcagctacagttaccagataataaagaaagaaaactaaaaatccccagtcatggttttccttctatttttgttaatttgtcacctgataaggtcaaagtatctatttgataagaaccatctctgccacactagtactgttccacattaatgcctctttgcaggaaatgagctgggtatcctcatctcccgtggagccaacctcccaagccaaagcccaggaagacccagggttaagctcctgattccttttaaagaaaaatgaaatagacataaaggccaccacagaggcagggctggaggcagaatcagctgaccaaggaacttggcaaatgtgtatattggggaagagggaaaagccccttggatacctgggccctgggtcctcagccagagaatcaatggagctaaaagaatcccattcacattcaggaatgttgaggggacagaaaacttcttattctagataaaagtatactttgccttctctctttccaataagactctggctgggaagaaagatcaaaagaaatggctttgccccaaagccctaagtgctcacttgtatctgtttctctcctcacaacaaaataacagcctccaagaccagagttatttctcatatatgctctttcctggatagcataagaatttttttttttttctgagacaggatctggctctgtcacccaggatggagtgcagtgactcaatctcagctcactgcaacctctgccttccgagttcaagcaa

SEQ ID NO: 80483 - DNA, 1037 bp, Homo sapiens
tcagtaagcctgaatttccttttattattattctaggaaagtttttctcaggctgttattaattgatgaactcatgctgctaggaacatcaaagccagaacagccatgaacgtgtaataccttggatttggatgatctgggcttgatttttaaaagtctcctgagagcttacttatgactcttgggagctaataaaagacatacctcagagtcaaattccagagagctattgtccttgagtaggctgactttcttctccatctcctgatattgggccagggcgttcttcttctcgccctggttgtacagcagcacagcatagttcaggtttactaaagggttacacctgtggcagacagagattctatggagctgggggctctgcaacaaatggtcatttagagatccttctcattacacaaaaacaaaacaaaactggttaagtagagatttctccattatgcagcaaggtaggtacatacgtgctaagcagacctgtggagaagaatcaaggagttaatggcctaacaagcaaagctggtattgggaccaaatctggcatctcagccctcaacagagactacctaggccagggttgaaaaagggatctctaccctgctgtctagaagatgccagcggagtaaatcctggaagagtcaagttttatcttgaattaaacagcccagagtcccatctgatattccagctagcccatagctatcagcaacccaagcccactgccagttctgacattctctagcctcctgattactcagtttaggactggaaacattttctcagagtgtcaattcctgctgagccaccacatacttaggagacacatccctccacactgaggtctgctatgtactaatgccatagaggaacagctgggctgacacaggcagcaccaatgctatgtatggcaccacctcatggctttggagagtccaacccccgccagtaccattctcaacaaagtgcatacttatccaggtggactgcttctgcgtaggctctcttggcattttctatat

SEQ ID NO: 80484 - DNA, 1093 bp, Homo sapiens
aaatcattcttttttgctgttagagttcaagaggaaaccccatattttctggaaccagtgggactgacccattaactataagggaagactataactgagaaataaagcaacagtcaagtttgccttcaatgagtcactgaaaaatatttacgtgtcaacttctgataaagcagtaaaaattaaacattgcataacaggatatacttaataacatattgctaaaattggaaagaccagtgtatagaccatccaactaagtctgtgagtagctgttacctactacatagctcgccttaaggaaacaagtgccaatttagccaccctgtgttttttttctccccttgtggccaatactacgttggacatatgagtctgaagagaacctcactgaaagctataatctctgctgacagacacatgtggcttgtacctgccaggtcttcatggagctctgtatggtcctacctgaggggagcgtcctgtatgcagctgctgaagacattgcctgtcctagagcttgattagagcccagaggctgctggaaactggcaggtttgctggttgaagtggtctggtgctttgatttgggatctttaactggtttggtccagaccagtgcctccccaacctggagagcagctcccaacttctgagccatctccaccatcttgtgtccacaaaggaagtaaaagaatcaaaagcgtgactgtcagagacaagccaacccacttctttggtcttcgagctggggttttagctgaaatagtgtctggtcgtactagcagttgaggcaggaagtacttatcaaacagtagagattacagattgcctttactggatggcatggtggttcacataggatctcaaaacccaacaattcaagcctggtgcattaccgggccaaacagtgcatttcctacaacaagtgaaatagggctgggcacgtggatcacgaggtcaagagatcaagaccatcctggccaacatggtgaaaccccgtctctactaaaaatacaaaaattagctgggcgtggtggcacgcgcctgtagtcccagctacttggaaggctgaggcaggagaattgcttgaacc

SEQ ID NO: 80485 - DNA, 1343 bp, Homo sapiens
ctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcaggaattctgtctgtaattgatttttgtctccatcaccactctggaaccagataagataaaaatcattctgatcttcatttgtgatgtgcatgttactttgctcttgaggtgcttgcagtc

SEQ ID NO: 80486 - DNA, 5163 bp, Homo sapiens
ttgttgcagacaacatcccatgtctgtttgcctgcacaaggtgtgagtgagtaaagaaagtgggggtagggtctgctttggctgccatagtagcacaataccatagacttgggggctcaagcaacagaagtttattttctcacagtggagactggaaagccccagaacaaggttccagcaaggtgtggcttctggtgagaagtctcttcctggcttgcaggtggccaccttctcaatgtgttcccacatgtcctgtccttggtgcatgcggtggggggagagagattgatctctctctcttttcttataaggccaccagttctatctgattaggacctcacctcacccttatgacctcatttcatattaattaccttccaaaagccctatctccaaataagccacatgggggtttgggcttcaccatctaaatttggggaggtgacacaaacgtgcagtccgcagcagagggaatgagatgtagcagctgcataggtgcctgacggctgtgacacagttcttttgtcagcctctcagttctgggtacattatggccataccctccagaggccttagccctggtgacatgccttctgccgcacacctccagaccaacagctttcaaaattagatttggattccaatattttgttgaaatgattagaatcagcctgaatgtactgtcctggggtgctgttgaggttctgtggggaaaggaacggggctcctgatggacttcgtgttgcttgcctccaggttcttctttgcggtccagttggtccaaagctacatgagcttcttgatgacaatgtctttgttccaccagagtcattgcaggaagtggatgagttccacctcattttagagtatcaagcaggtaaggaaatgagtaagtaatggtggcaagaccagtcaaggggctgtgtattgtcagattggggtgtgactgtgccggaaatttatctttgtaaattagcaggatcctgtttttgccatactgaaagtttcctgacctattggttctactgagctgatactggccgttgtctcaagggagactgagtattataacatggaagaaaattcccaggtctacaagcagaattgctccgaacccaagataaatcaggtcataggaaagcaagcatctcaaataaaagtgaaaacgtgttaaacacacatatataaagttttcctttatgactaagacaagagaaaggcaggtagcatccattcaactctgtgctggattctgccctaggcctttctgactgactcttccaagctgcttggggttgattccaagcttctggcaagtttctctggagcattttatttttccttgggtgtgtgaatggaagtgttttgtatttaacatcactatattgtttcccatcagatgttctaatgttaataaatccacatccactgcatcccatcccctcttcccagcagattttatatgttacgtagattaggcatctggtttctgagagaatattaaatacttggacatactttgatcctgtgtatttcctgctgtaattttccctctgctcagaactcagactcttgagtttctgattcaacacattgttaatacacattaaagactcaagcatctaaacagactaattggtaccttaaagcagcacttaatactcttcagtgaactacttccaagtcaattaagagaatcttctctactagagtaattaactttaacataagatatgaactatgttatttcttgagaattatgcctttctccaggtagaaaaaagagttgtaacatgttctggttctctttcgggtgcttactagaatcagttgggaattaaagaaggatagggtctgaaaattagggacacagcgttgacgtaggcaattcatacttaatgctacacaagtttttgagtttctcagctttagttttcccaaatgggaagtaagagtaatagtttttactgcctgatcattgtggtaaggattaagagattggttggtgtgcggaaacattgtgagcagcttggatgaaaagatgacctggccgcacgtggtggctcatgcctgtaatcccagaactttgtgaggctgaagcgggtggatcacaaggtcaggagttcaagaccagcctggccaagatggtgaaaccccgtctctactaaaaatacaaaaattagccaggtgtggaggcgggcgcctataatcccagctactcagtaggctgaggcagagaattgcttgagcctgggaggcggaggttgcagtgaactgagattgcaccactgcactccagtctgggcaacagagcgagactccgtctcaaaaaataataataataaataaataaaagaatgacctgactgtggactggaagggtctggaattgctaaagatgagcccctgaggtattgctgccatgagttccagattcgtgtcagtttttttggcacccacagcaggaactggggacctttgtgattcctggtttgtcatttttcctggtgactacagagtggagagtcttacgtcttcagcaagactttgatgttgtattggacagctgtgcctcgtatgtagttaaggagacagcacagttcaccgcacaaagagagtgtctccatccttgggtttataagcttcacacttcagtttttctttcctatgcctcttctgcatacaaagcagtggacttccattaaactttgtgaggtgacattttcctaggtccaaggagggagcctagtctagtggcagtagccctgggctcagctctctcaacagaaatccattcccagcttgtctctgacctcaatagggaaattccaagggatttgtccatttttttttccacattctctcttaccagatctccccagagaagcccattgtcaggcttgggctgggaatccagtgagtcactacgcagaggttttgctgacttactggctgagggcaggatgatacattgagaagagattgcttacaggaatgaatacaacactttgtgaggaaagaggggcgctaactaccattacaggcagaattagatccatttgcatctgccccctgcatggcctctccaacggggccatgaatatgctggaggtgtttgtgtctagcctggaggagtttcagccagacctggtggtcctttctggattgcacatgatggagggacaaagcaaggagctccagaggaagagactcttggaggtaatggcactgttacagaatttcacagatctcagctggtggttttcttcaggttccagcctctcttggcatctgctgccttgtttcctgtggaaacagcaagcagctctgcacggttcttctcatccttgccttgcagaagagcctgtttatttttgcctctgtcacttcctgaagaaatcagtgtattttcaatacagtgtggctcctttctcctaggttcagttaggtcgtgtttcctagcagtgtcactattcaagggttgagtccacgtcttgctctctggagaatgtcaatgtaatgtatttttcccatcgtacagagtctttgttgatttgcaaaatgttggatttggggttcatacccatattttttgttgtcatgggcatttaggtcatcagtctgttctcttatttgcttgttcttttgttaattcattcccatggctatatgccagacacagcatgatgcagaaggaatacgacagaggatgacacaggccctgccctcagctcacagtttactgccagagatagacacttggaaaaagtaattgcaggccgggcatggtggctcacgcctgtaatcccagcactttgggaggctaaggcaggcagatcacctgaggtcaggagtttaagaccagcctggccaacatggtgaaactccgtctctactgaaaatacaaaaattagccaggcgtggtggcgggtacctgtaatcccagctactcgggaggctgaggcaggagaatcgcttgaacctgggaggcagaggttgcagtgagctgaggtcgcgccattgcgctccaacctgggcaacagagtgaaactccatctcagaagaaaaaaaaaaaaaaaaaaggaaaaaagaaaaaggaattgcaaaatcatgtgcctcagtcctgtattagggtacagtggtggccccagaaaggaggtaatcaagtctgcttaggggtggtaggattaggaaaggcttcatgtttagggaggaactagcacttgaacttgggtctttaaacagtcattcctctaaagcaactcacatagaagcaactggagcagctagatagtctgatcctttggatcaggtgcccagaaaccactgatgggcagcagggaagaggagatgcagtgagcttggctgttgggaagaaattcagcctgcttaagttccaactgaatgaaagatgctcagggcaatgctgtgaggaagaatgtgctttaaacaatgacagcctatactgtctgcagggcgtgcgtgctgcacactgtatgctggtatttggaagtcatgctgccattctgtactgtctctcctgtgtttgagagctcaagtagggctctcctgggactcagggggagctaattaccttgaaaaaggcatatagcacccatactatgtttctgtttcttggctgggtttgggtttaggtttttggtttgtttcttgcagtgccatgctgaccttaggccattgttgctggggtctcctcagccagaaaccagcctgcttggagccaaggctcctgtgaggtgcctgaaagtgcccccacagctaggagacctaaagcctcttccttttcttcccattgtgttgactgggtttttccaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggtaatggcactgttacagaatttcacagatctcagctggtggttttcttcaggttccagcctctcttggcatctgctgccttgtcttaggtcctggcctcccagggacatatcttggcagctggctgtgg

SEQ ID NO: 80487 - DNA, 1049 bp, Homo sapiens
tttccatctcatgtcattctcccttctgccagaaggacttcttttaacattgcttgtggtgcgagtctgctggtgataaattctttcaggttccgtatacctggaaattcttttacagtaatatgctaagacatttgtagggcttactaagtttattcctgtttccttttttttggagacagaatctcactttgtcgcccatgccagagtgcagtggcatgatcttggctctccacctcccaggttcaagtgattctcctgcctcagcctcctgagtagctgggattacaggtgtgtgccaccacgcctagctaaattttttgtatttttggtagagatagggtttcaccatgttggccaggctggtctcgaactcctgacctcaggtgatctgcctgtctcagcctcccaaagtgctgggattacaggcatgagccaccacacctggccagtttagtcctgttttttagggatcgtcctttattgtctgatgttcacacaatgttttgaaaaccattgtttcatatattttgtcttttttgttgtttcaggcaggagggtaaatatggcctatggcccttgttgtctcatcttggaagtgaagcactagccaagaattagagaaaggaagtaaagtggttggggcaagactttttcagaattggcctgtaatgggcatgtgtcaaggcagaaaagggagaggagtatgtttttatccagaaggtgggatttcttaaataacacgaaagtacctctgtacaaagcagtctatataagcagttaattagcaagttaatgccttttgaagcttctgggtgggacatactaaatctgaaacagaccgagtatgttagctcatgcctgtaatcctagcaagttgggaggctgagttgggaggatctcttgagctcaggagttcgagactagcctgggcaacatagtgaggtcttgtctctattaaaaataaaaataaaaaattaggccaggcgcggtggctcatgcctgtaatcccagcactttgggaggccaaggcgggtggatcacgaggt

SEQ ID NO: 80488 - DNA, 1277 bp, Homo sapiens
ctgaatgatttttccacaggatagtgaaatttttcttcattttagaaggactataatgtagacgataagccctgtccacacttttcctgtttcctgtgtctcttctggctgtctgtaagctcagagctgaatttgatcaacagttaaagcaatcagactcattttcatggttgtcctatttattttcttcatcttattactcactttctatttctgtgttgcattcacttcatctgtgtgtcctttgatgtaaaatcacctcaaaatgtttttgggaaatggactataaattaatttttaaaataaaaaatgattaaacttgggtgatatagttgtattaaaatactgtctaaaagccttgaactctcttacagcactatgtaggaggaaatgcagctttaattggacagaaatttgcagccaactcagatttaaaggtaggtcaagtttttagattaaaacctatgcctttccctagtgtttcaataattttaggagcaagaatgagtatctattccttgattcaacttatggatcacctactatgtaccagaccctgggtcttttgttaggaagcagtaatagtaggagatagtagtaactaatactttgagtgtttactctgtgcctgacattgtctttagtgctttgcatagattatctaatccttgcaacaaaccctgtaaggctagtcggtactgccattgttcttcctttctgcatgagaaaacttgaggcacacagaggttcacaactgattggtaatggaatgagaaatttaacccaggcagtctgacccaataacccatgttcttaggcaccatatcatttaatagttaggagcatgtgggccttgagactaaggattatacaagtcatgagggaaaacaacggttggccgtgttggtgagcctggatccagagtgccaaaaaataaaagccactagatgagagtcagtaggggagtgtcttcaagacttaaattgtttggtttaagtagaattaaaaatcgttgccatgttcacagtaacacctgagtaagaagtttctcttgctatgagtagaataggcctgaagggggaggccaacaagaaagttatcgctgttttcctgtataatgattaaggtttggattagagcagccagagaggagaaacatgtatctaaaacctactacaatacatggggaacaaagaagagatttatcaaagatgattatggagtaaataaccttgatcagtgcagaatggttgtggccgctaacactagaaaacaga

SEQ ID NO: 80489 - DNA, 1042 bp, Homo sapiens
gttaaagggccaaatttcagcctacatatcacagaaagttttaaattatctctaaaaagctattactgtcccacctgaattcagaggttagtcagcacaaaattgggataagagtgatgtctaccatctagaattgtttactccaaccttgtccagtctgcagcccaggatgcctttgaatgtggtccaacacaaattcataaactttcttaaaacattatgagatttaacctcccccccaccctttttttttaatagctcatcagctgtcgttattgttagtgtattttatgtgtgacccaagacaattcttccagtgtggcctagggcggccaaaagattggacacccctggtttagtctatgcctctgcgtgggctgaggactaggaagctgggatagtagcattccacccaggtaacactatcaggcttttcaacttttataatagaacagcagccttagctgttatgtgtcagatttccaaggcatatggatccatccttagcaacatggaacaccaaccttgaattatttgttctccaggtcctcagctgagagatgtggtgtttaagggaaagtactgtcctatattaggggcccattatctttagaatttactcccaggaaaacttttatgtttcccaacacatcagtgtgtttcttcgtttctcaaaatttagcaacaaacatttactgaacacttcagaagaagacagtccctgccccgaaggacctagttgtgtacccagatgatagtagcccaagcagacaagagctgcattagaggtttgttcaggttataggggtaggaagagatctgtaatcctatctggtgagggcggttgtgaaggctgagatgtcagtggggtgtaaggggaacagagaaggcattacagaagaggtgacactgcagctgattcttggaaagtgatcagggttttacctagtatatgagaaagggagggtgtcctaatggaaggaaacagcatgtgccaaaggcacagagacaggggaaggctgacttggagagctgtaagcag

SEQ ID NO: 80490 - DNA, 1034 bp, Homo sapiens
tgctttcacacagtttttttcctccttctagagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcatcagagttcccaggagcccaggtctgtttggttcagcaatagtaaattaagggtggaaaaagatgcctttttaatatggttcctagaagcaagcaagcaacttttcattccagtttgaagaggaggggagcaaaatcacccctggttgaaaactgtgggtctaggttgatggttctcagacttgagcatgtgtcagaatcatttggagaggctgttgaaacacagatttctgggcctactaccagagttcagattcagtagatgtgggatgggacccaagaatttacctttccagcaagtttcctggttgatcctgtaggtctgagaacctccttttgagaaccactggtctgcaaggtagaacctgtcgaagttagaaccttagtggtttccaagttcacctggtgattatatacaaagccctgcatggtccaggcacttcctggaggttcacgtggaataagaggcagtgctggggctggagacccaaccatggctcttcctacctcaccccagtatgcctgctcctacatgtaccctcatgcctcttgaggctgagttttggttggttggttatctcccatgtcttgcccccaccccattcttcctcctcatttaaacctccctttggctgggcacccagtctggtttggtagttctagccagggaagctcttaatgccatttttaattggcacctttcacaggcaaacctttgtgactacttttattttgatgacttaagattttaggccgggcacagtggctcacgcctgtaatcccagcactttgggaggct

SEQ ID NO: 80491 - DNA, 1047 bp, Homo sapiens
actaattagcgatcttaccgcattttgcaaataggtttaatctatctgaaaatgcctgcctagcgtggggtgcttcttaaagatcagccgcctttcttctatctagatgcaggagctagggttcagcacagggaccactgccctagccatttttcccccgcctctttacagttctatgtcttaacaattacgattagctcttataacagctgatgcacataatgtaaagctagagaaaaccttagaaaacattttacaggtgatgaaacagaagggaggagataggaaacatcgtctttgccttagaggcacttatggtctagaagggagaactgtgccctctttgccagccccccaacccattttgacattcagcatctgttgtcttgacctattttctagttgtttcatctgtgttttctccaaaatcacagtcatctaatatacattttttactgaagtgtgagcttctgcttgcatgtcagatgagcataattttgtcttctgattctttaactgtgtctccctttatttccccttgacaatacagccccttaggtaatatgctttttacattttgggatgctattgagttgagaaagtgcagagaaagattcttattctggttaaagtattataaaacagaacaagaaagtacatgtaaagtacttgtttggcatccggcatgtagtagatgttcagtgtttttttgagacagggtcttgctctctcacccaggctgaagagcagtggtgccatcttggttcactgcaacctctgcctcccaggctcaagtgatcctcctgcctcagcttcctgagtagctggggctacaggtgtgcaccaccacacccaggtaatttttgtattttttgtagagacggggtcttgctatattgctcaggctggtctggaactcctaggctcaagtgatccacccgccttggcctcccaaagtgctggggttacaagtgtgagccaccgtgctcagcctggttttttttaattataaaaagttatcaagtaaactgtgaaccagtctgaaaa

SEQ ID NO: 80492 - DNA, 1045 bp, Homo sapiens
tagctcactactttctgtggagtgttggggccgggaggggtaaagtagagcaaacttggcctgaagattaaatgacatcattcatgtaatctctctagcatagtgcctgctttaaaaagcattcgatattagctataattttggggtttttttttttttttttttttggacacagggtctctctctctgtcgcctaggctggagtgcagtggtgcaatcactgctcactgcagcctcgaactcccgagctcaagagatccttctgcctcagcctctggagtagctgggacgacaggcaagcaccaccacgcccagccaattttttatttattttattttttttagtagagtcgaggtcttgctatattgcccaggctggtctcgaactcctgagctcaagccagcctcccatcttggcctcccaaagtgctgggattaaattgtccttccttgctttatgcgcgttcattcagcagatattcaccaactacatggttagtgtcaggtctgtgctaggttcttaagatacagagatgggtgaagcaaggcccctgtctcacttgttggaaacatattattgtatcagtcatttgggctgctagaacagaataccacaaattaggtggattaaacaacaaatctgttttctcgtggatctggaggctgatagtccaagatcaaggtgttggcaggattggcttccgatgtggcctctcttcctagcttgcagccagctggcttttcagttagtctgcgcatgtacactcctggtgcctcttattcttcttatgtggacactaggtccttttggaatagggctcacccgtatgaccttatttaaccttaactacttccttaaaggccctacgtccaaatatagtcacattgggaattagggtttcagcatatgaattggtggggggtggacaattcaatccataacaattatggttagaagaggaacaacccacgaggaccaggcagaagccttaatgccttttacgaccttaccttagaagcacataggaactcttctaccagagtc

SEQ ID NO: 80493 - DNA, 1035 bp, Homo sapiens
cgtggggtcccccctcgctccgtcctggcgccgcccgtcgccccgccccttggggggccccgtggcgcacccttgtgacgtagcgcttgtgtcgacatcggcgcgcgccgagcccggaagaggcgcgggctaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggtgagtgccaacggggcctgggtctctgagcctccgaggtcggccttggaggtcgggcggagccgcgcagaaacagggcttctcagaggtccccgggaggcgctgctgtccgcgctggccccttggcgagaagtgtcggacgtctgagtggaacccggttcgtcaccgctgctctttccactcggctggcctctgcgcctttctctcatcccggtaggaccagccctaacagcttcttgctaatcccgctttgtctgacacctttctccgagccttcttcctcgttccaacttttagccccttctcttctggcgactgttgttttgcaatcaaagatacttgaccttacccactatgacaacactcttcctctttcttctgaacttcttgaagacgcgtgatgtctgcctttacccactttcgaaacgccgtgtagtctagaaaccacacgactgtactgcaactcctctcagatttgcctttttgaatcttcattatctactctgcagccttccacgcattgaacacgcccttctccgtgaaattcttttcttcccctgacttcagtgacactgcatatttaaggttcttccaaatgacactacctcctttctttgtacttttccttg

SEQ ID NO: 80494 - DNA, 1054 bp, Homo sapiens
gcaggaacttctctgcctcggctccggttgccgaagagaaaggggatcgcgcgtggtggggaggagaagggcgagagggggcgccaccggggaaggggcggctgccggggggcaggtcgggggcgcaggggtctagttcccagctttgtacctggaggcaggttcacccctcgcctctctcccctcccccaggctcatcccacttgtaagagtgggacattcttgtgctcacactagcaccagtagaggccactacacacctcattaaataaacaatcagacggccaattcattaattttcaggaaaggaaaggggagggggcttgagctcctggttccctggccagggatttcccagcttccgaagtctcgaggaagagctggctagtctcgagggactcctcgcgcggggattggagcccgagtctgcggaagagcgggggtgtcagaggggcacaattgcccgctcacaacccctggtgttgatttaacgatgaggacgccttggagagcggctcggagtgatcgtatctgttagtgtttccgttatgaaatgcctcttctttcctggggattacaactatatttacagcctattaaccactcttaaccaagggaattgtctaagcatcagattttaggtacttgtacaatgttttcagatggcattgtataaacattgaacctcaaaagccattttcagttcttttttggaatattatagattactgaaaccacctgcattcctattaaggggaccaacgaacaaaaatgccaagccttccgggaaggaccttacggtattgttgagcaggatacactcagcagttgaaaggcaaattagcatgtaatctgttaaaattatttgaccaaggtggtgtaccataaaacttgacaaaactttcactcgtgtgagatatgatatttttacatttgaaagcagtcttaccgctgaaccagtacttgtttttccctgatttatatgaaataatatttaaaatcacactgcaaggtaacttgactgataaacttttcatttccttgcagagtgtgt

SEQ ID NO: 80495 - DNA, 1068 bp, Homo sapiens
tgggtaggagtggaggtggggaggctcacaggtaattagtcgtttaattgggtctagaacatagatctcctgattctcggtccagagtccttcctgtaaaccgctctgcttcattacaaaagcgagaggaataactgcaataaggaggggttggtcagttctgccataaaactgcggaagagatcaagagactggagaactgagtaagcagcaactggaacaagctgtccgcaaatcagatgtcctttgtcagtagttttattttttttatttttgtagagtgatagacttataaatctttttataggggattatagtgaatagattgtagggaagtggacatgttcagtagtagaaggtggagaaaaatagagatgtgggacaataggataaatggaaagtgtttttccatctgaggttatagacatacggaggtggaggaaaaagtaagaagtaaaggactggtgatagaaaatggtcagcaagggaggagggttggaattgagtaggaacataatctggtattctgaaaaagggcagattactgaaaagatatgtagagaccttggggaagatgacatggcagcagcctgtgcaatgcatgtcttctctatttagagtgaacattcttcaccgaggactctgtagcttctgcctgaaccatttatttcatgatgtgattcattgccttacagggtagtccatttctgtgttgaataacttctgttagaaaatgttgctttgtacagtacatttcactgtagttttcaccctccccacccttcttacattttttcctctttgcttacctttttcagcattactctatcttcaggttaatctcttctctgattaattcttcatttgtctttctggcttttcttgaactcactcacttaaatattagtatctaaagcttatctcattatacatactctgtttgccctcagttgccacctgtaagctaaggactctcttagtccacactttctcacttgccactcggtaccttcactaaataggatcttaggttactgaagtccgaagttaaactctgtgtcattttcc

SEQ ID NO: 80496 - DNA, 1129 bp, Homo sapiens
aagggatgtagagtaaattgaccaggttacagagctggcttatgtaaacaggttttgattccctgtctgacccctttacataaagaaaaggcagagaggtatggtggttatatatgttttattttactgaatgaagtcagttcttcagttctgaggagttagcaggttggtggtctgaagtgcagattacgtgtctctgcttttccttttttaaagaaccattagaaataaccttctttaaaattatttcatagcgagaatccttacatttaactttttattaagtcagttctataggcaaagctaggagttgcagtaattttggctggttgcaaacgtttatctttgagggctaattatgcacaaaactacactgtggaaataaagatgaattggacgtgctttctgtcctcaggaagcatttggtctaatggtggaggtaagggagatattaggtaacttgatttggcgagagaaagtgccattactgctgtaggtagaaaaatacattctggaatcattgtgttactgttgatcaaggaatagtgctgctttccctcataattttggttctgtatctttagagtagtcctaacttagttttataaagccagtagactagaattctcaagaaggagttatatatcatttcctctgattactgcagtgtttgaatgtatgagaatgctcataattgagctgtctgggggtacagctactcccatgttttttggaaatctggagattgatcatactgattttcagaattgattattggtcattaatagtacaacttactaagaagtcctgagcagagtgaatttttgtaatgatactatgtggaaattgaaaacagaatgtttctgtttttctgctgtagtggtaaaaaaaaaaatcaccaaaatatgtctttatttatgaggtctagttaagataatagcattataatttacaaatttagggatagaataacaaattataagtttcattcataattttttaattcacagcatagctttaaatgtaacaagtaaaatttgaaaatctttttggttaattgttgaaagtttttgaagttggaggtaggataactagttttgtttgtttgtttgtttgtttgttttttctg

SEQ ID NO: 80497 - DNA, 1035 bp, Homo sapiens
tgggctcaagtgatcctcctgcctcagcctcccaagtagctgggactacaggtgcacaccaccatgcccagctagtttcttaattttttttttagaaacaagatcttactatattgtccaggcttgttttgaactcctgggctcaagtaattctcctgccttggccccccaaagtgctgggattacagatgtgagccactacacttggccctgtagtcatatatttatgttatgtttgtagcacgtggttaggttttgttttcttttgcctgacagtttttgtcttcttactaaatcatgtctatttaatgtaatagttcatatatttggctttaaacctcccattttattatttacttctgcttgcactgcttattctgtattcccctttctctcttttcctgccttccttggattattttaagttactctgtatttccctctcttttagcttgccagttataatttctttcactattcatttagtgtttcctaaatgcatctttaacttgttatttgtatgatttcatggacagtgcaaggcctctataacacctgaattccatttgtccttctcttttgttttaatgttattatgttattgttgtgtattttagttctctgtatgtttaagatccatcagatgttatttcatactcactattcatttagttttagttatttaaattcattaatttattcatttagatttacccacgtatttcgtttgtgagttgctcttcattttttttttttctgcatctctgatctttcatctgggatcatttctttctgcctggagaatataatttagcatttagttaggtttgttggagatgaattttctcagcttttgtctgtctgaaaacatttgtatttcaccttcatttttagatttttgtggagagggtgctggatgtagaattctaggtaaacagtgtgttttttcaacactttacatatgttgttccatgtccactgaactctatcttttctagtaagaagtcaactgtcttatttttcttcttttgtgag

SEQ ID NO: 80498 - DNA, 1039 bp, Homo sapiens
ttaatttcattttattgaccttttcagttctgtaatttctttttatttctttctttcttttcttttttttttttttgagacggagtcttgctctgtcacccaggctggagtgcagtggcatgatcttggctcactgcaggttcatgccattctcctgtctcagcatcccaagtagctgggactacaggcgcctgccaccatgcccggctaattttcttattttttgtacgtttagtagtgacggggtttcatcgtgttagccaggatggtctcctgacctcgtgatccacccacctcggcctcccaaagtgctgggattacaggcttgagccaccgcacctggcctcttttttttttttttttttttttaaatagtttgcaggtctctgctgaagttctccatcttgtgtttttattcctttaacccactccagcatgtgtgttcccgtaggagttttgcttttatgtctgttttatcacctgatttgggagggtttcttttcatgttcttagttgtgattgaatgacaggtgttgtgtatgaaaaattatcgagataatctggatgatactgtcttctcaggatttacctttacttctggtaggtggttatgctggaggtactaacagtctcctaccacattacatagggattgaggtgatttaaaattaggctttagactctatgagttgaaatagtttaggtatacctttagttcttagatgtagccctttgaggctctgatccacagtttaaggggtttaccctccctcttggcaggccctcactccagtttttgtccccttagggcttgggtctgtcgaaagctatgctcatctcagcctcttcagcagtagcctttagaatctgccgatagctctaggccaaaaggagccccacataccagatttgtccctttggcttttctttctttttgcatcttggttcctcaattcctcattgccttgattgcctttacacagatattttgtgttttgtctagtttctttagttattctcagcgggagaattggtctaa

SEQ ID NO: 80499 - DNA, 1041 bp, Homo sapiens
aataagtgaaggaggtctcttactataacagtgtttaattcaccatttcaacaaatctctccctgcagcctactaagctttttctttaattaagtacctgatttacacagcagattttactcatttgaggactcaagtcatgtctaaacagataaaggtatcagctcaggcatagttcaggtaccttgtaaatgcaatcagagttgttctgcagggtaattcagttttagacatccatttctaaaaacgggttctgtctgaaaatggaggccttaataaccaatttctcgttattcagaggccagttatctagtttatttatcaagattaggcagtcaccttgtttttcactcctttctaatctctctgactgttttgttgttttaaactcatgagtaagataaggagaagaaaaacagagaatgtacataaattaatggctaaaatgaagtgttcctttgcatgtttctttttcttatgctttatttctgtgactcatacggagctgttagaagtgacttcatataatattatacagtgtaataaaatgggttttcgatgtgtgaggataccctcatgttatttagattatggacacaattaacaattccagacagaattattttctcatgtttgaagtagtataggcacatggccctttatgggaggggggaagctcttctctgtgtgcccacttttcacatccctctccagcatgactctcccctttctgtcagtcttaccccaggagtccctggcctccttcctctccttgacactgtttgctttgcaagcatatgaaatactggcaccctatgaccagggtagactacaaccagggttggggtgcaggagccagatggagaaattcaaattatgatcatgagaacatgttcctctaggtagtggccatacttttatctctatatccttaggacgtaacacagtgcctggcatataatgtgtctccagaaatattttgtttttgaattaaagactatttcaaaattacagagtcataggaggaatcatttaatttat

SEQ ID NO: 80500 - DNA, 1025 bp, Homo sapiens
tctctgtcctttctgctaaatgaatgctacttactatttttccagtgcctagaagagtgccaggcccatagttgattttcagtaagtattggttgtatagataaatagaaggtactgacagtaagcatgagaggacctctgagtggtgtggcatttggagaaggcctgggatcttgtacagtgcaaagcttaagtaacttcattctaagtttgtatttccaactcccccaacctcagcatgttctccccacccacctcctcacaccccaaagcagtccctgtcttttgttaactgatttttttctttggaagcaagcctgatctttctcacatttattttgctactgctcaggctaccttcttttcttatctctacctttcctctttctcacaacattgctgttcctcttcaaggatttagaaggatcatgttttggtttataagacaactgtgttttcttaggtccttcttctctccagggattattgtaggaggtaaggcactttctgtggaagaactgagttatcagaaaaagttcagaaacatattctatgattatttagaggaaaactgtaggatagtgatatcttataataacatagcaatttttttaaattaattaatttatttattttgagacagagtctctctctctggcacaggctggagtgtagtgacatgatctcagctccccagaacctctgcctctcaggttctagtgattctcctgcctcagcctcccgagtagctgggattacaggtgcccgccaccacgcctggctaatttttgtatttctagtagagatggggttttgccatgttggccaggctggtcttgaactcctgacctcaggtgatccactcacctcggcctcccaaagtgctgggataacaggcatgagccaccgttttcaggttgtcataactacattctaattgactgcatatttttaaacacaaattaaactagttatgttctccaccctactcagttttggcagtataaaggcctgtttcacagaga

SEQ ID NO: 80501 - DNA, 1375 bp, Homo sapiens
ctgggtgcagtggttacacctgtaattccagcactttgggaggctgaggttggatgattgcttgagcacaggagttcatgactaacctgggcaacatggtgagaccctgtctcttaaaaaaaaagaaaaattagctgggtgtggtagcatgtgcctgtggtcccagctactcaggagattgaggcggaaggatcaattgagcccaggaggtcaaggctgcagtgagttgtgatcatgccacttgcactctagcctgggctacagagcgagaccctgtctcaaaaaaacaattaataataatgtaaaaaagactgcactgagatggctaaattcttaggactgagttctttagggatggactaactggttggtatcattgcttacaaaaatgttttgaccttgttggggagcttgtgttgagaaataaagacgatattttaaatttttatcttttaatttcatttttccacgaacgttttgaagtcctctcatatttggccagtcagagcctcttttttttttttttttttttgagaccgagtcttactcccatcacccaggctggagtgcagtggtgcagtcttggctcactgcaacctctgcctcccaggttcaagcgattctgctggctcagcctcccaggtagctgggattacaggtgtgcgccaccatgcctggctaatttttgtatttttagtagagacagggttttgccatgttggccaggctggtccggaactcctgacttcaggtgatctgtccacctcagcctcccaaagtgctgggattacaggcgcgagccactatgcccagcccagagcctcttttgagtgtttgagatgaccttagtggccattgatagttttattttctattatgatgagatgtttcatattcatctcattttctaatcccagacctggaactagccttttttttttttttttttttttgtaagttcttttcagtggaaaatgatgcgtagagaccaaaacctgagtatggaaagtgctcattgccactgggttggtcatcattactaggccttttaagtgaagtgagctaggaaatacctattttttaaagtagtaaaatgaatttatattagtacttaaaattgaaggctaaaagattatactttaatgttactgatttttacatctatagtgtttttcttctacaccaagaatatcatgttctccaaatcagtaaagttactcatttgctttatcccacaacacacacacacacacacaccctcagaataacaatactaatgctaactgcaataaaatggtcattaaaacagcttaaatttttttgcagttcttttggtccttagagtatatcctactatgtatagtttggttactgg

SEQ ID NO: 80502 - DNA, 1083 bp, Homo sapiens
aaccaggagcactaactgttacgtagcaaagcagggtggaaaatgtttgttaacgcttaagtgttgcctgctcttagttaataacatgaatgttgttgagatctttgaatgttaaattattttaattttctaattttctaaggtagttgagaatttgaagcaagatagtctgaaccgcatagtgatagtggacactaaagaatcaagatggatgaaatgtaggatttggagactgacgagaagggatgggatggttgaaagaaacattaacaagtagtaaaaaaagaaaaataggaagtcctttgacagtagtgtcttagcttatgataataaagtgatacttttcttacaatgaacattatacagaatgcttgcatttgtaggtatataaaaatgctacttatccttctgccctgagtttctgctactactaaactttgaacctcttttggcaataagacaggtttcattttacttctgcaagtattcagataccatatgttaatgttttactctgggtacaataaagtttagaattattactggtcacacacaattaagacatgcaccgagggatatgatttgttgatgttgttgggagttacaacagaaaggagttccctgtggatattttctttctgtaagatggaattctatcaagaagtgtgaagtattctatcagaatgtgaggaatagtctatcaagaagtgagagctattccattaagacgtgagaaatttgaagagacttgggaatgtagaagatattagataggatcattaaacctatttcaaaatggaatccagtgactctggccatactaaaccaaaattaagcaaatataattggctgggagtcaggtccctggggagaagtataagccagtttttatacaaagtcagctaaggagtgagtgtttgataacccttttattgtaacaaaaagtgggtaaagaaaatgatgatagatcttttagaaaataatctcctgttccaagcaaaggattgttctccaccaccaccaacaaaatttttgttactgaaaaaaaagataagaagaatgtgtatgcaattgttcatatat

SEQ ID NO: 80503 - DNA, 1102 bp, Homo sapiens
aactgataaacataaaaagatacctcttaagaatcattttaattttctgcctcttttatgttcaacagagaatttcactttgaatgcagtaacttaaagtatttataaatctgattctagggtttgaaataaaacttttattagatactcatgtcatttaacaaggcttgtttatctcaggtagaaggtttttttttcccctaatgttcttctaaatggctcaaagtttggtttcctacttgaaagtaaatcttatttattagacatttgtagtgagatgactatatttatgtgtcacattcaaagaacaacagttaataatttttggacttgttagtaatatattttctgacaaataatagaagagagatttgcttaactttgttctttttctttatttttgtaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtaagttttaagtgatttttttttttgcattttcaaatatttataacatacatcttgataaaagcactgttctcttggagttttcttttaattagtagcaacaaatatactcatttaacagatatcaattgtgcatatactctgcgtatgggaccttgctgtagggcttgctcagtgccgtagagaataaactgtagcgtgtttccacttgtctgatggcttaatattgctatcagaagtactgagcagttcttttctccttttaaacttggaagtggcagaggaagtggtataggaaaattaaatcactttgacggccaacttctatcttacccagcataaccatttagtatggttttgtaaaacttgcagtaaagt

SEQ ID NO: 80504 - DNA, 2892 bp, Homo sapiens
atatgtgtatgtgtcttgagacacggtcttgctctgtaacccgggctagagtgcagtggtgcgatcttggttcgctgcagccttgatctcctgggctcaagtgttcctcctacctcagcctacgagtagctgggacaaacggtacacaccaccacatctggctaatttttttgtattttttttagagatggattttgccatattgcccaagttggccttgaactcctgggctcaagtgattctcctaccttggcctcccaaagtgctgggcttataggtatgggccacagtggccagcgtgagatgtatattattagatcttgtcacacctttgctcaaaactccctaatggttttccatgtcattcagagttaaagttctgggctgtaaagatttataatcttaataccacttccttcctttctctcccctatcccatctcctactcttttctccctcactcgaagattgtgatcactttatgtttctagaacaatccagatatgctcttggccattttctctttctggaatcctctttcctcagatacctgcctgggtcactgtcttacctctctgctcaaatatcgctttatcagtgaagccttccttgaacactctgtttaaaacaacaatctttgatttccacccccagtgttttctccttctaccttcattttacttcagaacatattaccatctgacatgttctatcttacttgtctctctccctcattagtatgtaagctcaaccagagcagggaatttttgtctgctgccaaaaacactttctggcacatagaagccagtaatattggctatgaatttgtttaattgattctatcaaaattcaattaaatatacctaagtaattcaagttgaattaaaaaaaagaactattgccatataccaatattattcagtctgcttgctcacttgcttttacatgacagaggtaatacttctcaacacctagggtagcatttaagcaaatcctcaaaatctgaatccaagaaaacaagatttgtagtgtcaaaaggtgagatcactactcaacatctgaaacgaaaacataatgtggaatgttttgcttacttaagtaagggagagttgtgcttgtcaaacatagttttcttgagcaaagctaagtccttatctcctatagagtttttcagaagacattgttttgggttgtactggttaagagacagaggtggattaatgtcagtcatagaaatatgttttgtggttgattacggaggtgggagcaagttaatgtcagccttaaaagtcagtgactccaccattagttggctgacttttaaagcctgggcttatcactgattggctttcaaagccacattcacccttgtgagttgtcactaatcgattaggcaatgtttccttgttaccatggctacaagactgtcattaattggttagacaagtttaaagctagtcctggaggttgttatcatggctgtagaacatcttttccaaagcatatgggcacaagagtcacatctcttctgcctgagacctttttgtcaaaactcaatattaagttaatattaccttattgaggagagaactctgtcttctgcccacaagagtgtggccttttcatgtattcacaagaggacaactctataaagtgaacacacattaattctaatgtctgaataagaaatacaaaaatatagtggtagctagattgttgctcagttacaaaatcaagggactgacagactgagcaagttaaagagacgaaactcagaaagcttttcagaaataacacacagatacagggaaggaaaggaaacctcttatccctgtgagtaaggagaatgccatgggtcctgagcttgctcagtctccactgtttgtacacatggcttttatcttatctttcaatgtgaatgggattcatgtcaaatatctctcgattgattgacaagtacgtaccctgaaggcaggagcaataagttatacatccttaagacccctaaagagcctagcacaatgctttgcacatagaatttatttgagaagtgtttgctaatttgaatggaaatttttgtatcacttttgcttaaaatattttgtcatataaagccacacagactgaataagaaccagtcattcctcaagattaaagcagtaaagtgctttgtcgtgtgtgtatgtggtaatgatggggtcttgctatattgcctacgctggtctcaaactcctgggctcaagcagtcctccctcctcggcctcccaaagtatcgggattatgggtgtgagccaccatgtccagcctgttttgtcctttaattattgtctttgttaattttttttttttttagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaaggtaagtgttgtctgcctaaaagccttcttcagccttagcttgagactttgtcatatcccatttgggactattgactaatttaaaaagattatcaactttatttaaacacatcataatgctcatatgtcatccttcaaatatgttcatatgatatatatgatgaggatatttaaagaaaaagatactttcaaaatattaagagataattattccctttgttcctgttgaagccgcagtgtactcagcttaagtcttcaggattttcttccctaaattgttgcaagagctttggtcctgagtagcctgagtcttctcacacattctcatatgcatttttttgatagtagtttttccactgcacaatcagtatgagaaactgggctgg

SEQ ID NO: 80505 - DNA, 1139 bp, Homo sapiens
ggggtgggaggaattctggggagtgagccctcatcatgtgcaatctaatgctgtctgcaggtagatagtgttggaattgaattggagaatacccagctggtgtccactgctaggtgtgtgggggggaaactcccacataatttggtcacagaagcgttcttctgtgttgatgattgtggtggtgtgagagtagaaaaaaaatgcagcttgagagggtgtttttgaaactgtgggtgtatgtttagagaaagagagaagagacttttattataaagtattggttcacgtgattatggaggctgagaagtcccatgttctgctgtttctggagacctgagaaagccagcagtatagtttgaaggcctgagagctggagagtcagtggtttaaattctgctgtgagtctgaaggcctgagaaccaggagtgctgagggtaggagaagatcagtgtcccaactggaacaggcagaaaacaatttcagcctttttgtttctcattggactggatgatgccaacacacattgagtgccatctgctgtaactcagtccacagatccaaatgcttttctcttctggaaacaccctcacagagaggcacagaaatagtgagtaaccagatatctaggcatgccatggcccagtcaagttgacacataaaatttactgtcacacatagtatactcgtcttcatctaattacaaatagtttaaaaatctaattacaaaatctaatcactgcattggcaaaacaccatttctccccaaaaccctggagaaatcttcccatgcttatgaggtgtaaattatttgtgaagcattggccctacctgaaatctgggtcaaagggaactacagatctagagcatatcacaccagtgtgttaaagtgaaaaaataatgtaagcaagttatattggcgaaagtcgttattgtcagccccttattctgggattgtaatggttgatttccaatgattacgtaatataattatactttaaatgtaaataatgctttatattattgagggtctaaagggatttaatagataaagtgcacgttacaatacctgacttacatctgatactgaacaaaatttagttctctcttgtaaaaccctatgtagaggtattgttattagt

SEQ ID NO: 80506 - DNA, 1087 bp, Homo sapiens
ggattcaaatatattcttgctttgttagttgagtcagtaccaatagtacacttgtgattagactgtcaaacaaaatccctgaagggatttcacactgttaaatgcttggtttttatttgtttttatttgttgggtttttttttttaaacggcatagatgtaaatttgtgaattacagaaaagaagcagttttaacatgaaatggacaaaattgatttctttctctgcttacagagcttaataagaatttcagtccataagcctttcaaatgaaacaatagaaactccaacaattcagagctaatgtaaatgaaaacggttatcttccaaatcacagcataataaagtaaccttgaatcattggtgttggccctatattgttatttatttgaattaaatggcaattttcagcattatgtaacagtgatggaattaagtgatgtttctagtaaaagaattttgcaagtataatatattttagtattaaattccacttgtacatttagcaattaaaattattcctgaaatgatgatggcatttgaagggatagggagctgtcaaagaggatttgaagcttaattatctctttggtaacaaaatgcataatcttccattacaacacttattttcttatggtaattgactcatttgttctctggttatcaatttaacttcccaaccacaaacatctgctcttacaattgtgtttaattggtgtgaatactatctacagagtagttaaaatccagaaaacattttaagggcattattttataattcatgaaagggaaactaatgattaattgaacattgcttatgatgattttttctaatagtctgtgaaagtctgtttactaaaaatgcataccgaaattatctgctcccccctcctttttttttttttttttttttggaagaggcttttgctgtgttttccagagtaattatttactctgccttagggggagcctcagttcttgcagttctttagactcaaggaatatgttaatgtcttggaacatggtaccttagtagttaagagtataggctttgaaggtagaaaaaaattagtatgctatcatttata

SEQ ID NO: 80507 - DNA, 1031 bp, Homo sapiens
agttggtattgcgtgccagatctttttccaggcaaaggtgtagtttgcaaacagtgagagtatgactttccatgcgttaagttcttcatcgtgaatgacagtatgtactcttctattcagttaaattggtaccttgccaatgctttagtatgaaattgagttaacaagtacttggataatatttaataattggatcataaaaactttacttgtttttttcctctccaaaaagcatatttttgagattttgatctggtatttatcaattaaattatgtaattttatttatgcttttcttcttcagaaggaacataatcttcaagttttgggtctggtgaaatcagatgaagggttctatcagtgcattgctgaaaatgatgttggaaatgcacaagctggagcccaactgataatccttgaacatggtaagaagggctgaaatagtcagatgatagaggctgtgtgcttgatgaacaagcacccatccgtccaaataactcatgattgataacccattagtaaaggccaatatgtggcatagctaagagaaaaagaatagcagtctaaatcatttctattacataaaattacctagaagcacaattttggataatgttgaaaagaaatttttactaagaaaaggaaaactgaatattatagtcttaataaattaatttttaaaagaatttagtcatcttaatctcacaaatatatttctgtcctataaagaaaaacttcttttttttccaattctatacacttttattaatacacttacaaaaaataacattcaaacactgagaaaactaaataactttggaagcagagctcattgttttctgcttacatataagtgacaattctgggctgttggcacaaaatagtcaacattcataaaaccctgactactatatatcaaacataagttaaaatcataggcagtagtttatcaaatccacgtttcttagaaaaacttagtatttattttgcattgaaatttttagtttttccagaatacaattaatttacct

SEQ ID NO: 80508 - DNA, 2125 bp, Homo sapiens
gtaacaaaggtttgactagtaagaagtaaagagaactctagacaatataagaatggcaactatcaggagcaactacaacccctaggtctgagatagagccctcaggaagaggcccctctttttacggatgagatccagaccctgttggagagggtgtaaccatggtttactggatggcagagaagttgatgtggtgttttgctctctaaacttgctcaaaatctcctttcttgagggttggggaaagctgcttacagagaggtatctcactggaggcattctgctacaaaaccacccagtggatcaggtgtaaggggaagctgctggctataggaggctgccagggtagtacactagaaccaggaaggaaactcctttcttctgtactgtatctccattgccttctattgataaagtttaatacatatgccagctggcaaaggaaaagtatataaaggacatggctctgtttttgcagcataggcaatgaaatcagaatttggagctgagaggcagtaaattgataactggtacacacttcaaatcctaccacctgggtacactgtgtatggttttataatttcctgttttgttgcaacagcatgctgtgtatatctttctgtgtcaacagttgatctgcatcaatattgtttcttattaaataatatgtatatatatatatatacactgttttatataacagattttatattggttaacatttagattgtcacctgttttttcctattacaaacaaggatgtattgaactttttatgtgattattttcttatactaaattactagaagttgaattattggataacagttctgtgttaaattgataagggtacctgttgggtgcattattcatttgttttagcaactgaaacatttttcattttgagcatttctcaaaaatacatgaaaaagatgccactttagacatctgatcttttattcaagtcaaatacaatcaggtattggtgtgcctccaggaagaatttctctgatgattgtagtttggccagggaagctaattggcaaagatggcacctactctggcttttcactaacatggcatatatgtaggatttttgtgtgctattttttgaaaaatatacttgagagtgctgttacagaaaagcataaaatattagaactgcttttttcttcttaggtttgtatataccctcccctgtttattggaaatgattttagtagaagcatgccatttttccatcttggtgaaatgcctgagtacaattactaaataaggcactagcagaattagtgaggtagataggcttatttctttttacttgtggcagtgacttttcttagtaaacctcgtagctatttggggtatatttatttacatggaactaagcaaaggcacttcattatatttgtgtttgagattactgttacaaatctaactctaacagtagaaatggttaagtatgccaggaagttcctaaactaatcctaattgggctttcctctgaaaatatttggatagtgttaaaattgtagtcatagtgtatttgcttctctctttttgagaatagcgttttatgagctgatgaaattttttagtgacgttattgggcatgtattaaagatgcatagattataagaaggagagtaagtgtcatgttattaattgtgttttctattttgctgttttaatttgcaagataaatatttatacaggaaagctaaaagaaggaatacagtaacttactagatctgagctcttcttttttagagtttacaatataataagggatgtaagagatatataaaacttgaataccagtccagatgcataaataaagcagcatacagttcagaagagaggaattctgtctgtgtgatcagggaattttttcatgtaaggtgtcccctttgtaataggccttgaattataagatttctagatgttaattcaaaggaagacctggatcaatatggaaataaaatagaagacctgttcctgtagtaaggtagcctttaacagcagaataggatcagagtgcatgattataaataataaaaacaatgccatgtgtaatgagtatgatgataaagtcaggtttagaggaagacagagtgcaagctgg

SEQ ID NO: 80509 - DNA, 1041 bp, Homo sapiens
tactggccataggccagctggctagtgctgggctgcaagaagctgcgttggagcgtccacagtaggcctgtggtatacttaacatgactattaggttaattatcagctttaaacattaaatgaaacttaataattatagttaaaatatataaaacatttttgcatatcactggaaaacagaatttctgagcaaattgtgaagtagaatttgacttttgttcctagcatgctttcttaatcaaaacatttaaaatacaacttttaatatttaacttcacttttatgcattttcggtaacagcagctcttgattttagaagatcttgtatcttttaaaaatatttaactgaacataaaacaggattatttttatttgctgccatttcagattaacattgcctgtcattttatgctaaaatcctttgttttttataattatctattaaattacattttcaaaaaaaagcattggcaggtacattgttattattatttaaattattactggtcaattaagagtagtaggaattaaggtaaaatgtctgtatcttttgtccattaactttttattggcctttcttcctgtcagttgaatttaaaaatagattgcgaaattatcatgtgagactggaatgtgaaaacatagaaatacactttctttttctgtcctttcataccacgtctgataattgccaaattttagttctagtaaaggaagaaggattcatgaaaagggagtaacatcaacttgtttttagtaaaggaaacttacactttaccagctccttaaatgactgctgggatgttatggccatagtagataagaatacacactgagcatcccccaccctttttttgacagaaatgtttgtaaaaaattccaaatagtatctgaggttagcattgaataatagaagttctggaataagtgactaatggcctggcatgattaaaagttggctagatagcaggaaattgttactcattagtggaatattttaatttcaaagcactaggatgtacagtagttggtgttgatgtt

SEQ ID NO: 80510 - DNA, 2127 bp, Homo sapiens
agttatctagcagataccctattatataggctattaggggagataatgtaaaattatagagtctagctagaatagaccttagagagctgagtatttaatttagctgagctggaaactcagttaagtgacttgccataaaataactagttggcatcagagtcaggactgatatcttggttttcaatttcaaaattcactgtatcactttagcaagtttaatgttttcaagacaaaaatttatgttcttttttccgcttatgttctcttaatttcaagttcagtcttttaagtcagtataaataagtgttattacttactgacaaggttggtcagatgtatcattttgctaggatgaccatacatctagtgtgcctaagacaatcccccagcataattaccaaaaagtgtctcctttcacttttagtagtatctggttgtggacaacatattccatggtcaccccaattgttgctaatttattgaatctgaaagattctacacagtgccagggtaaagattttggattatgaatctaaataattataatgcaagctgtgctgaatgccaaagcgctactctaattctaaactggaagaaataatttctgctaggtttgacaggcaagggaggctgattgaagaacgtggcatgtgagccgagcctagaaggatggatgggattatagattagtcaggttacatgaagatgggaagaggtgtatatgcaagaaggctcaaagtgcatttggagaatagccagcatctcggtttaccagtgttgagagaagtatgagtacaggaatatacatctgggaaggtgtgcagagaccagattatttaataccaagtcaaagggttggaatttgttgagcagttggaggactccagcagttttcagttatgtagcactttaagaggattaatttattagagatgtgttgagtggctttagagaggaaaatatggaatctgtcctaccatttagaaggattttgtaccaaatcagatgtgatgtttaaggccctggactagtttatggcaatggagagagagaggctttctttttattccctaatggctttgtattagttcatttgcattgctataaaagaatacctaaggatgggtaatttataaagaaaagagatttatttggctcctggttctgcaggctgtacaagaagcatggcaccatcatctgcttccaatgagggcttcaggaagatttttaatcatggcagaaggcaaaatgggagcaggcatgtcacatggtgagagaggaggaggttccaggctcttttaaacaaccagttctcaaggaaactaaccgagtaagaacctactcagtgcaagaaagacatcaggccattcctgagggttctgtccccatgacacaaacactctccactaggctgaccctccaaattggagatcaaatttcaacatgaggtttggaggggacaaacatccagacgatatcaggcttatacatggtacatatttattacatgttggatagatgtttctacaaaagaagatggcacaagatttatgatttattggatacttaggataagagagaagaaaacattagagttttacactaattaaaagtagagggattttctgtataagtgtaaggatatgatctttgttctacttagcttaaggaggtttgtctccattaattttgagttatgctataatgaatgctgtttttagatagctttgaagaggtagacatataattaaagtatgaataatttgtttgatgttgaacatcaatttcatctttgccaaaggtcatggactttaagaccagaatttctgaggtccacataataatttaatgactcaatgataatttttggtgttaaataaaagtcctgcagatgacctttctggacacaaagttgaatttagaattatcaaagagcaagcttgaatttgaatttgatgctattattttgttataaagaaagaatctattatgcagtgctaaaacaccagaaggaagatagtatgtctgaatatcttttaattggtagttatatttaaaagatgctaaattatacaataatgtcatagttggcaaaatatcatttgagtctgaaagatatcactgaca

SEQ ID NO: 80511 - DNA, 1051 bp, Homo sapiens
aaatatctattggattaaacttaattgtgttcttaaaattcattaaacgcttacctaatttttgtctaccttatctgtcagtttctaagaaaatatgtttctaagaggccaggcaacggtggctcacacctgtaatcccagcactttgggaggccaaagtgggcagatcgcttgagctcgggagtttgagaccagcctgggcagtatgttgaaacctcatctctataaaaatacaaaaattagccgggtgtggtagcacgttcctgtagtcccagctgctggggaggctgaggcaggggaatcacttgaacctgggaggtggagtttgcagtgagctgagattgtgccactgcattccagcctgggtgacagagcgagactccatctcaaaaagaaaaaaatatacttctaagaaagtatgattggagatttgttcaatgttttatttatattattgctttatatattcagaagctatgttgttaatgcattaggaattatgacttaccttcctggtcaattactccatttcatcaaatctaaggtaccatgcattatgagatacaacctgattgcagagatgttaaaatatggaaaaggatcaagaaaacatggtatttgttttatcagcaggaaacatttgtgttgtcctagttaattcttgttgctttcaactttgttttgtctgatactgacattattatacctacctttttttttttttttttgagacagaatctcattctgtcacccaggctggagtgcagtggcgcaatttcggctcactgcagcctcttcctcctgtgttcaagatattctcctgcctcagcctcccaagtagctaggattacaggcacccactaccatgcctggctaatttttgtatttttagtagacacagggttttacaatgttggtcaggctggtctcgaactcctgacctcaagtgacccacctgcctcagcctccctaagtactgggattacaggtgtgaacccccatgcctgtccatgcttttataatagcattgactgaaatatattttctattc

SEQ ID NO: 80512 - DNA, 1131 bp, Homo sapiens
gtaggtggaatttgtgcagcaggctactggagagaagagaaatatgcagagaagaagcccaaggaagctatatagggttccccttgagtcttttgggtctcacattacatttagtctccttcagtttgtgatagttcttcagtctttccttctctgccatacccttgacacttttgaaaagtattggtcaggtattttgtccagtgttctcagtatggatttgtctgatacttttttgtgattacattgaggttatggattttttttggaggaataccacagaagtgatgtacccttttcaatacattcgtatcggggtacatgatatcagcatgtcctgttatttggtaacgttaacactgatcatgtggttaaggtggtttttgccagtcttcttgcagtcatctctgagcccagagcctctctgatttatttagtttctcctgagtgtaaatctcctattgccaagggtgagggatttggagatttaaagctcttcttacaggagctttcaaataattcctccatcccccatatcatcctttcctcctgaagtgctgctgattcctgaaggtcagttggcttgaggctcacctgtctgtccctttggaggtacttagattgactctttcccgtgaaataatttacttttcttctatccaccttcttctttcatatattatagattaggattacaatccaaaatatctctcagttttatcagaaatggagtttgtgttcctatttcttgtcctgtttgttgtttgggtgtatttatgaagtggtggacccagaaatgtattcgaccttccatgctaaaactgaagctaaaaatagctttttcagaagacagtatttggcatcatttctcaggcattcaaatacaaacttttgactcagcatttccacttctagcaatttgtcttacagaaatatttacacatggacccaaagataacatgtataggaaagtttatagaagcattgctgatagtagcaaaaaaaaagtaatggaaacagcccaaaaaaaaaggaaaaacaagggaatgattaaataaatggtggtatatctatattgtagaatactattcagcaattagaaataatgaggtttgtctttatgtactgtta

SEQ ID NO: 80513 - DNA, 1049 bp, Homo sapiens
caagacaggcacatcacttgaggtcaggagttcgagaccagcctgaccaacatggtgaaaccccgtctctgctaaaaatacaaaaattagccgggtatggtggcgcatgcctataatcccagctacccgggaggctgacgcaggagaattgcttgaacccaggaggcagaggctgcagtgagccgagatcacaccactgcactccagcctgggcaacagactccatctcaaaaacaaacaaacaaaaaagccagatcaggagaaacgtcatcattctttaggaacttccacggaacaattcaatttctgctacttacaaccctgtgcaggcccttaggtttcagcgactgggccagtgtgaagctgctgccaagcatttgagcagcaggtcagagcggacagcaatgctcacatttgaaaatgtaataccttttctcaaatagatttcccagtggcctttggcttgattcagatttacatggtgtttacatactgttctaaacatagtagcagtatgaacaaaggtataaaagctgtaaagttccttcttgttaagtaaccaagcaaatcaagagcacatcctgtttaggaaataagcctagaaagcgaggatgggaccagtctggaggactttgaacactgtcctgagatgtttagacttattctggaggctgtttggtacagttacaatgggtgaactttatggtatgtaaatcatacttcagtaaagctgttgaaagaaagactggatagttgaaactattaaacatccttttttttcctagtgtaaaacagcaatagttacacagtcctaggacatttcttttgctcaaaacacctgagcttaaaatctgtctgaagtcttcataaaattaaagtgtccagaaattatcaaagacttttataaatgccaaccagtcatcaagggcccaaagcaaacatgaaaaatacagatctgtaggccacatgtagtaaaaacctttgtttcttagagtcaggctggttgctttcccttctgccaccagagtagttatctcattgcgctctta

SEQ ID NO: 80514 - DNA, 1112 bp, Homo sapiens
atgttttcaatgagacacacttatttaaattttatgatagattgtgggttggagtaagcaggaatgattagtaaattaatttgtagttggaagagatacagaagttgagttggcaggggcaggtgggcatgactagtgtatgtaaaggaagaggaagtgcaaggtaaggccatctgtgtgtatgctgtgagaaggatgcaaaggcaagaaagctggccaaactggcccagagcttttggcagaaattagtaagagattagaataaagtggacgtttggagccagatgctggaatgccagtgagaatttggacataatcagataagaagggaccatttttgactgttaagaaagttgtacactgtgattttattaaacagtactttgggaacactacccaagattaaaggagagaaaaaatagagtcagggagacaaaattgggtagtaattatgttagcctagatacgtgctagtcgtcggcttggatgaagatgaaagcagcgacttgaagtggataggacaaatttgggaaatatttaaaaggaagattttgggagaccataatagttttttgttgcttcattactttatgatttctgaatagaggcaatgaaggagaagttaatttttttaagtcgtaagactatatcctggctaattgttacataaacaaaactttcttattaatcttatcggcttaaattttctcatctaaaaaacaaaagtaatatatttacttcacagacgtgtggtaagaattcaatgtgagaatgtatgccactacctgcatttacaaattcacccacttcctgcatttgaaaattcagccaccaggtggcaccatatgccttggtcatgagctgtaattcttatgggtacctgagttgccagagatttcagagggtccttcctctctgccttttcagctatgaaaatttcatctttcttaaaaaagcagtacttttctatattaaccattaagtgggaagtggaaagtaaggtatttctgctattcatagcactttaaagttggattgaagccttagagatctgttagtctagtcaaggggttagcaaaccatggaccctgtgccaaattggagcaattatt

SEQ ID NO: 80515 - DNA, 1411 bp, Homo sapiens
tgcacatgcaaggtaagtcatgacaaaaatgaaggaaatgcaagggtcctatcctgaggctgtgaaccttctgaaactgcatgaaaataaatatttgtgtctgtacatattcacatttcccttggaaaggatctgtagttttcattgtcatttcagagctcatacatcagattgttgagaaccactgcgagggtcattgtcaaatttagagatgaaagaaaaggggtgaagaagagtggatttattgagtgcccaccatgtgtcagccactgtgttaggcagtcaggatgtaaagatgagtaagacttgacttctgtccacaaggagcttacggtctggtaccatagacaacagtgtgatgtgttatcaccttaaggaaaataggcagcataaccatttattcaaggagtttggctaaaagaaaatagttgtaagaatgtaggtagaaaaggcaacaggttctggtgagggtattttagggatggagaagagactataacatgttttggcaaaagagaagcagtttctgaagagagatttggatttcatctggaggtgttcagcttgtgtgggggaggcataaatgttggaaccagcccttggaaaatattttacatatttagtttcacaaaccaacttaacattttttccatttattatgccactgtacagctgaaatgaaagaattcattagcaccttttttaggatcatatttgcctacacttggccaatgaatatattgaaaatgatttcaagagaatttagggactgttttgtttttcttctcctttaataagttagaggaaagttttccatagcagcagaagtgtgacaaatcccacctgtcaggctgcacaaaatatgcccttaactgaagtgaataacgtgattcataactaaagcaaacaactgttagagtaaccatattcagatttctctactttgatagcaaaattaatcttaagctgtggtgctgttattcaggaaagccagtgtgttttacattttgttagctttttttcccttcccagtttttaaatctaatgaatgtctattacagaaacactagtgccagagaaattgttttcaaatatagaatgtctaccaaagtgtaggcatagacagccacacaggatttgtgtataaattggaactggaacctgtcagtcagacaaaaataatacagtaaaagggtaggtgtgtgagccattgtaggagatagagccagctagacacttaagcagtcagccagtgatccagtcttccagtcacatacatcctatcgtgggtattgtagtaatctccttacgggtcttcttgagcccacgttttagaatcagcaagtactcgactcctgggtccaccgctagctaactttcccatcacttgggaaagattgttaacttcata

SEQ ID NO: 80516 - DNA, 1018 bp, Homo sapiens
gttaattagttgtcccctttttaaagagttttatatggaaattgtctaatttcagctcttctgcactggacacgggaaagaatctttatacctaataatagttagttccctaatccatgtgcttctggccttcttatactttccttctgaaaacttttctgagacttttatccaacatcatctttctggcaaaacaaccaggagatcaggggtccagagtgtactactcgaatatataatcttcccatttgatcattgagggttttagaatttaaaggtatttttgagtgattattaaataactttgtaaaactctgagtaccttgctgcctctatgttttttctctttaaacagtaaaatcaggataaaaatatttaaaacaggaccaagcttttgatatattcagccttttttctataattctgtcttgtgcagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtaagctaccgtgcacaaaggcaaaaggtacactgtgtctttctcagatattgaattatgctagtctaatgactgctctgaactgtcgacttatacaaacaaatttaaaatggttcagaaaatttttaatggttcaatccacttctgacttgatagagattaatggaaaacactcttaaaggttctgctatttctgagtggtgagatcgagtttgatttttcctttcttgtgttttctgcattctccatgttttcatttttgagtgtatttattgcttttttgtaatcttaaaaatgattaaagaaagttatataagcatagaaattaccccactcagtatagttggtaactgaggtctacaaagtggtttttgtaacaccgaccaccactcgtgtgtacgtggcctgaaacagtatttgtgaatagctgcatc

SEQ ID NO: 80517 - DNA, 1021 bp, Homo sapiens
tgaaataatccttaaggtctttgtaagtggacacgagagggaaaagatgactaagcaaattaaagagagaacaggctatctgggtttgagattctgtttggtttttgctgacttttagacatgcctttctgctaccccctgggctttcctagtctagggatatgcataaccatttcaaatctctgtctattttggcctcctatttctctcctatatgaataatggagttataaattctccacaaactgggcttggcctcagtgtctttttgtcttctgcacagttcactggactttgtacagagagaagggttggatttgaagagttagaaatacagtacatcaaagtttaaatagaccttgagtttgctttctttgccaaccattttaagaaaatgtttttacttcaatcctaacccattagataacaaatgagattgtgttttcccttaggatatttgcatttcaccaggcttccttacattttatactaagagaattctagtattttaggaagagttgagtaaatttaaggatgtacttaatttgctcattttcctactagtgtgttaaaagttttcagctatcacatggaaacacaggaaacgtattgtcctgttgcataaacgaacagcttcactttagagctgtaacctcaatagttggcagtatgtttgcagaataaactcatagtgaaaaatattaatctgtaaatcatctattctttgaagaaatagggcttttaaaagttatatttggggctgggagtggtggcttgcacctgtaatcccagtgctttgggaggccatggtgggcggatcacctgaggccaagagttcgagaccagcctggccaacatggcgaaaccccatctctactaaaaatacaaaaattagctggatgtggtggtgcgcacctgtaatcccagctactcggtaggctaaggcacgagaatcacttgaacccaggaggcagaggttgcaatgagcagagattgtgccactgcactccagcctgggtga

SEQ ID NO: 80518 - DNA, 1048 bp, Homo sapiens
ctctttctgtacatcctggtctttatgtcatttttttaggttttgactttgcctcttttgtgaaagaatgaatcatgacttgacttggattacattttactttgtcttttaaaaccggcaacagcgcagtgcccttttgctgtgggtcagatagattcatggttgtgatgcttcccttctcaatgtggggattaagtgccccctggtggaagtatcaggtgacagttcactgtggctctgcccaggagttcctaggagatcacatcggtaagagctaaaacagcctgtcaggcaattcctggttttcaaaactgaattattttaattgtagacccttgagggtacattattcaaatattatgctataatattcatatgatataataggtacttattgatttactgaaggcaaaaggaaaagcaggagtgagatttcttttcccattaattcctttggacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaaggtaatgctccccaagctgagggttttgttgtgtgtctctttagtggggctatgctgacactatcacttgagcatatagagtctgtggatagtatatgaagtcttaatgatgagcttgtgagccatgatgtgaagatttatcccagaatgattcctcacctactcattgaccaaatcagtgctccctgggttaccagcctaaacatatcatataaaagaggacactggttccaggctatttggggcagatcaattgcagtgatctaaaagtttttactggtcagatcagatatgattcttttggttcccatatagagaaagagtagtgtgttcttgtgatggatagttcaactcaggcaggctattaacctgaaagacttatttgtggacgtt

SEQ ID NO: 80519 - DNA, 1048 bp, Homo sapiens
ggagaaactgcaaacatactttctgttgtgtgaaagtgcaggaatataaaaatacccataatatatatatgcacagaatataaatgggctcattgttttctcacttgattccatagccagagtgcaattcttagctgcctgacacctctggtatttaaaattctttactcattgatatttttggtgctcagttcatccttggaatttcttgttcatagtttacattcaagagaaacaatgttgggaaatacaggaatataaaccatccagtttgttagcaatgtgtgttctttgacaattaggtacataatccaatgctctggatagtttggcttaaatgtagcctagctgtcaactaagtacacttaaacctgaagagccttgcaggtgctaagccatctccaccagctagactttgtcatagtgaaaagcatatgaggaacaactggactcttaatctatggtgtgtgtcacttgggagaaatgatggcatcagaagtaaggagataaagtaatatgtgtggacaatggaaaaagggccagggactgtgagtaaattctagaatatgcccttttggatatccaggaactcctgttaccttcttttggtaggttttcagtttctggaagcatagcattgttttagtcactggatttattctgttagatgaactgcatacacaaacttcagattttaatgttttcatttcattgaatatatgtatctcctgataatttatggaagtacttgacattagctctaatgttttgcagaaacacctagtttatacatttctagtaaggctttatttgtagaaataactctcatttataagtgttttttgaagcttcatgctctctgcctctttaaagagaagattatactctttcgtgaagattttttatgcttgtaataggagtggttaacatttatggaacatctactatgtgtcagtcagtattaaaaatattttatggtattaaatttccatttaatcctcacaacagctttgtgaagtggataccattattatccctgtgttacaat

SEQ ID NO: 80520 - DNA, 1020 bp, Homo sapiens
aactgatatttgcactttctgaggcctccttctggggtggtcctaggcctgaggtcagcagcctcacttagtatgttccctgatgatggattaggagacagtgtctttttgagcaactaggaggaagactgtttttttcagcctctggaatgtttaggtgactgagcaggaactgagaacctgatttgaacttccatttaccttcctgctcctgcttagcttagggtaactttatattcagaaggacaactttgtaatttgagaaaagaatctaaacaatactaacacctgctaggtcaggtattagtatccacatagccaggtcccttggaagagtatagttctttaatgtagacattaacctaattagtccccttggttgcttttctaggagaagctacttttgctgtaagtcctctgagcagtcctttgggaactgtttcctaagctagagaaatagcacctactgtcccagcttctaaacagcagtgacagtcagctcacagccgtgagacaagcgtgtcagtctttcagatgcctcattacatagaaagctataccttagtttgctttccacacatagactatagattcccatgatttatgtgctactttattttctcatggacagaatagactaaaaattgtgttttttgtttaaaacactccctagctatgaagtggactgtcacgccaaatgtgtggggtcattattgacatgatttcttctcctttagcctcagggtctggagggaaaggaagccggctgccagacctaggatccgactacaaacctccaatgagcggtaaagcctttcccatggcgttttttgcttactatggacatgaagcacttttgcttaaatttttgaaatgtcctttatagcttgtgtgtggtgggttgtagcatattagcctgttttcttttattgctagatttaagtgtttgccaaatcactccaagcccatgtgtcgtaggacccataaatcaaattgtttccccagttatccaacttaaga

SEQ ID NO: 80521 - DNA, 1008 bp, Homo sapiens
gatggaatctttcttactcagatctgaactcaaatgccatcttctcagagaagctttttctaaccattcaatctaaattggctacccagacactctgtatcataacccctcattttctttttttcacaccgttagttattaactaataatttcatatttatcgtttatcccattcccccgccaaacgttcacatctttgttgttcaccattgcaccttagtacctagaacaatgactgacacatagtaaccattcagtatttgtcaaattaagccatacttcagacctactgtttcttgaagttgaacaagagaattaactctgcgtaggctgtgtatttataaaaacagactttacttttcatgcaatttttataatctcagatatctgcctgttggggaaaacttctgctttgtatgaatgaacatttttaaatggttttgaaaaccagaaaactaaatgacttataagtggtgctttacaaaatgagtttatatatcacatgagacaccagagagccaagactctttatctgtctaagtatatctcaacctttgaaagctcttgaatgttcagtacaatttgagaagctttaattaagtactatctttgagcaggctctgtcctgagcactgttcataggacagactcttagctgtctaggagctcatcatctagagaagagagccatgttcacgcggcacttttatataagtcagagcaatgagtgttatcaagaagttcacgtgagatattaatggttctgtagcttgatagtatgcatgttttaaattctctaaccctaacacatgtaccatttctctctctgcaggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagtaagaagccccagatgcaccccttaga

SEQ ID NO: 80522 - DNA, 1749 bp, Homo sapiens
catctcaaaaaaaaaaaacaaaaaaagtttttgcctccctcctttataagccacagactttccctctactccattgttatgtttctacattgctctaattagaaacttgtggatgaaccttctggttatgagattatataatgaaaaatgctatcttaatcttttaacagtcaaaaaaagtagtcacaaggcaggattcaaacataaagaccctggtaagtatctctaaatatgtgtggacaaaatagagatacatttactctccccaggagcaaacttgttgttgttgttgttgttgttgggggcaggaggtatgtttttagtttttgctttttttgcttgaaacatctctcagaaaggaagttttaatcactcaagccttttgacaaatacgttcaaatgagttactttttaaaagctcctctgaacttcgtgcctaggaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagaggtaccattttaagtgcaggttttttctcaaatgttaggaaactattttcatttaaatctttttttttttccctgagtttgccttcatttggcaattcctatatgagatcagatttagagaaatgtgtatgataagatttgggaacatatgatgaagaatacctagcttcttatgggagagagattctgtagccatacgagacaatcttgcagatcttttaggtctctcatcaggcttcagcagcgtgatattcaaggatttgaggctagctagcccatgtctgtgcatttcattctgtgtcttcagctggcttccagcttgcattgtggtattcagaacattcttggtctggaggctcttatagacaccctgtgaagtatggtgggcagcattgtgacatccacattgattcagcaggaactcttgtaatgctctaatgatcattttcctctttatttcacttcttacagaaatgtcttgtccccattatgctgtttgtgaattctgaatcccctactagaaatgtttcactgttgaggctgctcagtggcatagggcacatgctggtaactaacctccacgtttaacatctagggcatgagtcagaggacagcatgtctacactggctggaaggcgaggaatgagaccaaaaatgatgatgccctttgactcccagccaccccagcgtaagtagaagcatctcttttcctcagtgctaccaatctgttcagtcatgtaggggaacaactatgaatgatctttttgacttcacttgattctaacacaaagataatctaccaaagctttgacaccttgaaggaggaagtaccaaacacttgccatattttgcaacaaacattattcttgaggctagcgtcgttatgtttatggtaaataagctgaaaagccaatgtctccagattcccaggaataggggagtaactagtctccctaaaagtgcatcatatctctatgggagagatgggaaagcttccctcctccagactagagctaaggatggtctgatgttacaagttttcattacgctgcctgacaccagtgctgatga

SEQ ID NO: 80523 - DNA, 1051 bp, Homo sapiens
ttcctgctgtagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaaggtgagtgaggatggcagcacacctggagggagcacacctggagtgaccctttggctcaagcttgggacaaagccaccccttctttgaagtatagcaaagcaaatatcctccaagcctatcttagcaattctgttagcgtagcagtgtgccattgccccgcccaggaagtttatggcctccccttttctgggaacacttacaaaccggagaataatttgctgggaaccaagggctgaccttttgaattgtgttttatgtgcagcacctttggtggtaagtccaatggcatgggaatggatagcagatctagtctgcccagacccctggaatcacctcacttcgtaaggtccctgcaaactagagaagggatcagggaggccaaggcttggactcatagggtggtgaaagcagaagtaacctcagaatagggaaaggaatcctgtgaagggaaagtcatttacccaaatccacacagctcagtaacagtcccctgacctcaaaggcatgcttgctttctgctcttccaaattgttacctattcatttgctttagaataagccagtggttttcaaaatttctggtctcagtatccctttatagcttaaaagctattgagcacctaaaagagcttttcttcatatgggttatatctatcaatatttaccatattaaaattaaaactaagaaatttttaaagtattttattcatttaaaaaagcaagtatctatcatgttaagataagtagcatatttttatgaaaaacaactattttcc

SEQ ID NO: 80524 - DNA, 3230 bp, Homo sapiens
ttgggagaaaggcattgtgcattatcaggaaacgggatcctagtgaccttgggtctatcctgctactttccactcttctgagccaccctgcgtgttagtagccagttttctggggccatttgactactgaccacatgaggctttggcctctctctgggctctcctttctgagctgctccctggatccagcccagtaacagtgttttcttttccatagagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaactctggtctggtcaaagagttattttcctttgtccttaaaaaaaaaaaataacaacaactttggggccccctgcttcccagcctctaactgacttcacggttgccttcacaactgtaaagccagtagtctatgaggagactcagggaagggtggcaggtgagccaggaggctgcaggaggtgtttggaccgtccaccagtaccaaaaatgagtcttgtccctgttcccatccccctgttgctgccctgcagggactgagcagcctgaggaatcagagggggcccctggcagccgtccctgaatggagtgcaggccatgtccctgccgcggcagcgcattctgttagggcagactgactgtccacgtggggcctggcctccccactcccagccccaccactcatagggacctgaagctgga

SEQ ID NO: 80525 - DNA, 1075 bp, Homo sapiens
tgttaactgtagagaattttaaaaagacggtaaaagtgactaaatgtcagtttgcttcctctgatcaccatgtaccagcaattcagacagtgtcagtgatagaatgctcccagcacaggggcagacagctcctccaccccaccatgagcaccctatgcgtcagccccaagggacacctgctgtgctcgtgctgctggcgctgtgggaaggcctgaaggcactttttctccctagtggggctaaacccgactgggatttttaagggacaattgaaagatgcgtaagatccctacctggactccacgtctcttcccagccgctactcctcactcttcccaccggagagctgtgtcccctccctgtcctcatttcctcctccaccgcatggctctgacaatttctgatgaattcacctgcccacattgtgaaatccagggcctccttcccagccggcgtcctgctgtcctcttagcagggtgtgacctcctccaccaggccctcctcagcacatgggaccccatcctctgctcactgcttcacctttctcaagctcagcctcagcttgaagggctcttctttctcccaaaaggttggtgctccctgggcctctggccttgtcccccgtcttctcactccagatgcacttcctggggttaacctcacctaggcctgtggcttccccagcctggaagcaaaagcttcccagagttcccctaccccaattcaggcccccgcatgccctgagcctcggcctgggcagctgctccagggtccctcattctcttctgactgaccacggcccttttattctttcttgggtttgcagcttccagtgcactacaaagcatgccttctcctccacctgcaccccttgttgattttgctgctttaattttctttctcttgagggtggaatatttcgtacctactgaagagatacattatgtaaatcagatataaaaaataatatcaacagctatgtaccaatcactcagtttaaggaatggaacataaggaatggagcataaggaatacctttgaaggcatctatgctgttgcccaagtgtgtccctct

SEQ ID NO: 80526 - DNA, 1046 bp, Homo sapiens
actgtgattaggagatataccaataacagtaataattatttaaaaaaccacacacaccagaaaaacaaaagacagcagaaaataaccaggtattcttagagctatagatttttggtcacttgcttttatagactattttaatactcagcactagagggagggagggggagggaggagggagcaggcaggtcccaaatgcaaaagccagagaaaggcagatggggtctccggggctgggcaggggtgggagtggccagtgttggcggttcttagagcagatgtgtcattgtgttcatttagagaaacagctgccatcagcccgttagctgtaacttggagctccactctgcccccagaaaggggctgccctggggtgtgccctggggagcctcagaagcctgcgaccttgggagaaaagggccagggccctgagggcctagcattttttctactgtaaacgtagcaagatctgtatatgaatatgtatatgtatatgtatgtaagatgtgtatatgtatagctatgtagcgctctgtagagccatgtagatagccactcacatgtgcgcacacgtgtgcggtctagtttaatcccatgttgacaggatgcccaggtcaccttacacccagcaacccgccttggcccacaggctgtgcactgcatggtctagggacgttctctctccagtcctcagggaagaggaccccaggacttcgcagcaggccccctctctccccatctctggtctcaaagccagtcccagcctgacctctcaccacacggaagtggaagactcccctttcctagggcctcaagcacacaccgccacctctggggccgtcagtttgcccatctgtacagtgggaggtgagcggaacttctgtttattgagtctgctctgtgccaagcactggtttcgcactttacacacattaactccttcagtttcacaaagaccatggggtgggtactttgattctccccatttagcagaggaagaaacagttttgggtaatttttccagaatcatgtaactaggagtggca

SEQ ID NO: 80527 - DNA, 1034 bp, Homo sapiens
tggcaattaagtttccaacacacaaacttcagggggacacattcaaacaatagcaaccagttaacacttctccccaaatctcagccttctgatcaaatctctgctatccaaaaaaaaaaaaaaagtgtcctccttgaacttcactgtccctttctctccttcccatcacatctaaacctctcaagagggtgggcttcatttgctttcctttctcaactcccactcattcctcagcccatgcagtcaggcttcactacccatggtgtcttcagcaagaccacaaatgtcctcctgagtacaaagtccacctttttttcctttccttattgaccttggagcaccatgccatgctgctgaccacctcccccttcttgaaatacccccttcccttgacttcagggacacacactcttctgattttctttctacatctctggccagttctcaggatcttttgtgtcccatcctcttctactggctcctcacatgtgggtgatatccctgactctattgtatgctctttttttcccccacggggtctctctccctgaacgccagacccttggcttcagttgccattcatgccttcagcccagacctctcctgtgggctccagacctgcttatttggcttcttggatgtgttacaagcagcacacactgaaaatgtctaaacattcacactcttctccaaagacccctgctcttcctgctcaatgaacgagaccaccatcatccggtggctgaagccagaaacactggcattattcctgactccttcctctgccccaacatcccatcagttcaaaagtcttatttctccttcataaatatctctcaaatatgtccacttcttaccatatgcactgacacaacttcagatgatttcttgcctaggctatggcaacagcctcctaactggcctctctgcctccagccttgctctactataatccattatccatgatgctaccagagtggtttttcaaatgtaaatctagccatatctgcttaaaactcctaacaaatatcact

SEQ ID NO: 80528 - DNA, 1048 bp, Homo sapiens
acagaagaaaaatgacccaagcatgtcaactcacagaggctgctccccttggtatgtcttcctcagctcatcgttgtctgtctacttcactaagagaatgggacacatatgagcatgtggtctgctttactccttccccaggagctgtctgcatgcctgtcagaatttatatttgcaaaaccatcagtgatcagaaaatactatggttgattctctgtccttgctgcctccaacagaaccacaggaaaggtacaggttccatcttttcctccctccccttctattatccatctcctctcctctccatgtccctactgcaaaaattggcctctcaatctccattctaccttctcttagttagaggcattgaaaagctacacactaggtttctggattcaaagcagcttttaccaaataaacagtcaggtggcatttggaagtaagaagtgagaagaagaccatcttcctgctgttgctgataaacaaagtaaagagtacgaaggctgtggcagcatctggactcagagttccaatgtctagtgtcttgctttgtgggatgagggtcagctgtggtgttcacagaggtagtagcagtagtgggttcctaacagtttcagtggtataattatgtatttgatagcctggttgcagaaccttgacttccacatcacaaatttcttccaaaaattttttgtattacatccctttccgcataaaataattagagtgatttctgcttacttcagtaaactgattgatgcatctatcctctgctgggtcacctaaatagataacagtttgcccaggagggaattcagtttcggttcaggtcaacccagttagtactgacctccactatatgcctagttcattttctaggcttttgccttcaggaagttcctagtctgtctgggtaaatggactcacacaaaagggtctgtaatcatagatactatttattgaacaatcaccaagcaccaaggtactattgggactttacatttgctgtctttctcatcataaccctgtacgtatgtgtatcaagaat

SEQ ID NO: 80529 - DNA, 1050 bp, Homo sapiens
gtctggagctaagtccaaagatcaaagggcagcctggttctctgatagctagtcataacctgggctattggcttaagtcaatttccttatatgggaaacaaaacaggggttcttgaacattttggagtgtgtgctccagatccctgtggcaatctggtaagccagtggaccccttctcagaacaatgtttttaatcacacaaaatgcacaagtttacaaagaaaccaattatactgaattagtttattacaatattaaggcactaatttgtgaactaatatatatgcttctttattaatgtatttgataataaagatctagtaggaggactaataaacaccttaattttgaggtagtgatgagcataaacatttgagatgtcagaaacaactgaaatgtgatatgaaagtatctgtgatttccattagtgagaaggtctaaaactactgtggtctgctggccttacattcatagtggaaggaaatgatacatttcaattagaggtcagtgaaaatccatggaagttcatggaccccctgaattctatggagactctggggtctgtgtaccccaggttaatacccctccactagataatcgtctaactctcagagtctgagtccctcaaaaattagtatctttcacttaaatttcaatattatctactccatgaatgttaacagattggttttcatagttatttttgaaggaaaatgatccaggtgattaatatgactgtttctttgatgaagatcattctttacacttaatacagctagaaagcaagtaaaagggaaattttttaatattaaaaagaaaaaatgaaaatacatattcactgaatcatttgaaggtatacacctttttaaacatccaaatcgcaagacaaatgatgtactccacttccaatttgtgcttgggggatagagaatggctgcacagctccatcagacgcatactgagaaatccatcagagcctgactccttagcaatgtcctcctgctaatgaggcttctgcctctctacggtccttgtttcatgtttttctca

SEQ ID NO: 80530 - DNA, 1068 bp, Homo sapiens
aaacatctagattataacaataacataaaaccattttagaatagtttcccttttttctagtctactactctgcctagtttagaggagtcaacctacataaaagcctcccgaaacaggactgtatatattgtatacctttcatcagtttcttctgtaaagaaatgtagatgctaagcttagcacagtgacagtccttttccctcatgaaatatatataccatgttgcttccttgaaaacactcctaactacagttaacaaaatcctgtaagttcctataagcaaataaatagtccttgattttcctgttcataatttacactatttaaataaacccatcaagtaaagccatatatttagattacagaaaactcttggcatggctgagataatggtaagctatcatgtttagaagaataggcaccactgccccttttcactgccagtatttggtactctttatattttaattcatttaatttttccccctgaatataaaagtcatccattatcattatcttatccaacattggaaaaaatatgaagagtcatatatatctgtgggtgtataaaagaatatatacaaacactcatgtatatttaatttctaaaattttaggtacataggtgtgtatatatttatgaggtacatgagatgttttgatacaggcattcaatgagtaataatcacatcatggaaaatggggtatccatcccctcaagcacttatcctttgtgttacaaacaatccaaccatactcgtgtatttaaaaatttccattatcgtcatcctgttgtgctatcaaatactaggtcctgttcattctttctttttttggacccattaaccatccccactacccttcccagcctctggcaaccatccttctactctttatctccacgagttcaattgttttgatttttagatcccacaaataagtgagaatatgtgatgtttgtctttctgtgcctggtttatttcacttaacgtaatgacccccagttccatccatgttgttgtaagtaacaagatctcataatttttttttttaacttttattctaagt

SEQ ID NO: 80531 - DNA, 1050 bp, Homo sapiens
acatgatgactattagtacagtttggtgccactgcctgatctgtatgagatgacagcagccttacgatgcctttgtgtcatcaattcaaatgttgacacagtgaaaaaggcaagtgatactctttctttaaatattaagaaaaataattttgaccttgtgggccccctggaagagtcctagggaggggttcgtggaccacactttgagaaccactgttctgtagtgacacccagaatgcagctggaactcctccctgcctaatttctgaatagggagctacaatgagtatcgacctcaattttaaaaagtcaccgaacatagatgttttttaaactacaaacctaacagacttgacaaactccactgtcattttggccactcattgtgcactgcattgtcatgtttcctgtataaccaacacatcagcctacttactccaggctgccgtgggacactctttgcagaatccttcccttgactttcagttgccctgggtgggccaggaatcagctgaagctcctggatgtttccatcaggcacctgcacggttatgtattgtgccagcttctgaacacaactgcagcagtgttccagcgcctgctcctttgactctccactgaactgtactcgaaacaggcgactcttgtcctgtttgacaaatcaaaagttatcatgagagaccctcatcatataactatttactttggggtcttccactgagtgtttcctttgcttggcggaggaagaggtatagataagggaacagtcatcttcacttattgatgcaggcatagaaaagccaataattcattttcttcccccttttgggagttgttcatcatactaaaattcacttccctctgggaagtgacatcagcaacagtggaaaagctcatatcataaagacaggaagatcactatactgattgcagatcagtgttttatcgtgctttggaataaagatttcatagcttctaattccctaagtgaaaaatctgtgaggataataatacagcaagcatagtcctgctcaaaacttttctaaactg

SEQ ID NO: 80532 - DNA, 1086 bp, Homo sapiens
aaaaagaggggtggaggtacagtgaggaaggaaagaacaaagacaagaaaacaaaaaacgagcaaaatggccaaagggccaaaggactctataatcaatagtccttagacaagccccatttctctgttcagtttcttcagttttctcctctgtaaaaacaaggcagcctctagtgcctagtgtttcttcagctatgacatatgatgctttcctagaatacctatcatttcagctcacacaaagaactaatgtcaaccaaaattgtctgccataaacactaaaaaatagctaagtggaactgaagcacctgaggctagcgggctctaggattagatggtccacctctgcaacagcatagagatggaagagtctgtgcacacagtagctggagtcccctagctactttcttctggactttttgtgctaacaggaaagagtccacataggaactgcgatcctcttaactgtctttcccatccccctccctggggtgggctggttgcctttgaagtgctaaggttgagaaatgcctggttaagccacaattaacaaaattacaaggctgaggaaaagcaaaaactaaaatatgagccagtaaatgactcaagaacttgaaatagaattatctctatttgcaaagaaggaaataactattttatactaaaaaatatataggtactacaaaaatgacacacctgaatgtaagagagcagcaaaatgaccagaaccttggccatggcttgtgccgcttaagacggattctgagaaagagcacatgctaccaaaatttgtacaacagagttaagggcaaaccttatgttttgccattaggaaaactagaatgttctaggtggtgcctcacaaggtctgtaccctggtggaatttaatccaatggctttaacttatcatctgctctgcagcttcagacactgtcttatcatgccctctcttggctctggaggttctgatccttgctaattgactaggatgctgatttgttcatttgcaagggaaggcacatctgaaagggtaacattggtggcaataatagtaatgatggattttgtgattatatttgccaggca

SEQ ID NO: 80533 - DNA, 1069 bp, Homo sapiens
tgctgtggtaactcaagtaaccctccgtttaaaccaggacagacctatgctgacaaccatttttatcactcttagtggtattttctttctttgaacatgaatgcatatttctgctctttaatggcctttggtatttaagattacattcagctagtctccttattgcatgttgttttattccagtcccaccagcactcagaacaacagcaagtgtgtgtaacagcgggcacaggcgctccagacggaaggacctcactgacgcagttagctcaggtagagcttatttctgtgttcaattttcttgtcatgagaagcagtgacccctaagaatttgtatccctttgttcaattctttgttttaggagagaaacttctaaagcattactctaaaaggtgatagagacagagacgggccattttcatctaccccttgcagagttaagttttattacagtaagttgtgaggtgagacatgatggctgcaggcacatagtcaagatctaccctcctaaggaaataaaacggggaaaagtggttgaatgtccaatatagaaaatttaatcaccactttcccaaaaaagaataaatggaggactccattgtaattatggaaatgaaatttgggaactattttaagacaaatatcaaaatgaatgtggattcagatctacaacaatttctatatgggtagattgttagtactcagctaaggatgtgaaacccaggaggattcagctgttaactcagacttgctttcagacagccccttgccccctgctgcaaaacctcttcattcaaaactatggttgtgtgacgtccactctcctgggagctctgcaaggactttgtctccccctcactgcattcctcattgcaggtgttcaagccagcagcttctgcttgccacagaattctgtgtgaagttcatcaatcttcaagtatgatttttttttttttttttgaggcagggtctcaccatgcctcagcacccagcaggctggagtgcagtggtgcgatcttggctcactgcaacctctgtctcctgggttcaagtgattttcctgcctta

SEQ ID NO: 80534 - DNA, 1888 bp, Homo sapiens
gcctcagcctcccagaagtgctgggattacaggcatgagccagtgtgccccgccatcaggtgcattgtgtcacatgtttatataaatgccatttcagaagacatattttaaaatcaacacttttcactactattatatctttacaaagaggtgaaaattgtcaccttcttaggtggcttattcccagaggcctactagtcttacctcacgtctgggggcaagacaagaatggccaggtagcagcagggccagaatgtcatcttgttaggcatatggagatcagaatttcacaccacatccctgagcgtgctgtttgaaccaaagttttgtgtggcacacggtgtagttgtgagtgacagtgcataatccctttataatttccaaatacatatttctttacagatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaggtgtttggataatactctttattctaatatcttctttaattttaggaggaagcatttttcaatactttgaagttccttagttatatatgtatatagagcattaatttctcaaacccgccagctttttcagttccttttctacctcttccacaaatgctgggaaattctgatccataaggcacaaacgtaggaaggggcctaactcttctgcaccccatgcagattgttcatagacatggggcagctcctccgatgccagaagagtctgcagggataccagaaaagtcgttacagattacaggtaaaagcaatacctggctaatagaacacaggcaaatagtgctttaaggaaagattagcgaaatacacaccaaaaaaattagtgttaattagctttacaggcttcctttacatagttttactgttacatttacaattttgtatattaatatgt

SEQ ID NO: 80535 - DNA, 2523 bp, Homo sapiens
gctctgatatatccaagctcttttagacactttagaatgaagagctgttctaatgttccaaaatctattcgttggtcaaaacatttggtagcatatgaagctttatacagactagggatattggaaaagaaatgtgacttttaaaatgacacctaaaacatgcattcggtgtctggtctgttaactaggggccatctgggtcaataacaagttacctcatggagaaaatgcaataggaccaaacaaggaaggaaataggaagtaactcagtctctcttgggtttaatgctaacctgctaaggtcaggcaaaatttaagtggatttagaaaccataaaaccttctagtgagatgaatgcagtgacaaaggacctttgaccagagagtcaactcttcattattcggactttaaagccatctttttggaggtgatattgtattaggcaatccgttatttactagacattgcagagcaccccttctagatgatgaggcggatatagggggagtgagggctgtggtccattcggttgggaagatggaacacgcagataaatcagtgtgtgctacagttccaccggtaacttcactctcataaggtggattccagaagcatcttgtttccattatccccccagtcctcttcctctcatctagccagtggctgtaatactgaggtggagagaacagtcattgtttaagctggctatcttttggcctgagggtttggggtatgttgatatttgtcggttactatgacttcttttttttcccccctcaattgcatcaaacccttaaaacatggtggtaagtgagcgatatgcatgcttttggagtttgtttaatctccgcttcagtctatacgatgcacagttcataatgttaacacttttcttcaagtttacttcattcactttcacaactaatttggatttcagtttgctgtttaatcctcatttactttggtttctgtatcttttttctgtaattctgttctttccctctcccctgacttccctgttaggggtcaagtcgtttttttgtctgacctgtaggggagagtggtgctgcagatagtgattcagtccaggagagtggggagacatgaggctcttttgtttgtcagtgtgaaagtggatttggggagacagatgaagagggctcctgggattttgcccccttgtgaatctcaactgctcccacttgcaggcatggcagctatgccggaggcactgtcgctaaaacacctccatgcaaccctttgcatgttaccagcttgttgggctggaaagtgacattactaatcagacaccagggaatacccacactccaaaaggaaaaacagcccgtggtgtgaggtgcttgggttggtgcctacagtgtcatgctttgaaaagattagcctggctattgcgattctccctcccctgctttttattttaaatttgggagtagattggtgtattcttgattcggctctcttgcattagaattttgtattttcgagtgcacagccagagcactaaaagtattccaagtttgctcctatgtcttttcatttaaatccccaaagtgcttagttcctagcatgtagctgagctggcttggccgggatgctgagcattaggatgttgtgaggggagaatttaggctgggcttttgtgtcttagtacctggtatgtctttgtatctctccactgcatacacagcacacagatgtcttgggtgtccttaagtcttagtttgttctctgtacccgtttgatagtgtatactgttgttagtagtggactcctgtggacactagtgtgtcgctagcctattgttttggctgatgagtcattggtttgtggttagttcttttttttgaaatccttttttgctccagtcactgtgtgtgctggcggtggctttgcctctccgttgcctcgaaggaacaggtggagcaatgtctccctctgacagacattactcccgacatgtgctcctgcagatgcctacactgagactgtaatctccataactgcttcatgtgcaccaagcccccttgtggaatcctgctgagaatttttctagaagccttcagtgaaatcaaactgttctgaatcatttagtttacctgacttttgtataataaaaacaaactaagagcacttacttgttcccttccccttgtgggtctttttaaaacattctctctctgtgaatgtgtatctctgcttaaaggggatcaagttgcacttagttgaaacacgaaagacttataaatcagaatcataaagtatcaatttaagaaggcttaaactcatataatgtcagctttttgattttaaaaaagttatctcatggctcccctgggtttggcttctggttttggccagggcacaggagtgagcctgtctttctgaagtcttttctagagggatgtcaccactgttcagctttcctcggtgtgtcacagaacatcctctggtatacatacacttgttgctggcatagcccagcatggctgacccaatttaggt

SEQ ID NO: 80536 - DNA, 2749 bp, Homo sapiens
tgtatgagaagaggaagaggccagatgaggttcctgacggtaagagcatccctacaaaatagctgtactgctggggttggttccttcgggtggtttccaagtacccaaagaggactatagggatgttgggattcaatccctaaaggaaagaaggaaaattcttataccagttcctaaccccctacccgtaagagttttttatttttattttttatttttattttatttttattttttttgcattagccatctagagctgtccttagctctctccctctgtttgggtgttttccaaaccctagtcccatctgcctttcaggccccatgtggtgaatgggcagctgtcagtctctttgttcagctctgtcctccttcaatacagatcatcaggcagattgagcttgaggagaatccaagtcaagcctagaagccaccccaagatggcaggccacctggcctttcaggcagatttaaggtatctaactggttgtcacatggttgcctggtgtagcccctgtaggtaactgccccagcccagtcagactgttctcagaaaagccattggaacaagccagcttttggttccttggttggtccctttgataggtttccagcgctctctgctgggtggctttccatctgtgtctcacagacaaaggagagtctgatgtatccacccatctagtgtaagacagagatagcaaaggcggaacaaatggagtccatgccccgaggctgtgccctcaagctggcctagggtcagagaagggaggagatggtagcagcagaaccacagcacaccactgagcactggaaagagcaagagctgaaatcttaggttattggatatgcctagagtcagaaaagccttgggaaatttttggtgatcgatttttcctgtgaagggggaagctgctgatggagacttgtatctgcagtacttcaggttcccagctggctccccatccccaccctataacatgaccggcgtacagaaattaattggccgactgttaccaccactagtctgtccctggctagactagacagatgggtgtgcccctgggctcagtggtagcctacccggggtgatggtggggttgccagctgtagtccagctgttctggggcctgtgtttgtgcacctgtggtgctgtatcctgccccacagagctggctgtccagtggagaatacaaagtgacatctggtgctccctcagaaagaatgtggccccagaggcatgccagtggctttagactctctgggaggacatgtttgagagcaacagccccttccccatcttttcctttcttctcagcagttataaatctctctgcctgcagtaagtagagtgagtggctggtgaggaggtttgttgatgacactgacaatatctggtgactccctccagatgtgcactcagcagtgagctgggcagaggcgtgggaaggacgttggctgggagcagacggcctctgcaaatgaatctctagtttcctgcaacctgggagtgtccccatgagttttactttcctactttatgaagtgaacctgctttctttgggatttcatgtactcctaatgctttttctctccaggtatttctttcctgctacatattaggactcccaaggcaagagtgcacctttatttagacctgggagtaaagggaaagagttgcctgtctttcgtgtgttttcagctttggctctgtgggatcagttatgcctcattcctgaaaagggcctttttatccccccagaatgcttttgctttgccaataccaccttcctcagcctgccttttggaaaggttgagaagctaaaaagtcaggtaagagaaggcagagatggacttcagaacctgatttttaaattttaaggcaaggctggctgccactggtgagagtgatgcagcagcctagcgtgttcccagcagaggtctagtctttgccctaagaagtcaccgcgcttatgaggttgctatcacagtgcatgtggtaggttagatttgagaaatggttaggattgttctgttggataagtgcagacacctgcccagggaagcagctctttttttgtaagagttttcttggttactgaaatcaaatgggggaccagtttgttataggagacatctgtggccagcaaatctgaacagcttcctagagggaaagtacctcttttaaactaagttattatagacagtgaatgaatcctacccttaaaagagatgacggcagggtaagtgcaaagtaaaacctccttgctctagtctcttgggagagtattgtaatgaaagcagcgtttacttcgttgttgttgcattggggtgaaaaatctgagatgctggaatgatggcaatgtttgccttctctccttcccttcctgacagccagtgtgggccaggctccactctccatcttcacaccctgcccttgctccagtatttccattctgtttttctcctctgtctctttctgtctttctctcaaactccatcctgcttccacccctgcccgcttttcttctcctttcctggaagtaatcattaaacaaaagaaaaagttgaatgttctttggtgagtttccttcttctctgccttttccttctttagccagttcccctcaacccctgtgcactccataggaaggacaaacttacctgtctgcttccttcccatgtgcttctccccaaattttcatatagatatatacgtacactccttttggaataaacgaagaggtac

SEQ ID NO: 80537 - DNA, 1052 bp, Homo sapiens
cttctccctatctcaccttctcactcccacctgcccttagtaggatataaagcatgcagcatattttagtaaatatttgttctcttttatttgtttgttttgttttgtgttaagacagggtcttgatctgtctaccaggctggagtgcagcaacctcctgggctcatgtgatcctcctgcctcagccttctgtgtagctgggaccacaggtgtacaccactatgctcagctaattttatttttgattttttgtagagatggggtctcagtttgttgccaaggccagtcttgaactcctgggctcaagcgatcctcccaccttagcttcctaaagtgctgagattacaggcatgagcctctgtgcccagccacaaatatttgttgattgattgaataacctttcctctaacctctagtccttaaatgaaaggaaagttatgaatttcccccagtctgactaggagtgagttcttagcattgtttgtggaggaagtttaaggagacttcctcagaactcaccaagtgtgaagtcagtgtgctgactctgaggtcatcagagaggcctgaggtccccgaggcatgcctgactgtaggggttgtacccctccttctgccgtcctctttctgctgtggtttcttacctggtgttggaggcagcatttactaggttgttggacttttctgagtctccaggcagtaggacctgcactcacttcgtggaagtcggggaagtctggaggaccgatggtaagggaggcttgcctggctctgtcagaagttgatttgttgttgttgatactgaagggaaatcattaatgaaatgttcctagacactgcttcctcattctggctggtgcctaaaaagaacggagagcagtgtcaccctctcttgaacattagctcagttactcactctcacctttgtgtattctcacttttttgcaggacattgtcaatacctctggccgcttcttcatcatcaacaaggaaaattacactgagttgaacattgtgaacctgcagatcacggaagaccctggcgagtatgaatg

SEQ ID NO: 80538 - DNA, 1046 bp, Homo sapiens
atatactcccttattttcttcacgaccatgctaaagttcatctcatcacaaaagccttacccaaccagtctgacatatctggtgtgtagtgggtgctcagcaggtgtttgccagatgaatgaagcatggctggctggagcagcacatggtaacccttcgggcatgctgggtcctgtgtggctatggagcctgctccttggagtgcttggaatttatggactgaagtaagctctgagaaagggtgaccaggttgaacagtcagcctaagaagtgactgagtagctgtgggaaaagttcggctttgtgggaatgagatagagccaggttgaccacttccttctgtagtaagaaactttgcctggaaaaaaaaagatatttcctttgaaacgtactatctagaaaacacttcacactgagtgttactcagcaggcctcagtttggcagggactggttacagagacagcttggggccttgcccagtgcatgcccatccaggtgcctctggagggtgagtctaaaaccagtttgtgcctgggaagcacattctgtgactagtaggactttgcattgtttttaagccaagaaaaaccaagccagtcaaaggtggaacatgagattagccccaatgcaatagtacaggcttctacagtctcaagatgaatgttttgacatcctgttcatctacccaagaacactgggaggtagacaaggacacgaggtgtctccatttgataatggctgtagcagcaaagcccagaataacgaaagaaccaacaaaactggaattgggaccaaggcatatcgattctctttcctatcttggataacagagtgacatccagcctgctttgacttttattgctctcagattactgtaacccggctgggcgtggtggctcacgcctgtaatcccaacactttgggaggctgaggcgggcagatcatctgaggttagcagttcgagaccggcctgaccaacatggtgaaaccccatctctcctaaaaatacaaaattagccgggcgtgatggctcacgcctgtaatc

SEQ ID NO: 80539 - DNA, 1036 bp, Homo sapiens
aggattttgttggtcatccaatcctttgcaacaaatatgtcactgcctcttgtgagaggcacttcccagcccagaagggggttgagcctgttgtcttactaggttcatctcaccctccttattggacatttcaaatgagtttcagtcttttggctgctgagagagccaggattgatcttgtttttctcctccctactccttagctttctctatatttgactattaagaataaaggttaggatttctataagtggccttgccctgccttcctatttcctattctgtcatggtgcattacaagtgacatattaatccagactggctaaggcagtgtggtggggatgaagatcactgtgaagaacagtgatacccagaccacattcacacggcactttcagcatgcacagcatctccaccgtcctttcttcactgacagtcaggaaaggcagctagtgtgataggtgaggatgcgtagaggttgtgacatcctttaggtgagaactgatgtcaaagcaacctgcttctgactcagaattgctgtgacttgagaagtctttgaaggcataataatatcatgaagctgctagggcattttgaacattaacttcagcccaaaaaccacacctgcactttcttttcctctcttcagggtgccaccctgaccttccttaataagaataagaatagctaacattattgcacacttactgtgggtcaggcactgtgctaggtgcattatttgttccttttctctcctttagtctccacaactctatgggataagtgcaattattatctctactttccagttgagaaaattgaggcttgagggaataactggcccagtgtcacagagttaactggtgaagctagggttctcactcaggcaccctagcactagatcctgtgctcctaagcaccaagccatggtgccctgttgagcatgtaacatttaaaaggccttgactaagagttaggagaaatgtgttctaatcgtggtcctgccattaaacacagtgactctgaccagtcactt

SEQ ID NO: 80540 - DNA, 1127 bp, Homo sapiens
cctgagtgcaagcagtctccccaccttggcctctcgaagtgctggaattacaggcgtgagccactgtgtccagccttagacttgttttttatgatacctcctttaagatagcagacatccaatcatgtttctcttgggtcttgtactattgcctgcaaagtgctgagctttaacttcatgaagtttcagcctgactttataaaatgctgcttcttttttcccctcagcttatttgaagctctccaagggtgttgtgtatctctagagtttttcagggattctacatttcgtgaaataacaactgatgagttccttgggctaccaaataagttagcctgaagaggcgatttcagaaccctgcttctgcccagcctgtagggaacgttttccctttgctttaatttcttcctaatagctagtccaagggaatggtgtggggagattttcagcctataggcatggactcaagtgtgggagttatcttcccaagtatttctcaaagaacttagaagtctaagaacttcagtcttaagttcagggctgagtttgaggaaggaacagcaggtctttcttcagagcttggactcaaagaacttcagtttaagccctgaagaaagagctgctgctccttcctcaaactctggaacacttgttgataagagcagctgacttgtctgttttccaattgggagcataatgatttaagaagaggcatggtgtcacattgagaagacactgactgcttctcacagaatattgtgccgccatgtggatatcttgagacagctctggggataggctatgtctctcctcgtccatagtctcttaacctgtgtttcctttttggaatgagcaatataagatggataaatgcattaggccagagtggtcgagtttaggagtttttcttagacattaaatagtgcagtagagatttgaccatcacaagtatcatattttaacccctaagcaaaagagctagaactcagccctatataactatttatcctctcatctggaggctgatgtttttcttctttctgtaattactcactaacctttctgcatgtgtttggtgtatgtgcttgtaggccagagtgtactgagttgatgtgtagttgaccctc

SEQ ID NO: 80541 - DNA, 1032 bp, Homo sapiens
tataaatgatatggcctttgtcttcagaatggcaaggtggagcctggttgtctaattgaagccgaattgtttggtggttcttataaaaaggtggtattcaaaaacgtaagtggattattaccagtacaagcacccgtaatactcccattctttcacgtctaggccaactggtcttcaggctgttgtctgcgctagtggtcatttgcttataatcattgtttttcctttcttgacttcctccaaagtggtaaagtgaaattcctcatgtggtcctgtctgccctccctctttttctagtttccccctcctaccccgtccaactctcaggccagggctacagaggatggaaggctattgccccctatcattgtgcactcttattacagagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggtgagagtggtgggcagctcctgggaaggtgggagggagtgtggctgagcttacttgacattcataatccatagttgcgccatgcagaagggacatgagatatatttggttctccctttgagagtccaatccagtatctcaggtaaggcccagtagtctagaaaagattcccaaaggattctaatgagcagccagattggagaatcatagatgatcccctcactataatcatagagaaactgaggctgtgaagtagtgatttgttcagggtaacaatgttagtcaataggagagtcacacttagaatgtagtctcttgacctaatccagtcagattgaagttaggtttgaagaaacagattgaagtctgctttgtgactgtagagcaagacatctccctaagccatctttccactgggtagatttcctgtgaattcccttttaggagtgtgtaacatcactgtaacctgataag

SEQ ID NO: 80542 - DNA, 1074 bp, Homo sapiens
cttttggaaagatcctctgggtttttcaccttctctttgaggacacaatgagagatctatagccagttccagcttaaagagctgattgatctagagaaagtaagaatagtaaaatcttactttgatgaggaatttggtaataacataaagtagtaagacatgggccttgagtctatatacttagatggaaaatagcaaattagtgtctgttctttgtagccacttgaagatcctatgggtaaaaaaagagtcctttgtagggcagtggtaggagaggctgctgcagttggcactgttgaatcaaagaacctgcttctggaaagaggaaaagaaaaccttgtctatgtgaaaatggggaacattaacccagtgattttttttttaacaatatttttaccctgcacgcctccttctcctgcccccttgctcctttccttataaaagcagaattacctacatggccacaaaggtctgtggaagtttataggtatggactgggctgggcatttgcacttatacttccaagagcctgactcatagctagaatggccatgccaaggggctagaaaaagatgaggcattggggtacctacctaccaatcccgagaatacatagcattccccagtttacttagaattgtctgcatgtggttgaatcaaatccaaatcctggctagactctcttcagacttccccatcagtcagttaacccaagttagctgttttggagagccaggaggttgttgctgctgctgctgcttttttttttttttttttaaaacaccctggatccaactctaattggactgttttatgatctcagcgtcccaaaagacattgctctatggggacatcaggtgttctatctaagaatgacctcctggtagtactttccccaaagctcattgagtatgtaaggcaagaagagaagtgtgcccagtttttaggtatctctctggccatagcatgttctttatatatgcatgatggctggggtaagggtctcctatccactgcttttaaatagacatcagtggcaggtaaacacatttgaacttctcctaaatgttcatc

SEQ ID NO: 80543 - DNA, 1404 bp, Homo sapiens
tggtagtttgtgagaccgagacatggctccttggataccactttattgggcagtgagctcagctcttcatgcaggggcttgggggctcctttctgtaattctaaagcttctcctgcatctgagaatgacatctgttgggcttcttggggcctctggtagatatttccttacaaggaatgcatgctggatctgaagaggtagtttaaaatggcatattaaaggcagaacgtttagtctaagcctgttaatcactgcattcctgtgctccccagagtctgaaaatgtcaggaattgaaagactagtatgaatttggaggtcttggcctctacttgagtaagtatagtacctccattaatgttcttagtccatggtgtggggttatcaccaaaggcaaatactgctatggatgtaaacaggaatttttccacttagtaacctccattttcagctagccctgttaacatccttggcttctggactgtaggaaaacagttccatttatttcatcctttcctctggaatgttcttaatttgatgttggcagatcctgacctcactccctgcttactgcacaggggctggcttggcttatgcagcaggcctcccaggggacgtttccaagccaatcagaatgccctcttttagtgtctctctttataccttcggatactgtctgaatcagtagaaatgctgaatgaaccctaggtggggtggaagggtaagagagagtatgcttgcactctgattttgtttcctatggacctaactccaagtttttaaactaagcctggattttttttttttttaactctttctgccatttccaccttgtcttatggaagtgtaacctcaagcaaattatgggcaattagaggtaggcatcaactttagttcctgggcagttcctaagagtgttggttgaggcctggctttcaccctagtgtttagtttaattcatcagggtacatttctcattcttctgagctggcttctagaagccaggcaattcaactgtatggagcctgtcaaataccatagcttttcagatttttctaggtaatggatctatggggttatggagggcacagtccctccattagctggcagtgagttgggttgctggtattgttggtcccacttctgagctgacccacaaagtattaatatctcactgtggtgtgaagtacagactgtcttgttctcctgagggtctgcattcaggaagaggctgcctaacgctaaacaactgggttgtttgtttgccataggcccagggaagaataggaggtggagaaagtctaatcgaacccaggatagaatcctgtgtgagagagaaatttgctactctttcagttgaaatttgaactctgaatcccaagagaaggcaccagtaggtcatttaa

SEQ ID NO: 80544 - DNA, 2915 bp, Homo sapiens
ctcaaaacctgacaccttttcttaggctgaaattaagctaatgtgacatgatctcagattccataactacatcttatattttgtaaattaacagtttggcctgttcaatatccagtatcttcccaaatattgttaagcagcctgatttataattgataggattattttctactttaaaagaattttttttgaaaaggagaatttgtactgcctctctttattcttattattcttggactttccagattattcataatatcttagatttaatggtttataactctgaaaacacttgctaattccttgagtccacatacatgtgtctgctattatcactttgttcattccagtttgctctaaagataggaaggaatgaagaattcccttctttttcattcccttctgcagttaacatttccgttctggttctcattttatttggaaggttaaggttagttttttgttgtttcttgaagaacttggattttaagttaagctcattttggatgtgaagttctgcttcccagcctgttgtggagcagtgctgcaggctgctgcccgtggcctgtttagcacttatttctatggagacatataataatagctaacattattgagtgcttactatgtgtcaggtactgttttaagctatgttatctcatataatcctcacaataaccctgtgaggtagctgctattattagtcccgttttacagattagggagatgaagctcagagaggttaggtcacttgcttacagtcatacagttagtgacagagccttatgtgaatccagacaactgattttagagtttgctgcatttggtcactaaactatgtagtttctcttggcatgaactagattcccctatttttccaaagcagaaggctggctggtatagatgcctttggtcattttgaatggtataatttcagaataaagggtggaccctggtttagaagctagtgatagggatgatcttaatttccaaacttttgtcatatctgcctgatcaaggtacctgtggaaggagcaggtttgaatttggaaaatgttttgtaattgctgccatctctacctagagatgagactaatctgtggtacctcttcctgctgcagagaatgaggttaccccatttcctctgctcccaggacttcaagcctgccttacccttggtcagtacacacagaatgagtgcatatagacttctgacctgcctttggtgttaaggaatagtgatgaatgatctgtttcctgattaacaggaaggataggcaggctctacagtagtttgtgtaggctcaagtctgtgacagcctcacagcagttaagggtcctttagacatttgaaatactcatagttcctgtattcacgtttagatgtcagtgggtcttgctcagtctttattttgaggtagacgatttgaatttgtgtgtgtgtgagagagacagaggagagaaacgctcttatgatcttggctgtcattttctctttattgcgaggaacgaaggagagaacagcatgagccagccacagggaattagaggtagagggggtttgaagggaacagctgtttttaaaagaggtgacaaaagcaggcaagacttaaaggcctggccttggcagtagtcagttgagggagagagaaagttagtctgatttcttgttctgtgggttgccctggaggtaaatgtgaaaaatcatgatagtctctcctatatagggctaggctagctttttttacttccttagggcatatatgaaagcagttttcctgggattgggctcaacttgctcttctgtgtttcctttttcttctcaccctctgctacatatccacacatccagtttttcctgccagcaagctcctccttttctccggctgctagtcccagctgtcatctttgcctcccatcccccatccccagttatgcaattttacattacgcttctcttgggtttgctgcctccatttttaatgctctgcctgctaccccctccagcatcagcttctagtctcttcctccctcaaagccagtaaccactgttcagtttccctctttatcactgttgctctgaatgcactgatattaatactttcccaaaactcttgcagatctgggcccagtcacttaagatagtgggtggagacgatggtggggaagagggtggggtaggaggttgtcttacaaaatttagggtttttccaaaatattggatgacccttgacctagagagcaaacagatgcttctgttggcctcccaactttaggcagtgtgtgctttcttgttgaaggtacatatttgtttgaaagcccttagtaatgaaaggcagggcagtgagtcaggctctgaacctcctgctgctgctgctgagagccagttcttttcctgaattgaagctaattttggatggataataaggtggatggttgctaataactttcccttgctaattgtgatttcacagtactttgtaaagagggttcttttctcttttctctttttctttttcttttctttcttttccatgctgtttggagggggaatagatctcttttcatggtttttgatgagtgttcagctatcaaggaattccttagtttgtttagaggcagcacagtttattggaaagaaccctagactaagctaagacctgcattctagtcccagccccactcaggattaactgcctaagtgattttgggcaagtcataaacctgtctccgcacctgccctatgtatgaaccttgtggaactgtgcgaatgaaatgagatgtgatgtatgtggaagctctttgcaaactgcggagttttataaaactttcaggtgctgccctttattaatttggctcctgactacagcatcagagaaatttttccagtgtcttgtaaattccttccttctctg

SEQ ID NO: 80545 - DNA, 1426 bp, Homo sapiens
gctttaatgctaactggagagtcagttgaagtacactctttaaatgttttgtaactggtattatttttcttttaattaattaaaattgtttttggcctcaaagctccattttggatgtagttctagatctgcccatagctacttttgacaatctcttgggataagagagcttttatgagcatttgcttaaatatgtaagggtttcacttacatatttgaaccagacctttcattaataactctctttaagatatagcttatttgtgtgcatttttctgtttcccctgcatgagacattcctggtttttaatggctagcaaaaccagctttttctcttagggaccagcagcttaagtactatttgtgaagttgggaagtgaattacctaaaattcccctgaaaatactagcttgacaatagtttgtggctgctgcatttttctccttggacagacacatccttagttttaaaaaagtcatggtcattttgatgtcaaagtcaaaatgggccctgatttattgtatttggccacactttcttggatctgactgctcaagagtaaattaaatgcctttttcctccctggggtgaaggagaaacattgttagtctccagcagtgtctttgataatgaagctgtttacctgagtactgtaaaagcctgcaagtggctagcattttctttttattttttttgagaagtagtttgctttgtcacccaggttggagtgcagtggtgtgatcctggctcactgcaacctccacctcctgcattcaagcgattcttgtgcgtcagcctcccaagtaggtggtattacaggcgtgagccaccgcatgatggccatagtattttctgataagtaacatacaggcagagctttcaatctgttaagagtccatgtgaggatattcaggatcataggaaggaaccctggaagacagacgtacaaaaggaatgcaagaggggttcaattgtgagctgattcttctctttgcttttaacattttccaattctttttttttttttttgaggtgagtttcgctcttgttgcccaggctggagtgcagtggtgcgatctcagctcaccgcaacctcccctcctgggttcacctcattctcctgcctcagcctcccgagtagctgggattacaggcatgcgccaccatgcccacctagttttgtatttttagtagagacgagttttcttcatgtcgttcaggttggtctcaaactcctgacctcaggtgatctgcccgcctcggcctcccaaagtgctgggattacaggcatgagccaccgcacccgacctacattttccaattctttctgtttctcaggtctgatgtcaggttctatttttgtaagattttttttttttaaccagaatttattctaaatcatttttattaatttctggcagcctta

SEQ ID NO: 80546 - DNA, 1047 bp, Homo sapiens
taaaagtcattgttttgaaatcatagtgacacagtttttttagcaactgtttttgctactctacttcttttggccatggatcacagacccagctgttgggagaatctttatatgatttcagaaacatctgtgtggctcttatgcctttgttttccttccatttaaacaagctcaaaatttgcacaatatttgcacagtttcagattctccaagatattgtcagagtatggtccctggagcagcagcacgggcatcacctgagaacttgtaagtgcagtctcaggcctcagtctgtgttctaacaggccctccaaatgattctgctgcatggtaaaatttaagaattactgctttagaattttgtcatctaaggaaagctttgccttttgtatgtaatgacaaagttctcagtgtgatttctgctataagctatttatgctttggaaatattaatagttcatcagctgggaagactaggactacggttacctaacatcctgagatgtgattcaaaacttgaatttccctctggtcagagtttttgactctgtggtttctgagaatggctgtttaaaaaaaggtggggagaagtagcttactacctctttcagttaaaatgtcttctagattatacttagactatcagcttggactgcttgtgttcattgtcatattcatgcgatatatgatgatggaagaatgagatgaattttggtatcttaacatttaagtcctgattgttactgtgttgtcagagacagaaagtaagcttgttatcagaagttacgctgaatttatagacaggtgcatttcacagaaaaagtttggcaaagattagcttttgagcagtaattacctatggcttttgagaatggtttattcaacttgctaaagaaaaaaaaatgataacgtgttaaagcatggtaagaaaggctttatttagaacatggtgatagatgtagggaccagaccactgcagtgagattctgcactggggagagagatgggctcagctctgaatacagcataggcaggtgggggtcagtg

SEQ ID NO: 80547 - DNA, 1600 bp, Homo sapiens
acacacatacagcccccactatcacattcccaccagagtggtacatttgttacagttgatgaacctacactgacacatcatcactcaaagatcacagtttaggactttgagtttagggttcattcttgatgttgtgcatactatgagttttgagaaatatataattacatacgctaatcattagagtattatacagatagtttcactgtcctaaaaatcccctgtgtactacctcttcatccctccttccttcttatctcctgggaccactgatctttttattgtctctatagttttgcctttttcagaatgtcatatatgtagttggaatcatactgtgtacccttttcagattggcttatttcacttagtaatatgcatttaaggtctctccttggcttttcatggcttgagagtttgttttgtttttgttttgttttgttttgtttttgcattgaatagtattttactgtttgggagcatatttaattttaagaaaatgttcttgatagtctgtttcgagattggcatactaaattccacaagtgggaacttttaattatttaacagtgagttgaatacgtgataaattcccatttaatgggagtgaaattgcgtattactttaagaatgattgtcttcctgaatgaacaataattatatgagttgttgagaattcagggacaaatacaggatcttcataaactgtgtcataccaaatatcaaatattctttggactctggctcagtgtaactgtataaataatttttgctactatcacaacttaagtagtgggaatgtttgcagtttcagcacattgtccatatggtccatatgtaacggagtcaaatttgtctcatttttcaagattcaaaataagactcagtaaagttctgctgagcatcctcaattttttttaaattgagaaaccactggggcctagaggggggaaaatgttcccatttcatgccattgtggaagtgaagagtctcttgttcagttgcctgtgtatcactatcatatccttattttccaaaatcatatttgtttaatctttacagaaatactggaggggaccagaagggtaggaaaaggggcataaacattgtaatatttcatgaacttttatcacagtctaaaataggggttactatttctgttaatattttctctagaatcactggtccgtggcatattggctttgtttcttttcagtactctttactgcagagtgggagttggtttagctttgggctttaggctgagattccgcttgttttcctttttaaaagttgagaaaatttggttgggattatgcgttagctttttctccacagaaagcattccatgttaagtgaaataacccaggaatggtaatttaaacactgcatgttctcactcatatgcagaagcttaaaaaaaagttgatctcatagaagtaaaaagtaggccagtacagtggctcatgcctgtaatcccagtactttgggaggtcaaggcaggaagaccacttgaggccagtagtttgagactagcatactgtacaaaaaacgtagcaagaccctcatctctacaaaaaactaaaaaacttagctgggt

SEQ ID NO: 80548 - DNA, 2783 bp, Homo sapiens
taaagttattttatttttcctatcttaattttattctcttcttacacatactttcttgatcctgtttcttctggtatcttcagttgtttctagataaacatttgccacttaaaatttttaaattctattttaatcctttttagacagagaggtagtggttccatattctaagtgtaatataaaagtttagatgactggtgtttattgagcaggagtgtttccatattgtgagtgggtatttttgcatttcctaatagctgtttaatgactttctttgtatggtagagatctttctaacatatattttttttaactcttttaatccccaaagggtcataatgcccatgtttctcagaaacagctcagctggtcttcaaggcctagtcacaaaggaaattaattcctgatggaagtgaggacatcgaggcagaaagaattccaggcaggcggctagtaatgaatattgattgtgagctatgtggtacttgcttccctgcagagctaccacttactgtggagtagcatacgtgaaacgttgtgaaacgaaatgtctgcccatggagcatagaatttgctactcagtggcaagtagacattaaaaattcaattatgaggtggagtggtgctaggggtagtcagactttacagctggaggatgaaagggcaaattttgatatgcattaaagggagaaaaaaacaccagtagagtatataaagtagtagttcttgctgtaggaacattaggttatagtgaaaattgctcagaagttatcagaagaatgagctttcctggcatttgtattttagtaacacgtgtgtgtatttcagcagctttgtaaagccgaatgggagtttgagtggaatgtgtttttagtagtgtcttagtagagtgtcaccttaccattctgcaacactatctgtttgtcacagaaagaactaaagaattgtgtcaagtcttgaactctcaaaatataccactggaaaaacttgacaggcccagtagtaggtgagcctgaggtaaccagatacataagcttgtcagccatctgtgcctagaatttagtgaagttttcatcaggtcaaatttccaaagaatagctgtaactaaccacaggagggaataccagtggttagttaggaaggatgaatcctcctgcattggatagtggttagccaacattttgatactgaattatttcattcagctttttgaaagaaggaaaaagttattggatttttaaaaattatgaaaggatttgcttacatgataacttcaaataatactttggtgtttaaaatgttgaagttcttccttttactccttgatattcctgctttttagttagcagtgttagtagtttgttgtgtatcctttcaaagcttggtttatgtaggcatgtcatttacatactgtgatgctttgcatttagtagtatgttacaattcatcttggtatttatagtctttttttgaatatagtaattggagtgacagatattttcatttatgtaaacgtatggaactgctggaatacatctgttgttactaattgtcaccaaagggaattatgttgatagtgactgcattcttgatattgaaattggcctactgagagggaagcagggaaaagcttcattaaatggaatagaaaaatatactacttcaattttatccagtttttggctgaagtcttcagtgttcacacatttaatatcttagccatgtgggtaactcctgggacagctctgctaatttttagcgaaagcattctggaaacaattttgctgtcccttttcaagacaagcagcaatattttttactggtgtttgggacactaggtaagtagtataacctgactctctacctcactgcagaggtgaaaattctacttaatcatgtagttacgaggtaatacagacctgaaacaagttgaggagagtagaaataagaagtaattgtgaagggagaatagaatagatttggacaattggctgaattttgggatttcctgagggactgaggaggcagcaggttttagtggatagagcattagtgaacaggagtcagaatatttgaattctagctaagggttctgcaactaaagtatagcctctttggcccgtggtatatctgagtgttaatttggggcaagaattagatttaggagttttcaacctttagctgcagaaagtttgttgttgttaattagatacaagtagagctgtttgaggggtagagggagtcccataagtgttccaaagaatctttagggtctgtggagccgggtttttaaattgaaaaatggatgacccctttgtagacctacttttaaagtttttgcataagagtgttttgtacctttggttcataatgtacttggtcagtcttgatacctgcacggaagaggtcctgtgcatactttgtaaaactgagaattaagatacttatatatatgtccattgttgaaataagaccaacagaaaagatgacccatttaagatagaatgtataaaatagcacaaatataattaccctatgcaaaatggattcagtaaaataatttttattacaaggcttgccaacctctggggaagaaagagctacctgtcacttacccgagttttgaaatccaggtatatgtacatgatagagtgcagaaatgtgctgttaagtctctggttggaaagaggatgaacctgctattttcatctcttcttggtgggaagaaaatcttaggggcgtatcattttagtaaccatcttggagatctgtcagtaagaact

SEQ ID NO: 80549 - DNA, 1437 bp, Homo sapiens
tttgttttgttttgaaacagggtctcactctgttgcctaggctggaatgcagtggcgtgatcattactcactgcagcatcaaccttccaggctcaggtgatcctcctgcctcagctttccaagtagctgggaccacaggcgcatacctccatgcctggctaatttttgaattttttgtggagatgaggtctccctatgttgcccaggctggtctcaaactcctggactaaagtgatcctcctgcctgtgcctcccaaagtgctgggattacaggcatgagccacagcccccctgccagccagaagtttttaaagatcagaaattagtgtttctagctctaaacttctatgattatgaatccaagtaaaatggtagattaactttggaatccattaaggtagcttttaggacttgcctgtgatattagaacagaattttgcttactataaccttcagaagcaacttctttttgttatcaaaaagctaaactatgaaatccttccaatacgtgttgaatacaaagaagcctagataataaagagcccgttagactttatatgaaacctagtaaaagtataacctttggccattagaaattaagctttttcttttatatggtaaatgtatgctattaaaaacctggaaaaggacactttcatcctaactcctaagacttcattagttaaaatcctgctgtgatagaagccacagcctgtctttagaagtgggagctggtgctgtaataccttggtagaggtgggagctcactttagtttgaagagtgtagggttgtcagataaaatataggatgcccagttatatttgaatttcagatcaaaaatgaagaatttttatttacgtaatatggcaaccctggaagaatgtatctttgctattttggccttccagttagaacttaaaagacagccttgtaatttggtgaggtttttgtgtattaaaagaaaccttcctaaagtagatttaatatggacaaaatcatgttgcattgcaaattttgtatgagaaaatataggttagagtagcattgttttattttgataacctcacatttctatatgtgttttcttcagttcagctaccttatatctgacagtaatttttttcatttattctctgaaattaaagctgttttcgagaagaaggtgggctgagggcgtcaggctttttttttttttttttaaaacaattctccctcttcttacctaaaatatttaaaaatttagggcattattgcctaaagggtatatgataaggatgtttctgggacttctcgtttaaggattgcccttttccatatttgtgcctgggggcttggaatatatttgtattcttggtttggaagaagaaaaaggtataaatgaagatgtgattgaccacacccttttctttctaatgggttcaaaataattttcactt

SEQ ID NO: 80550 - DNA, 1014 bp, Homo sapiens
aaaaaaaagctctttagaaaaaggctttcaaacttttttgtctgtgacccagatagagaagtagtttttgactaatagaaatttataacaaaattacacaaatatgtaatatcttgtgaaacattacctattattaatctgtgtgaggtagttaagagaaccatagtgaccttctaaattgaattcacaattcatgggccgtgaaactcagtttgaaaaacagcattttcaggtatggagtagtttggggcttttgtttattttttacatgccatgttagtctggaataattatgatttttgttaacacaaggattttcactagacatttatcagtaatatcagcatatactgttattagtcattatgagtaaagaaaataaaacattttggatttatacattagccattatatatagcgattttttttccttttagaactttagaaaaaggggaagccacagtaatttgaatataatcaagacataacttttccagtatattcagttgaccttccttttaaattagaccttgtgttccttattcctgagcctttgagtttgcagggctgggagtactaatgtttattctaagccaaatgctttacttggttgctgtagtctgaggcacatttctgttgagtacagattgacttgaatactggccaagggaagagagagagagggtaagcagaaccatcactaaagaatcatctgccgttcatgtttaagatcctagagtagtgggattatttcctagtttttagacactgcttcctggaggaaaaaaaggcaacaagatgtcctcctttgttggcaactatctgtgaaaaacttctaaattcatagattgaaggaatgtgttaaatttaacttgggatttttttgattatacgagtttagcaggtttgggaatcattgccgaacaactggaaaaaaatagcacaaggagctccagcattgaaattatattcattaatgctgaatctcaaatcgtgcatcaagggagatgaaat

SEQ ID NO: 80551 - DNA, 3755 bp, Homo sapiens
tccactgtggaaggcagggtagagttagtcttatttgtcttatcagtttttcgactgtgtcaacatgacttaaagaagcctaatgctaattttagctattcagtttatggtaatagcatagtttcattttgcacaataggtgagagattcttgatcttaacatgtttaatctctgctggcttagcttttttccaatgatttataatacggtaaaattgtagtttcttagcaactaaagcaaggtttctggataggcctataaagactcatctgtctgctcagtgatatgtgttctaaatacagcatagaacggcctttcccttgaaatgagcttgaattcagtcacatgacatgaccgatgaaatgaagctgagctgctggttgacccaaatgaatgtaaatttaattcaaggaagagatggctatttttgagtttgagttcctatagttatggatgccattttatagctttctatataacatgtcttattataatattcaagctttcagctggtaataaatagccctgcagtgatctgacttcatgtcatggagtttgtgttttcttacagtgctttcaaaaagggataccttgcttgtgcatgatgttgaaatgttagaaatgttagattttctatttaaatgactggagaaaaaaactcacaagtatctctgaattgggaatgtagtagtttagattgaatatagatgtttttcaaaaggcatttgtttcattattcctaaaatgaagaatttggcctgtatgactctcaaggtctcttgaagctccagtgagtttctgacccattgttgtggacattcagggctttcattcagatggattttgtttctcatccaagaatttaaacttgtaagaccaattccaagtaaaatccttatttgttgacttctatatgtatcatcaaaatggtagtttaaagaggaacttgttctaaaaagtaaccttataagacattcaaaagcattagactgcaattgagtgagtgtaaacaaagcagtataatgtgatgatcaagagtgcaggctttggacggtgacagactcaggtttgagttccagctgtcagtagctgagtgatcttgagtaatgcaaacttcagtttcatcagttcatcatctgtaaagtggagattacaatcatgtccattccctagggatgatgtgaggattaaatgagataatgaccgcttagatttcagcctgagtctcagtacatgttagctattactactatcctttaaaaaggagcattattttttatttatttttcttcatgtgtatattgaaaacttgattgttaatgctgctgtcatggtaaataggccatttgaaggccccacatagagatttgtgcttttgcttatgtaactttctcagaaaagtgaccagctgcactgtgtctgcaattgccaattctggtgaggaagttaatatttttatttgagtttctgggagagactttatggcttttttttttcttttttttctgtgaaccaaatctttcaagtgggccaggtatcactttctcatagagtattattgttgtgaataagagaaatagagtgtggtacccggcacacagtgggagtgttatagatgttagctgaattaatgaatgtggagtggtgtgtaaaaacgtaatatattcatatggaaaatatgacatcacaaaattaacactgttcaatggaggaaaataaggaatctaatgaatcttatttttaacgacctaaattttagaaaccattttgtttgggtgatactagatagttgtgaacattgtgctttgtaataatgccagtatttgcattagatgattcatggatctttttcttttctgtcaagggctgtttgcttcagtggtttagcaattttctctcactgagtacatttttagaggtgtatttgctaattgattgcgtgtttcctctttgaactgaaatgagcaacagaagacacatcttatctatggcagctgtggcacaaatgacatgccgaatgtcaagcaaaaaattttgaaataatccaaataagatttgaccagaagaaatagtttgccttgacataaagcccttcctaaggagatcacaggctttcagtctctcaggctactggctaaaatgtcactactgatataatgcagcacccaggcatgagaaattggttcggtctgggaggataggccatgttactacatcaggacccattccctgggtttgttttacaaggttactggatccaaattagaaagagatacagatgggtttttgtgttgccagacgcagtagagcttaacttgtgaatataccaagatttaaaaccacaaaaggaaataaaaccccttagatgtgaggttggaattcattacaggtctgacttcgcttgattaatacagatccttatgagaaattagactgttttaagggaatcccattgttttttctcattaatacagatttgatgtgaaacagtttcttttgtggaatatgcctttagacattaataaaaagcaacattatattatctttattttaactttaaaataaagtttaaataaaaataattatttaaattaaaaaaagatttaattgggccttgaaagatgaccaaatgtaattagaaaagtgctctgtcagtttgaacattgtttttcattagtctgaggtactttttaaaagtaagatgttttgtgtgtaaactctgaaacttgctgggtctgtgtaaaggttttttacaacgattcgggaaggagataaagtgctaatatctattaaaatgaagtatgtagagaaacagtgagtgaccatgttggataccatacaagagatgttcaacaaaagtttgaataaaattatgcagagtagttttggaaaagtgaattttatgaaaatcgttctgatgtattctattcaatttactgtttgcagtgagagtacaatctggacaggatcagaagtagagaatgaagttgtaagagaaagggaaagacagaagaaaggctgcagtagtacaaggagaaaagcaggatgcaagaatgaggaatgaatctttgtttgaggagcatccggaaaaatataagctgtcagaaagagtaaatagaccagggacctctaaagtaaattcacacatcaaagttaaaataatgttggagaatcacctcctgtgaaaaattggcttagctttcagtatgcctctttaaacaaaacattatcattttatacaaatttttaaaatgttgttcataatatggagtttaattttaagcaccttagataatgcatttgtaagcttgtttgtgaaatttttatggattttttttttcaaaattcctaattttagttggtaaggattaacttcgggaagacaggaaacccctccagtaaaattaattggttataaatggttacatattttaggcttatatacataacaaaacttcttactgaatttaaaagtgatcttgtgtaaaaacattattctagtgatattgatgtctaaatttaaaagagtgaatacacaagtaaaatatatctgctttttaaggatctattcagtttaggaaggagagtcaaaatttgtatttaatttcaatttattatattgtctgaaactgaaagtaggcctaacttttgtttgcttttgtgtatgtacaaaggcaaacatttatcaatcaactcttattaatttgagattattttgacctgattgctcagaacttttgtctatctgtataga

SEQ ID NO: 80552 - DNA, 1035 bp, Homo sapiens
cgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacggtaagcggggcgccgggggcgggccgggcgggggttgaggggcgccggggccggagggggcccggctctggcctgaggagacgctggagctcggggaagggggccgagtgggcgtctgaggggctgcgggtccgagaggaggtaccggctgcgggtttgaggaggcgcgggtgtgaggaccggaggctcctatccgagcggcgggggcgtccggggtgagcccgaggtgttgcccactcggaggctccacgtcgtggggctcgtcgtgccgggtcggcgaggggacacggaggaagccgacgtggggagctggagtagcgggggcggatgaggagggggcgcagctcttagggagggtggcacaagaccggcgtttgtgttccgggcgacggggatggtggtgtccgtcaggccccccgggagctggggtcgtccaggattctactgaggccccgtaggactggtgacatccttaaaaataagggggaaattggggggaagagagtcctgaggaacactaatggtgagctgagtactagagaccaaaggagggggtaaagaatcagggaaccttggatctagggatagagggaaggtgggtgggaagatgagggagtgggttgactgcagtaggggacctggagagagaagcagcagtgtctccaaatgagctgggggaagagggctgggtttgctaaagagggtggagtgctgggcattctagggtagtggttgggagagcaaaaag

SEQ ID NO: 80553 - DNA, 1068 bp, Homo sapiens
tgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggttagcggggtctcgggtcctgcagaggaaaacgcccagctccgggaggggagcggcggggagggaaggcgagtggttaggcgtgtccactctgcagggcccagcagggcgaaggtgtgggcgactggtgcacttccacaggcagccgtgggcagcatgaggggtcagattccgggaaggacaggtagagacggctggcaggggccacggggtgaataggtgttgggggtggggagggaattgggatgggcagtttgggcttgggaagcctcagggaggtggggggtgaggtgggatggagaggagatgcgggcgacggtggagggaggtggggaccccgagtgggggcacactagaagggaggggattgaattccagcgcccagggccctccctgcgaccgtttagctagcgaattggcaggtttggcagcctaaggcaggggatttatttctaagccaaacctgctctaatgagaaaagcgtgatagatgactcagatatgggatctatcactgagggaaaacattaagcaaatagtaaagcaaaaaagatttgtgtgtgtgtgtgtgtgtgtgtgtgtgtgtgtgtgtgtgtggcgggtgggggggtgttagttgtcttaatttagaaaaacgatttaccttcaaattggatgtggataattgtaaatgagtctgatctcttcattaaagcccggggtccttttcttataagcatgtcttcagcagt

SEQ ID NO: 80554 - DNA, 1037 bp, Homo sapiens
ctgcctagattcgcccccacctggcgtttgcttgcttcctccctgttcaaagagcagggtccatctcagggccagagcggctgttgcatagtaggtgcccaataactgtgtagaataaacgatgtgactctccccacacggtgcttggcacacaggaagcactcaataataatagctactttaataacaatatcctcatcacatttcaaattctcatcagcatctctgctctgagacggcttcctccgtggggaagacaaagctgagggtctggcgccatcttgtggccataaagaagtgcctgtctctacccacggctgctctgatttctctagagcaagaaagggttttgtctgggtgacttaccaggtttcattcccccaaatgtcccctccaaggggcaccctggttcgactgacagggcatgagaactggcctggggcaccaggggtttcagcaagagatccaaggctagcttaagaactttagagatctctaggtactgcaaagattatgatactgagtatgattcacaataaaaataataaccataaagtcaatgttatttttctaaatgcaggaaacctttaatgagtgctgtattcaattagcattgtttcaaggttgatcttcccacattttgagtgtgcctgctttgctagtgctcgaagcacacaatctaaccattaccggagaatggtagtgccagggtgggggggttcgcttcccctcctcccctcctcctcctcctctttttttttttttgagatggggtcttgctctgttgccaaggatggagtgcagtggcgcgatctcggctcactgcaacctccacctcccaggttcaagcaattctcctgcctcagcctcctgagtagctgggattacaggtgtgttccaccacccctggctattttttagtagaggtggggtttcaccatatctgctaggctggtctcgaacgcctgacctcaggtgatccacctgcctcggcctcccatgccgggccttttcccctcacttctgactcatcagca

SEQ ID NO: 80555 - DNA, 1036 bp, Homo sapiens
tcctctgccattgccctgcccttgacccctgccctctgtcacctccagctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggttgctttgcttaaatgtccccttgggggaggggggttctgcttctgtcggcaggggttgggagctccgaatctggccccaccttcaatctcccagaacagcaagttgcctcctaatgatagggagaaagataacggggaggtggggatgttcactggaggggttgggggcggagaaatcacaggccttcttaaggctctcctgacttcaaggctctggaagcctctgggaagaatggagccacatctgggtcagcagaggggtgggcgaaggaaaggagtcctgatggcaggattcaccagggctggagctggtgagagtcacctgccccaggcctggccctgggattggtctggtcaggccaagacccacctgctgtgattgttctcagaagattggggagactccatatctgagagtcctcagacttaatctgcttttgcatctaagaagaaaataggaagatggaacagggtctgggaattgatgggggaagagtttgggggactcgggtggtagcctagagagtcccatttctcctcaccaccctgcccctctgaccccgcccccaggagccgtggaggtccaggtccctgaggacccggtggtggccctagtgggcaccgatgccaccctgcgctgctccttctcccccgagcctggcttcagcctg

SEQ ID NO: 80556 - DNA, 1443 bp, Homo sapiens
gcagagtggggtctgaaagatgagtctttgggatggccctccacatggagacaggaagcccaagggaaggaggagggcccctgccgtgtcactctcagggaaaccagtgtggaggggacactgggaaggctgcctgctggacgagggagttgggccaggccttggagggtggatgggatggacaaacaggagatgagaagggaaaagtgttgcacgtagagggagagtggagggaagtgtatcgggctgtgggcctgtgggtactgagagggggctgcgtgaggtggtccccctcaggtgccccggcgtgcctggcacctgcatctgtgtctgggcctccagggccgtggtcagcacgggggctgtccgttgggctgctgtctcacacacactccccacttgaagtctgaccaggtgcttgggcttctggcataatcccaaaaatagatcttctggcatctaatgcttttcccttcccttttttttcttcccatcatgaaatgaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtc

SEQ ID NO: 80557 - DNA, 1042 bp, Homo sapiens
actgcaggtgcctgccactacacctaattttatatatatatatatatatatatatatatatatatatatatatatatttttttttttttttttttttttttttttttttttgcagagacgggatcttgctatgtttcctgggctggtctcaaactcctgggttcaatcaatcctcctgccttggcctcccaaagtgctgggattacaggcaagagccactgtgcctggtcagcatcctgttggatgcaggtggctcaggttaggttaaatctcttgcacttgtgtcagagagtattcataacctttggcactgccagctccaggtaattatggtgacactacttcattactaatgaggcagctctttgttagcacagagaaacacctgggtctcatagaggaggcataacccagccctcagacagagggactgtgacctttgcctccagcctttctccagcatctgagcagcaaaatatcccctgcacctcagcttccttagctaatatgatttctccaccccagcgctctcctctggatgtgtttcatccgtgtcccttgcagattgaggctctggcatggatcacgatgcttcagctcatgatagatcacctctcacctcctgcatccagggcactatgttcctagtgatacagctccagatcccattagtccagcggttctcaaccctggctgcccattagaatcactttgggagttgtaaatggtgcctgggctccatccccagaagttctgatgcaattggttgagtttattgctaagtatttgatgtgcatatgccagtggctctagtctggcttataaattaatgtaaaataggattcagaagacagccctgagctgagacctttgagaccccacctcttagataagctagctattctcagtgatcaccatattggactgtgggttttttgtttttaattaagggaagcacacaaaatacaggagcaaggaaggttgagggaagtgataatctttagttcagaaaggagggggccctgttccctgtgttgtgggg

SEQ ID NO: 80558 - DNA, 1030 bp, Homo sapiens
ttaccaccatcataagtcatcatcaccaacattgtcaccactaccaccaccataactgccatcctattgtcaacaccagcaccaccaccatctccatcattggcactgcactcaccgtcagaaccactgttaacctgttactaccattgtccataccctcatcaatatcacactgtcatgaccacacattggtatcatcatgaccatgcactcatcgccaccaccatcatttggagggaaataatgtgttccttcataaaatcaatcaagcaatcaatttcaaatccttcaagagaggccataaaagaacctacatagagtgaaacagctggacctcacggcccccattcttgctccctgggattctgtatcctttggataatctcacactaattggctactgttgccaccaaactggccctaggagctctttctttaacacctcaaggcacagctgagatagagctagagcattcatagtaagtgggacaataatattaaacaactgatgagagtataaactggcacgaacttcctgaagagtagctgaacaatacaagaaaaatctttgaaaagtgcattctcagaaatcttacttctaagaagttatcataaggcaataattagataaatttgcaaagatgatgtgtggatgttataataacaatcattggaaacagcctaaatgtatagcaaaaaaagagattgtttaaagaaactatatggattaatatgcagccattaaaacagaaaatatagatttgcctattgacataaaaatatgctgactctatattgttataagcaaaagcaggtttcatatcagcatttataaaattatcctctagttctaaaagtgtaatgtcttcacgaaacaagatgaaaatattttcacacctggcatcaaaattcttcttagatggaaaactgtctttgggaaaaaaaaaaaactttggtaaactatctagacatacagtgattgcaaaccactcagcatgagacaaggagaggaattccttttgctcctgag

SEQ ID NO: 80559 - DNA, 1032 bp, Homo sapiens
ccacctcctccacagtgccgccctcctgctggctggagcctgtgtggtccacgctccttttccgaggtgggtagggggctggggagactcccaggttttgtcagcagagaaccatagttggggaggactgcgtttccatggatacaagccatgggagctgctgggagatggggccatggtgtacacagatacagatccacacggacctgcaagaaaaatagcaacagatttgctgagtcattggccccacatatttatagtttctggcaaaggcagacctgcctatcagaggctaataatactgcagcagcgtgttaattgcaaagacggagccttcaagcatccattcagacacccgagaccgctccttgaataaagagtggggccctcacaatgaaagccgggatgcgtggaggcagcgtgtgtgcttaggagtgtatgtgcatgcaggtatgtggaacccagctctggcacgttcggaaagccagaccgaaaccaccccgcaccagagtgttagaaagcactcttcaatcacctaaggatatctaggattcagcccactctacagatgggcagggtgtgaggagattgacaagaggagagcaggctggttggctatgtcccaggggtgagaggaggtggacggggtgctggtctgcagccgtgagagacctttgtggggacagccactgtcctctagctctgcacagttgggtagttaggagaaagagagaaacaggcctctatcttctggaaggtcagccccagtgggccacctgacacacctgagatcccacagggccccaatacaggaggcagagtcaaggatgtagatgccgggagcgtgcctgacgtcttgaataaatgcccaagggataaagtcaaccctagaagaccatctatatcctttgcctcagggagccaggaggcccatttagctctgaatgaggcaagccaagtcctcacctcctaggacttcaccggacatggtggtcctgtccttggagcactgccttacagtagcattagtta

SEQ ID NO: 80560 - DNA, 2305 bp, Homo sapiens
tgacatcatgtgataagcacgtgtccaccatatcctcatcctggagctgatgaaagtactagtactgtgcaggactgagttctgagacctgcaactggagactggaggactgagccgtaactgcttccctgggaagccttttcactgattctttcaggacagtggcctagagaggtgggatggggaggtgtgttggaaggctatccttctgcagtgatgtgactcagaccagagcatagtggcaggggagtagtggaagggaaatacaggtttttattttcacccaagcactttggttttgggcagaagctgccacaaggtgtcagtaaaggctcagagaggttggctgactggtccaaggtcacacaggccttctgatgcccagacctgggcatttcctactagacccagagtgatctgctctgtctgaaattggttggcagaatcacggggcaagctcaagaaggcctgagcgaccttgctgggcggtaacataaggtaacttcctgggctcaggcctccaagggggaaggctatgtcagattacatcagtgaaatgggaggagtaggggatgagcctgggctctgcaacactgtgtgaggctgacattgatggcacagcagtgacctctccccgcccccacaccaccccaattcttcctgaatgatcgtggcgtaactactactcacacttatctgcataccttccttcaacccccagaggaagccacttcatcagtcagtcagataaagaggccaggtcctttctgctggggttttgaggctggtcctatttaatctccttttcttcaaaggcaaggaaaggccttggcaggcttgggaccctctgatgctcccacccagagaggggctctctgctttggggtctggctctcctttctgcctggccttgtgttgaaagctcacttcctctactgggctccagggcccaagttgctgggcacagtgggggcaatggttagcatttgttgaatgactgttgaagcgagacctttctggagtggccagcttcccccctgcctctgctggctctcacagctagggggctgagggctgtgctttctggggtgggtgaccacctgtagcagatgctcctggctggttggcccaagcctctccacacccctttttccccagccaccttccagtgactggcctagagatggccacgggacccacttctggtcaatgagataggagtgaagtcaccgggtagggcttcaggacattctttctagaaggtacagaactggcattcccctcagcctttccatcttctttctgcctggaagttggatctaggtgtggagttgctgcagccatcttgcaattatgaggcaacaagcatgaagacaaaggctttcacactaaggttggtggaagggacaatgagaggagcctggagccttgacggcctggtggccccagactgcccatccctgaatttctttttatatggaataaataccctcctcacccccactgcaccctaataaacagttaggacactatttattaggttctctcttactcactgtcagatgcatccttaattgttttatcaccctcctccagttagaaatgctgagctcgggtagaaagggatctctttcccctgaccttgatattggcaggaaaggtcagaacactgagcttccaatgcactgtgagtccaggatcctttggagcaataaatggcctggaaatgaggctgacttttgagtgaccagtagcttctctaatagaccgagctcagggaccatgcagtgtcttccccttctgtggaagtgccctgcttttcttaccccatgctctctcccagttccaccagcctcctgactaactcctagtgtctttcaagactcagcctgtgtcccctcttccaaaaagcccctgccacccccatcacccacccccaggatgggtcagacattttcccttgtacccctacagtaccctatgccacccgtagcacagcatttgtcaccaaagatgtcatggaccatgtgtccatgtgtctgccttgcaccagatgaagtgtctttttaacctttctaagctgggtacctagagcaggtgttccagtcattcaggaagtcattgttaacttgctcattcattcattctaggtttaccgagcttctcctagagatcccaatgccaggtggagcagctctgctctgctaagctgtcacagggcccagtgcaccttgcatagtggatcctcaggaacagtcccagaaggttggcctcagggatgggtcctccagccacaggccttgct

SEQ ID NO: 80561 - DNA, 1052 bp, Homo sapiens
aagaggtactgtgatgtgccctgggtatgcattatttcattggtgacagcctcacgacaaccctttggaggcagcatcttgttattccctcattttttcccagaggtgccatctgaagcttggaaaggttaagtagcttgccccaattacggagtggagacaggaaggcttcctggagaaatggcttttaagggatgggaagatggcaggaaggccacagtggagatggaggagagggcagagggcaggtgggtgctaagagtagcaggcagtccagacagagtgaggctggtgatgcggggaggggccagcagggaatgttgcagcagatcctggaggtgatagggagccatcgaatgtttcagagcacaaaagtaatggaaaaatgcgttagggacagtgttgtagggtggggagaaggagctggaatatagcagtgccaggagggtggtctagcccctggctccaaaagcctgcactcctggctcttaaccaacaggagaggaggttcctggagcccagcaggaaggattctggcccagaaccacctttggccataccacccaacctcaggcagcaggctgccatgacactcaacctggtaaaatgggagtcagctactcctctctgatcctcagtttccccatatgctctgggttgctactggtttcttccagccataggagggcctggatgggctccctgccttttgaagagagctcttgaatcccagggacaagcacatttaatgggagggtttcaggccaacctccaactttcaagcagcaactccctcatccagaacagctgctcaattacctcttaatcttcttgatggagtggagccagccaaccactgcaggtccacgccaagtccccaagccacatccacagatcataccctaccccagaattcccagatggctgggtggaggtgtggagagctcaggacagcttttccctcatacccaaaactgcttccctgtgccagtgggtcagaccagtagcctggaagagacaaagttttagccacagagacctggtttgaaatt

SEQ ID NO: 80562 - DNA, 1069 bp, Homo sapiens
aaagcctggcactggagggctgcggtaaacagccgctagtgaattattatttgccaagtgaattattatttgcatggggaaaactggaaggggcaattgtccagcaaatagaccctgagttgtagaatctacccagcccgccaggggatgtgccaggactgttggggcatggggctggaacttagtgctgggtactgggaagctacacgggaaaggaccccagaggctctagccctgtccccagggccccaggcttgggctgggtttcctacagttggcaatttccccttcaagcatcccccaaactctctccgtattagcatgagaatagggcgccggctgagaccggaggatccaaagatatttgtattccaaagagcttcctctgttccctcaaagcccttgttgccagagctgggaggctgggctgggatccagaggccactgtgggccagcgagggaggagaggcacccaccagaggccaccctgtgctcctggccctccaccctgaggcctctcagagggggctgccagtcctcccagctcccacccctgtagtgagcctcaattgtgtatgtgtgttgggggggcgggggcaggggtgctctctcatctgaaaaagcatgttctatataataagtgcttcgatttgttttttgcctcaaccttctatttccttgatgttttaaatcctatactattactgggaggagtatgaggtttgtatgcttatcacaagtgagcctggaatttaaaaaggttgagaaacgttgcccagcgggattaataataactgtaataacagttaacagtggtgagcatttgccccatgccaggcattatgctgagcattttacatacactatgtttttttagtcctcactacaaccttgagatactgttacaaaccccattttacagatggggcaactaggtcttagaagagtaaattaactggcccaggaccctaaaatcagtcaatggcagcatggaccacagtgtcccccagcacctccctgcccctctgatgcctctttgggaagaactagcactaatggggagtttggg

SEQ ID NO: 80563 - DNA, 1028 bp, Homo sapiens
taggtcccaaccaaaaataatcggccatctgaagtcaccagtctaaaagaagcattagaaaatgttcatctgatgtttctattgattgttctcttcccaaggccaaaactagctcagcaagatgtcttttactcttgttctctgcctctctggcaaaatgcaaacacagtttcatccttggagaactgtctttcatgcgggaacacttatttaaataaactgccttaggaacataaaagcaaaggagaagtgtagtatatgaattgacccatgtgcctccctgcccagcaaacatgagctctttagccatgcagagaaggtgttgctggggggacaggccctcattcttcagcattccccctcaaccttccagcaaagatacagcagctaagagactcagagctggtcctggatgggagactgtcgcctgaggggaaggagaccaagcactcattggggacataatggctttggagtgatggtcactaagagtgccaggatgggagcagagggagggacagttggctgaagagtgagagggatggccatgccttacctctaaggaccagttcacagcaaaagcaagggatccctcctgcccatgtgtaatgtcagccctcctgaaaacttgtagtcactgggcagggcagtgtgtatgtgtgtgcattcgtgtgtgtgtgtatgtgtgtatgtatgtgtgttgctgagcagctctgggggcacccagccagccccaacccttctgcagtttcagcctttctggcccatctacatgtcttccctcagaggggccagctagagcatggggcaggctggacaggggctcagggctgtggcacagcctgggggagcaggtgtgatgcaccttttcctcacagagcaactgactgcctggccaagggcaaagagtgcattctcaagaaagattgatcaagactggaaaataaaatgtagcttgaggacacatttgcaggctgataaatgaaggcacaattatgagggaggctttgaaaccaggaagggaattg

SEQ ID NO: 80564 - DNA, 1097 bp, Homo sapiens
cccctgcagtgttggcctcagctgcttggaatccctggggtcctgtagggccctcccgccagccagatgggcagctgctgcagcagaggagggggagaaatggaaacaggcctcagggtacccctaggcagggagggaagggaagaggagtggagggaggacagaggatggctgtgaggaagggaactcagttgccctaacgtgaaggcaggacccctcgccttgactcggacagcagggcaggggctgcctcaaggctttggatgtggggggatcagggcacatgccattccactcagcgggcctcagagccagctcttggcgtgaaaccttacccgatgctggctcctgctcctctctctttttttcttaataaggtcgaatcagagtgagtcagaggagccaagtttcctgttaggctctatttgaataaactctgctctgaacatagcctgggcctctgcacagactcccctggccaggactgcgctcctgccagccatccctgctgagatggagacctgggggtccacaccatgacttgagctagggacctggcctggcccagccactccccggggaagctttttaagctctcagagcttcagagtcccgtctgtgacctgggggtaatcatacctttcttgtggcatatttgagaggatggaatgagaggattatgaaaagtccccagcacagagccagacatgtggccactattttccttctttcctcttgacttgtgagagaagggagggatttatctcttggggttgacccccactcccacttcctctgtctttcctgtttttatctgtcttcagcatctttccttgctcagggtgaaccttgtgcaggggggccagaggtggcccctccaccagagctgtcctctcccttcctctctactccctccttctgacctcattctacttgggtttaggtctcctgcagtggctgacaggcccagcagttctgtgagcccaggggagcctgccttccatcacctctcctcatgctgggcaaggccttgccttggtggctggaggtgtcctggcatccttaggttgaaacctgcagggtggggtcctaaaaga

SEQ ID NO: 80565 - DNA, 1049 bp, Homo sapiens
aatgaggccagtgaggtgtttttttttttttttcctcggggtgcaaaattttagggggtgccaaaaaaactcagtaacggagataagtaatatttaacacaatagtttttaaaataaaaattaatgcaaaactatctgtaatgaacaaaatatccaaatatcaaataaagacaggatccgtgttgctgatttttcagttagcctcaggctccaatatggctcggcataccactattactgactctatttaaaatctggatatttcctttatcacaggttttttttttttttttttttttttgcattaattttgacttaaaaaaatacatctcaatattactcatctcaactactgtgttttttggtagcccctgaaattctgcacccaggccagtgcctgactggtctctcttgccccagccttgcagactcccctgaggaagtccggactcctgcctggagcacacgctcccctctaacctcctgcgcactcaagccaacctcacacatgcccagtaatgggcagcctgccacacctccaggggcatcccttaaggcctttctggccctgaagactcaggtttctgatgctccttgcctcaccctgtgagctggcatagaacatctctaaggggggaaggagatgccctcattgaaatgagggagaaggtggatgaggggctccttccttttgtcctcagatgacccaagccaagtgcagaaggcgagcctcctcccaaagctcggctagtccctccaccaaagccaggatcagagcccacacctgcctggccaacccctggcactgatgatgcctgggtgcgggttaagctgggaggtgagatgccaggggggtgctgttggctgggtcgggggaagtcgggagggggcgctgctccgtgcttagcagctccggggaggcctccaggaagttctaaggaggggcccggggggcccggagcagtttccagtggccaggggtacgcgcggccggaggggcgccggggccgtactcaccgcggccgttctggttgggccggtacacgctg

SEQ ID NO: 80566 - DNA, 1050 bp, Homo sapiens
acagcttgtctgatccgacacagctttctaagcctgaagactctttttctttctgaaggaacaatctgagacaacttcggggaaggaaggagggatgctgatctgtgattctgcctccagggcaagtcgcttaacttctcagggccacagtttcctcatctgcaaaatggggataacaatcccagggttgtcacagggattaagtgattctaactgcaaaactccaagaacagtgtccggcacttagtatgcaccatatgagtgtttgttacacaaacgttctggaatctgcaatgaccatgaccaggctacaccctaaccccacactggggagagactctgcttccaaagtctttcacactcactgtcccatctcaccctgtcacaaccagtgcccagaatctagcactcaaatatctgttgaatgaatgaatgaccaaatgaatgagtgaataaatgaggtgtacaagataagcaataatatataaattttttttttaaatgcatggttgttaagaactcaggatagagagtcacacagactcaaatcctggttccactactaaaagtcagcaagtgagctcgtcaccacatctgtaacacgggacaaataacagtacctggctaggacctgggaattaaaggagatgatgtataacgcactcagcaaatgcaagcataattcttcctctggatgcagatgtgggaggtgaggaccacagaggcaaagctggcagaggggtccatgctcatgccctgccccaccctgcccgcaggctgaacatgatatcctcctgggtcatctcactgtgatgcagagagcacaggttcagtttgaattcaagctcggctgtacccttctgtgccacctccctaggcctgttttctcatctacaccaggaggaccataatctgcacctcattaggaggttgtgaggatgaatgaaactgcacattgaagtcagtaagcccaggaagtggtcttcagcaaatggccaagttggtattattatccctgcctctgggctctaactctggaagcttgttggg

SEQ ID NO: 80567 - DNA, 1017 bp, Homo sapiens
gtgtgtgtgtgtgtgtgtacgcgcatgcacatgcatagctgggaattccaggacaagggcaccatggagtcagggggtaaaaaaggttggggtatgctgccagagacctgcctactgatccttaggattaagagttctggaaggctaggtaaggtcaaaccacagacggctttagctgccactctgagacttctaggcttgattctgtgggcaatggggagccattgaagaccctgggcctggcttgatggctgtcctagctctcaggcttgagctgggttacatcttcattatggggcaaagtggaatctgcagccaccttgcctgcctgctcaccaagcaggtgtggcactgccaggccagtgctgacaagttaatttcctgattatgagataatcatttcctagggaatcgggcagccagctcccgccgtggaggcctctctggctcatctttattcaaggccctgctctgcagagctttctgcttctctgccacctaggggctcctctggagtctggctgcgctagccaaaacatcccgctcagcacatatttcacaagcaactgaccagttcctcctggactttgtttatcctccagccctgggctcaagagattagggctcttttgcattccactttccatcatttgcccctcatgaggaggaggcttggagaggaaagattccagagacaaggtttactgaacccacaaaaaagaggaagccaagagggaaacaggtgaggtgtggacgagcaatgggaaggcagccacagggctctcagcgccaggcagcctccctccaggaaccgctgggcaggagggaacagatttctaatgaagcaggaaggatttaggtcagaaggtgggagaatttcctgactgctaaagtatcgtctgtaggggttgtgagagggctcgggctcttgcccaaggctggggaatgaactgaacagctcctaaaaagtattttaatctccaagtgtttatcgatctatccaacctgtgttcaggg

SEQ ID NO: 80568 - DNA, 1070 bp, Homo sapiens
ctcaggggggaagctccagaggtgagttcactgtcttgtccagtctccccagtcccctttctgaggctcactttccccatctggatgatgagggagactgaactagctggcccctgaacacaggttggatagatcgataaacacttggagattaaaatactttttaggagctgttcagttcattccccagccttgggcaagagcccgagccctctcacaacccctacagacgatactttagcagtcaggaaattctcccaccttctgacctaaatccttcctgcttcattagaaatctgttccctcctgcccagcggttcctggagggaggctgcctggcgctgagagccctgtggctgccttcccattgctcgtccacacctcacctgtttccctcttggcttcctcttttttgtgggttcagtaaaccttgtctctggaatctttcctctccaagcctcctcctcatgaggggcaaatgatggaaagtggaatgcaaaagagccctaatctcttgagcccagggctggaggataaacaaagtccaggaggaactggtcagttgcttgtgaaatatgtgctgagcgggatgttttggctagcgcagccagactccagaggagcccctaggtggcagagaagcagaaagctctgcagagcagggccttgaataaagatgagccagagaggcctccacggcgggagctggctgcccgattccctaggaaatgattatctcataatcaggaaattaacttgtcagcactggcctggcagtgccacacctgcttggtgagcaggcaggcaaggtggctgcagattccactttgccccataatgaagatgtaacccagctcaagcctgagagctaggacagccatcaagccaggcccagggtcttcaatggctccccattgcccacagaatcaagcctagaagtctcagagtggcagctaaagccgtctgtggtttgaccttacctagccttccagaactcttaatcctaaggatcagtaggcaggtctctggcagcataccccaaccttttttaccccctgactccatggtgc

SEQ ID NO: 80569 - DNA, 1109 bp, Homo sapiens
acatgctgctgggtagggtcctcagtctttctcctgattccccatgtgaagtagtttgcagagggaccccttgcttacaagctcacaaggaaaccccaccacactccagatcgaagcaacccttttccattaaaaaaaaaaaaaaaaattagtcctagagctttcagctttagttcatcaactgggagaaaggtggtagagatcttaaggcccagagaggtatctttccctaaaagtgtgtacttattaatggatggcaggtatgagagattaagcctatgactatggtcagggtgtggtgtatggccagggtcaggattcagtctgtgacaagggttagggctcagtgtgtgacaagggttaggactcaatgtgtgaccaggatcaaggctcagtgtgtgaccaggatcagggttcagtgtatacctagggtcagggcccagtgtgtgaccagggtcagggctcagtctgtgaccagagtcagggcccagtgtgtagccaggctcagggctcagtgtgtgaccaggatcagggctcagtgtgtgaccaggatcagggcttagtgtgtggccagggtcagggctcagtctgtgaccagagccaggctcatttagagacagccctctcacacttggttgctaccatcaacctaactgttcacagcatgctgccaccacatcatgaatattaaaaatgggaacagcagcctccagttcagtgcagagattaggttcctcatgagtagaatgagatcagaattccccagggcacacagcatgtttgaaaggacgaactcctgtcccatcactggcagtttggctctttagcaggcctgggtttccagcacattcctgctcctcagggcctgtcttagccattcaagacccagggtcacctaagtggtagaagccattctagggaaggaggaggaaggaagaagggggtatccaggaaacaaaggaggctgctgggggctcggggaggcagggaatccctcctgctgctgggaaagggggatgggaacagaaacagcatcccacgtgccaggcgcctggagcagccaggagggctgtcggcagggcagatggagaagcagcctgcgcggccct

SEQ ID NO: 80570 - DNA, 1010 bp, Homo sapiens
caccactgcacttcagcctgggcaacagggtgagactgtctcaaaaatgaaaaataggcctggcacggtggctcctgcctgtaatcctagcactttgagaggccaaggcaggcagatcacaaggtcaggatttggagaccagactggccagcatggcgaaaccccgcctctactaaaaatataaaaaattagccaggcatggtggtgtgtgcctgtaatcccagctacttgggaggctgagacaggagaattgcttgaacctggcaggcggaggttgcagtgagccaagatcacgccactgcattccagcctgggccacaaagtgagactcagtctcaaaaataaataaataaaaataaaatttaaattaaaaaagcattatgttaagtgaagcaagccagatatagaaggccacatactatgtggttccacatatttgagattctggaaaagacaaaactacagaaacagaaaacagcttagtggttgccgggggctggaggtgggaggtagaaaacggagcacaaagaggcaagagggaagtcctgagtgatggaggtattacatcttcactgtgggggtatttatatcactgcatatatttgtcaaaactcatcaaactgttcacctaaaaagggtaaattttgctgtatgcagattatttctttgccagacactgtggctcatgcctgtaatcccagcattttgggaggcagaggcaggaggattacttgagctcagaagtttgagaccagactgggcaacatggcgaaaccctgtctccgcaaaaaaatacaaaaaataaataaataaaattagccaggcatggtgacacgtgcctctagttccagccacttgggaggctgaggtgggaggattgcctgagcccaaggaggtcgaggctgcagtgagccatgatctgcactccagcctgggcgacagagtgagacctcgtctcaaaaaaatatgtatttcttaatatacttgaatttttgtgaagaagtggaagg

SEQ ID NO: 80571 - DNA, 1943 bp, Homo sapiens
gacatgtgagggtccagctaaatggaactctggttcctcgcagctccacgaacatgccaggttttcttgtctggggttttgcacatgctgttcctgttgctggaagggtcctcctccacctgaggactccctcctgctggcaccaccctcctctgctgggggctcaccacaggccttgcttctgtcttggcacttaccacagctgaaaggtcattgccctctgcctgtgttcccaggctaggagtgtctcaagggcggtgtggtgcctccatgtccatgcacggccacacagtctgcccaaagaaggtgctcaggaaaggtttgttgaattaattacatttctcctcacactgtcctccagctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccaggtgaggagccctggggaggagagcgggggtgtttaccagcttggtgccagcacagactttgctcactatcccagcagctctgtgcagtacacaccctgcacagatgttcagcccacactgaccacagccaaggcagtgagaggaggccaggtgtctgagtgtgtagaggccattggcagcctccatgggaggaggcgacatcaccagaagggcagctggaaagaattttatatctgaggctggagtagtttagaaactgagtttgcagtttaggctgaaaactcaggggcacctttctggtagaggaggaagttgaacagaggcctgaaggggatctaagaggaaactgccacaaaaggtgcagaggccacagtgagtggtcctgaccttggcaacacgatgacctcctctctgcctccttccccaaccctgttggccacccccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggtgccgctgccctccttgcctctccttcccatccagcttgctaggtttcttgttacctaccccagtggtgctctcgtagactgccccctgctcctgccaataatttggggtgaacccatggcaggcaggggctcagacaccatttccaggcattaactatgccctggtctccccgccatccgcaggacaatgcagccaggcttccaataccaagaggcctgcccgtgttacaggcctgctgcctgtcaggctctgtgccaagtactttttgtacattatctcacccacttctcaccatgagcctatgctttaggaattgtcatctctaaaggaattatcatcacagatttggaaactgaggatccaagagttcacacagccaataagactcaaacccagggtattagaacccaaactcttaaccagtactctcctcccaatgggaaataccagcccctcccacccccatagatctccttcacgttcctccattcccctactgacactcggttttcttttgccccacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagcc

SEQ ID NO: 80572 - DNA, 1489 bp, Homo sapiens
tgatgtatgggaggagggaacagaccctaacttgcagctgcccaaagatacgggaatattaggcaaggagccagattgagagccctgagaaggaaggagcctctcgaggggaaggtgggcgtaaggtacacttgcccaagttcactccgcttggcagctgtcgtgcaggtccagttgaccacctctgctctcacctgcagatgtaccccagagctggccctcctgcctctgtcatggcctcatcagtttcctggggttcttgctgctgttggtcaccttccccatttctggctggtttgccctgaaggtaaggctggctgggtcagcccccagggtggttgggccacactgagagctttggcattgatgaataaatttgcctatcctctgtcccctttccctaaatattattacccctttgtgtaatgggctaggcaagaaccattcattcacattggtcaggggaggaaactaaggcttgggcttgtctaaagtcatactgggagccagtagggggtagaagcaagtcccaaactcctaagtcctgggatctggacactggctttaaggtacacgcagatgtctttgccaaattatcttctctttgggttagaataaattagaaatgaaaacacccaacttagcccagctggtagtgcataataggaattcaggcctcattttccataaggggtggtacagtgggaaaaggatgaaccatggagctatagttcagcatcgcacgtgaaagctgggggaaggtggaagcccaaggaggccttgccctttgtgtagccctaggcaacagtccctctctagaaaacctctgggtttggtgtggtctgcaagggggtccttaaatggccttatatcctagttctaaaactgccacagaaacaaatgccatgtgaccttgaacaggtttctttgcctctctgggccttcatttctcaatttggacatcactacttctctaggaggtccagggacctaaagttgacaaagccctttccccgggggtgctgttagggcagccgagccttttctcctaactaatccaaggacagacagtttcctggtatgagtcatgtctaacttcagaccacagagatgaaaagtttctctaaggatcaagtcaatacagtgcagtagttaagacacatggcctttggagttattcagaactgcattcaaatcttcactatttcacttagggctatgcaatttttgagcagtcacttagcttccctgagccttggttttctcatctggaaacagtgctagggatacctaactgtgacccaggtgaggaggagagaagtgaggaagggacctaggcagacagcattggccagcctaggctgaccactttcaactctttcccttgccattgtggacagattgtgcccacctacgagcggatgattgtgttccgcctgggccggatccgcaccccccagggacctggcatggttctgctcttgccctt

SEQ ID NO: 80573 - DNA, 1030 bp, Homo sapiens
ccattacatctacggctcttagaaagcaggggctgcgtgtggctcatctttgtacgcccagctcccggcaggacgtggcacgaagcagtgccagtgtgaacggatgaatggatcaaagccgggagcagggctgcccccctgcagctctgccctacctctcccgctttaccgtaagtcagcggtaggtctgcagctctccgcctctacctcctccccgctctgggcgtgtctttaaaacccacagtcggcctctctgccccctagaaccgcccccagcttctgtctcacttcctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagaggtactattgggttaggggatgatggggttaagctttgttggtttgctgtggtggggagaggcgggaagagagggtctaacggaggatttggtcaagtaccctagagagtgacacaaagcgggaagtccagacaccagggtcctgaccgtctcgggtggggcagggaagggagggtaggatagagtagaaaagaggacacggaggagttggggcggcctcgctgggctgcggtttctccactgagcagttgggcaaggtgagaagggtcagtggcctccgggcctgggcccttccgcccaccctcgagccctgcctcaactttgcctcagatgcaggacttcagattagggaggatggaggtagtacccctgttgcgctggcctggagccaggggcatgtcccaggcacggcaaaactaaaaccaacttcccagatccgaggtgagaaactggctcagactgaagaggtat

SEQ ID NO: 80574 - DNA, 1166 bp, Homo sapiens
tgagttccttgaaggcagaatgtatcctacacctcttatatctcagagcctattactgtgggtgatgagaagtagatgctcaataaatggtgcagtgagagctggagggcctgaataaatgggggtattggggtgctgataagccagggttttgcatcatccaatgactggctggaatggaatatgaggtcctactccagggtccagctgtaagggtggttggccggtaggtgggggcttttgggacttctccaggcctcacctgcctctctggtcccccagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccaggtgagtaggccggcacagggtggggtggtgcatccaagtaccaggtagagggcgagaggagcaaagatccaaagagtcacacagctgaggacaaggagcttctggggccttgcaactctaaatgtggtctgcagatatgcagtgtccgtgttgatgaccacaatttatgctgccagtccccacgcaggtggatagtaagtttccagtttcctcctgtaataaataatgctgcagaatcatctttgcatctttatccagtaacttctttaggataaatttttagaagtgccactgctgggtgtagggggacgggaattctacatttgatacatgttaccaaactgccctttagaatttagtggaattttccgagagcactgacacggaatctcagtaaggctggattctagg

SEQ ID NO: 80575 - DNA, 1534 bp, Homo sapiens
tatgccaaagtggcatattttggagtggcatatttttatcccttatgtcaggtacaatgggcagggaaggttcagccagcaagagggcaggattcctgttccttgagcacggtgcatggccttaacaaacctgaaaaatcatgtgctcccactcccatttcacattgtttcacaatttaccagtggttactggacaaactcaacttattttttctgcacaaaacttcaatgccataaataagagctcacaactttcctctggtcacaagtcagttagcagccacctcgctctttgaccctgggctgatttagagctcacactggggagcagccccagaggtggctttaaacctgggactcggggtgtctgccctggggtggctgccctggggtggctgccctggggccattggtatttgctccacatgcctgtggagtccattttttcatgttcatgtcacacctactgtgttgcatgttctttactagggggtggggtagaaatatgaatggacatagcccctccttgagatcacagcctggtaaacagatcagccattaacaattgaggcggcagggttccgtgcagaaggctgcatgactttgctgtctattgtgactgcgttttgatagttacctttgtcacactgtcttctgtattatgtttgccctcagcaacatgtcgtatctggcacagggctgacatcctgtttgtgctcagtcatttgtggaaggaagaagtcaggcaggcacaaaggtggctgagctcagaaaaggccacttaccctgctgggatcagctggggaaggtggcttccaagaggccatcacacttagtgtgatgtataaggaaatagaaaggccacagacaggagggactgcacgtgcaaggaaggggcactagtgagtttgcagcatctcaggaactgcaatagaaggttgatgtgagggcaggcactagaagggtgagttggggtcagatgtggcaggcttggaaggagtcaggactctatgctacaatttccagaacactcagtgttctcagctttctcctttgtcatgccttcataccacctaatcttctcaccagtgactatcctctggaagacaatgggaatgggaccctgtggagggctctgttgaaaacccattgatggggccgggcgtggtggctcacgcctgtaatcccagcactttgggaggctgaggtgggcagatcacgaggtcaggagattgagaccatcctggctaacatggtgaaaccccgtctctactaaaaatacaaaaaaattagccgggcgtggtggcgggtgcctgtagtcccagctacttaggaggctgaggcgggagaatggcgtgaacccaggaggcggagcttgcagtgagccaagattgcgccgatgcactccagcctgggtgacagagcgagactgtgtctcaaaaaaaaaaaaaaaaaggaaaacccattgatgggcattgaggagtggtgggatgatcagagcctctctctgcactctggtactttgacaagagtg

SEQ ID NO: 80576 - DNA, 1047 bp, Homo sapiens
attttttttttttttttttttttttttttgtagagatgggctttcattatgttccctaggctggtctcaaactactgagctcaggcaatccacctgcctgggcctcccgaagtgctgggattacaggcgtgaaccactgtgcccagcctttagaacaatttttaacaagacttgaaattaacaagcttttggcatagtggtgcacgcctgtagtcccagctactagggagactgaggtgggaggatcacttgagcctcagaggttgaggctgcagtaagccataatcatgccattgcactccagcctgggcaacagagcgaggccttgtctctaaaaaaaaaaaaaaaaaaagaaattaacaagcttttctcattgattgctaactgataaaattaaaaactattaatagaaccaccgccagccagccagacagccattgagcaatcacttattgagcatttatttcatgactggtgttatgatagctattgccagatgaaaaagaatgcctgccttcgaagcttgaatttgtggagagtttcagcctatggataagttgcatgtgtgtgcagacttgtactctatggcaagaacccagaggtcccagaagatacgttcagatcaagtgctgtggcagttttcagaagggaaaacttgtatttatgtgggagggtcagggaaaccctgatattttagcatttgggctacaccttgaagggtttatttgtctctataagttgcatctaaaacaaactgtataaattagtgagtttttttagttagtagcttaagcaaaagctggattgatggctgatgtaagtgcataggggtcaagctggcctctgacctgaccaattagatattcagattgtgtcaccaggaggtactttctctgtatttcttgtgacctggctttcttccaagactggtccattcacagaagggtttactcctcatgggtgccagatgattgcaacagctccagaggttacaccctcagccccaaattcaaggggaaaagagtgtgaatctctcccagcattcca

SEQ ID NO: 80577 - DNA, 1022 bp, Homo sapiens
aaatgcttctattttacatggtagtaactgagtctctgcaatgaaagatcaagatggttggcttccatccttctagttttggttccatgtcaataggactgtaaggttcaccactggtctttttactttaacatcacttttcccaagttttgtattttgattgagctcttaattggatagatattatcaaaaagcaattttttttttccaagaaggacttttttgttctgaattccttgagtctcttggtgttgagaatgtctttgggttactctgatacttgaataatatctcggctgggtataatattcttaggtcacaatcactttcacaattttgtagacactgctgcattatcttccagcatcaaatgttcattaggacagctctggggtcaaactgacttgctttttctgtctttatgcctaaagatattttttattcttgaaatttattaatttaaccaagctgtcttggtgtttaacattttgtatcaaattattctggaacctagcatgctccttcaatctaaaaattatctttatttcaattgcttaaattacttctcctccatcttccttttcttccttctcattttcttctttttcttgctctattactaataatatcacaatttgtaatttattaactttaggtgtgttcagtttagtaatataacagtactactaccatttagggtgggggaacttatttacttaatgacttaatgaatgagtaacaaagattagaaccaccatatacattcacttgatacatatttttataaaagtgcttgagaatatcagaattatttatgtcacacaaggagttactgcctgttttctgtgtcaccagattctattaacatttaatgattacctttactctttgaattttgaattttgtaacaaattcctgctgtggcatattttgcaatttggttatgttctgccaaagctgtaacagtaggtgaggtgtttcaaatttggcatgactgaatagaagagctgcccgttctcacc

SEQ ID NO: 80578 - DNA, 5175 bp, Homo sapiens
gggagttcaagaccagcctgaccaacatggagaaacctcgtctctactaaaaatacaaaattagccggggtggtggcgcatgcttgtaatcccagctactcgggaggctgaggcaggagaattgcttgaacccgggaggcagaggttgcggtaagctgagatggtgccattgcactccagcctgggcaacaagagcgaaactccatctcaaaaaaaaaataaccaaataaaaatattaaaatacaaacactttgatctagcaggcctatatttataatctatttcataggaacaaaagcttccatgattaggctatataacttggatattactaaagtgttgtccatattggcaccaaaagaaaaaaaaaaggaaaggaaaacgaaagaaagaaaatgcacaaacaggaaattacctgaatgccagcaaaacgacagtgattgaatcaattgtggcccatctgggatataccagagctattaaagagaatacatctgatctgtgcctatgcacctagaggaatgctctgagtgaaagttcgttgagaggaggaagttcaaagtaattatatgacttgatttatttctttcttttttttgagacggagttttgctcttgttgcccaggctggagtgcaatggcaccatctgggctcaccgcagcctccgcctcccgggttcaagcaattctcctgcctcagcctcctgagtagctgggattacaggcatgcggcaacacacccggctaattttgtatttttagtagagacggggtttctccatgttggtcaggcaggtcttgaactcccgacctcaggtgatcctcccgccccggcctcccaaagtgctgggattacaggcgtgagccaccgcgcccggccgatttctttctttctttttttttgaacaaacatcagcccccaaaattattgtagatatctaggtcaatcatttaacatgttctgtttcttcctctgggaaatatgtataacgacaattctcactcaaggggctcttgcaaaggttaagtggcatggctgacatgtgtcaagtctgtaccatcctgcaagcagcagcccagtctggcatttgtgtaaggcggtttcagtggagagatgtgtggaagggtgcaccccacgatgctcacctggtgcttcctcggtggggaagggaaattcagaagtggtggaaagagatgattgtcgtttcgtatatctttgtattgtttcccggatgttgaaattgttactgtagtaactttttatactcatgtgttattggtagtttggatactatcaccataaccacaaacactgaattaggaaaagcagaaacctagaaacatgccatgattcaaagtctggtatttttggaagaggaatttaataacgaacgttttaagaggaaaaagtcaggagagtcctaacccaggccaaccttgtgtgtccacagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaaggtaagcacgcacgccaccttcctgggcggcctgtgcctctgctgcaccctagggaaggcgagtcagaagagatcatctccatttgacagaaaagaaaactgggtgtttattcagtctttgggggttggtaaggtcttaggttccagggcacaggataagggggagatgaggccctgacaaagggctgcagccacccagaggggacacattttactaatttacaagactctgtggattgacctagcgatgactcatggggaacacgtgaaagttgaaaaactgcaaagctgagaatcagacccagtatcattttggcgccagagggaccaagcacttcaggaggttctcttaagccaccggtgtctcggaacagagaagtcaattgggacctggggttacggtagaagggggctaagaaaacctcctggggatggttggatgcttacccaaaaccatacagtggctcagtggaggagatcccttgtctgcaggatgacctgctgtctgccaacctttgcgcgccctgcctagtgttggacgcttgagaggtaaggagacacagactagtttctgatctcaaggagccagagccacttcacgtagctggagaatgagacagtgctcagctctgcaatccaaatccgggagatgtagcagctgtgtattagctggaacaggggggctttcaaaataaggggtagggggagtgtgccagagagtctccaggagtctttgactaaatctccaagctggaatgtgagctctgagcagctagtataggatgcccttactgggaaaggggagggaggctatggaatctgaaggcacctgggtagggtgccagtgacaaagagcttatttacttctcctggagctggacatgggtcatgaaggataatcttagagggcctggacctgtgccttctccacctaggtagtgaatgtcacccatattaaggaaatgaccccacagagtttacacagcttgccttgggtgttataactgggcaatagcagagagaagggttattttattctgaagcataagagatttagatttaataaaaaccaggctgcagataaggaagatcatggagctctcactatatgtagagagtcagtgagccggtagtgatggctttatgattgcgcacacttagccttgctgttggctcagagatggagagaggtacacttggggtttggagccaaaagcaagcactctaatgccacctccttttcccttctggctgggttcctgcccactgcattcgagagagctctccttccagctgcccctccagggagttgtccagtgctttgggatgccctggaaaataggtatcctggaaaagcaacagggacctcctctctatcactgtcccaggtcaggatgtcccttaccagcatgtccttgacctgcctgtgaccttctttgtgttctacagatgcagctgtatccaagaaagccagcccagaggctgccagcactcccagggaccctattgacgttgacctggtgagatgggtttgaggtctgaaggggtggtggtggggcccagcaggtcaggcaggttgtgagtcctgctgtccctgtgtgtgcagggagagcgtctgagtgagggacagcaagtggctggactggaaatttcagtgagaggaagtaaaggaagacattaaagaagggttggctggctagctggctctgactctaggctcctaaatgccaaagttgctcttgatgggccatgagccaggttcagtgggggttagatgtggggtagacagtcggccacagatcagggctgctgcagagggaattccagcattagatggcatattagtgccttccagccatgagaaactatggttgtcagatgtatggttagatatagggtcagcagtcctgagggatgtgcagatgtcctctcccctcctacaccctacccccaatgtgggagccttctcttggagtcagaataggtgggccttcccctgctctttccccacagatggttcttggaaaggaacggggaatggtgccaggagtcagatttcgatcccagttgcccgggttctgctggtgtgattccagggccaccatacatgtaacaaagcagactgtctcagggttcaaggtatccatgtcccatctaatgctggcattccttctgcagcacccctgacctgtggctgtccagctttcatgtacacatctccagggacaggaagcttgctcattctagaggcagctgctcccaactctggactgctctgacttagaaagtgcttttccgagtggaaatgcagtggtgtccctttgacttgccccctttggcattcacaagtatggctcctttccaccagaataagcatcctcggtttcttcctggacttggcatctggtctcttccctagcctagtcactcaggtttgcatgcgcctagcctatcaaggatctggcccaggactggccagtccttcatggacagcaggtcttctggtggtgggtaggggcctagcttttgccatggcatgacccataggagagagagagtgctgtaggttgaggcaatcaggagaggcttcctggaagagacaggacttaagagtctcagagttttagagccaggcaagagcatggagtctaaccccctttttttcacagaggacgaagctaagacccagaaaggatgtgacttacccaaggctacacacagcaaattaggggcaagattaaaagctgactctgttttttgtttgtttgtttgtttgttttttagatgaaggctcgctctgttgttcaggctggagtgtagtggcgtgatctcggctcactgcaccctccgcttccggggttcaagccattctcctgcctcagcctcccgagtagctgggactacaggcgcgcaccactacgcctggctaatttttgtattttttagtagagacggggtttcatcatattggccaggctggtcttgaactcctgacctcatgatctgcccgcctcggcctcccaaagtgctgggattacaggcgtgagccactgtgcccagcctaaaagctgactcttaactgccttgggtactgcattcctatatacacaacctcaagtaaaaagaggaattttttaatatatg

SEQ ID NO: 80579 - DNA, 1195 bp, Homo sapiens
ccataagcatggcccactcccagcccagcaggggtgctgagacactcagggttgtcagaggccagcagagactggtggacagcagatagtaccagcttgggaaggcttcctgtctgaagagagacgtaatctgcgtggttgagagcagaggagaggggacagcaggagcaaaagggtggccacaagtccctggcagtcagggcaggctctgcccactcacccctgcaggcacctgacctggctctgtgactccctctatgcaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggaggtgggtagggcagtggcctgggtgctgcccgccagggtctgggcggtgcccctcttctgtattttggccccatccagaaagcccaaagccaacaggagtcccttattcccactgaataagatagggaaagttcacagtgtgcgtgggggtgagagtggacacagtttaccatgtgttttgccatgattgaggtgtggggagcctgacaggctaaaatgcacagttctatgagtcctttctcccaaacactactgtgcctttgcacagggcaggtctccacaagaagtttgttggctgatgcctagcatactcccagagagggcttgggcataccataacaggaaactggactccccatgaccttaactctgctctctcagtctacacccatcatttccccaagtgtttctgcaaaggccacctacctaagtatctcatttgtcagagttatcttctatgaacactgccaggcaggtagtcagttgggcaggagttgaggtcaacccagaggaatctggaacaagagagttctaaggatctgcttcacccagagtacagctttgttcctcattctgactgagccctagccttggtcacacactgagcactgactgatattccttacccacaaatgctattggtaatcgatgggttttgattaacta

SEQ ID NO: 80580 - DNA, 2861 bp, Homo sapiens
ttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgtcggtccctcagccggtcctctcagactctgaccgcagcctcctgttccttgagctctcagtcctaccttcgcctccctccagccccgcgcactccccatttcatcccatctttcatcagaattgcagctccctgcccagcagaaaatcctggaaggactcaggagcttgtcgcctctgtgctgccacctggagaccgagatctgcaggagaaaggcctgggaaaactatgagtggttgcctgtgactgctaagggctccttggtgctccgcccagcatgtccttttgctctgcagggcagcccccgcctgcctttcttcactgggcccttgtcccagcctcaccctcagctgatggcggcaccttctgctccagggagaaaacaggagctctccaatggcatagggacagttgacatcttgctatttacagatccccatcgcaccccttccctgccctcgttagggtggaagggatgtccacctgcctccaggactcaccctgtgtcctggccccagcccttgaccccctgggagcctcactcctcctcctcatctctcttgcatc

SEQ ID NO: 80581 - DNA, 2781 bp, Homo sapiens
taccagggtggcctctgtgcctctaggtgcagtgtcgcgtttagtcgttattattcttgaccggcgctgggcccggtctttcctggaaagatcgcctgctcggatgcagctctgggcactcctccctctcctctgcaggctctgttttttcttggttgtggtgctcctgcaggtttgctgctgggccctttcctcttttcagtctgtgtattctcccaggtgctctcagccacgcccctgacttcagttactgcccaggggtagctgatacccaacactcgcacctgcctgccagaccagcatggccagtgaccttccaacagctccgcatggatgcccataggtacctcaaactcagcaccttctcctcccgtctcactggctcgccccactctctgcccggttgcacaagccaagaccccatagccacccagggcaccccccttttgattattcctcacatccaaccagttattgagtcttgtctttctagggtgtaaattcctctgaaatctgggcacttctttccatcccataatcttggtaaaattaaagctaccactgaccctgggtagaggcagaagcctgggaaggaaaggtggagaacaggtttggagtgccaacagtgtccccagatgtcatggagaatcaagtagagggaccccagcaatattgggggtggggcggggagtatgtaatgctcagctatcagcaaggagtcattaggggctatacagtgaattaagggagggggtaaaagcacatttcaggtgatgatgaattaaatacctaggagctcacattagagagcaggcctagagacgtggggagagagccagaggaccgctgcttttgtgtatgtagctttaagacacaggttttaaaaattgttataggagtcccaaactttagaaaatatatattttaaaaccccaacaaattaggtcccccctatgcatttctcacccaacttctgggccctttccagacccctggtgcccccagagtacacccagcaccaccactgcaaattcctactccccagcttggagggggtggggtgatattcccaaggtgatcccggctcccacctaacccatcctccccagctctgcagcttatatccagctttgcagtgaggaaagttgcagaatactggtctgctacattactactttccaagtgtatcagggcatttaggaacccctcccttgagcttcacctgtgtcctagggattcagtgagagactgtttgtgcaagaaggagcgagaggcagcagggcatagtcatggggtggagcagtgagtcccccaggcctggttgtggagtacctggggtgaggactttgcttaaaaactgccagagtgggtcagcagtgcgcctgccctggggcccctgctttaggatccaaagtggaaaagataggtgttttcacccactcttgtgacagattactggctccggtgccttggtggcagcagcaacaggagggggccaaggtgagggggcagcctgtggcagaagtggcagtggtgacggcggaggaagggaggcctgtggggaatggctgatccaggggaggggccgtggcactggtgagtgtgcatctgagaaaatgaaacggaggtgctggccaagaggctggagctaggcagaagggcagcagaggccacaggctggccgagtttatggtccagttcactcataacatgtgcagtattcctggggtctttgaggctttgcaagagctggggttttgtgtctgcagaaagatagcaatgcatgtgtcttgccaaactgatcccagctgtagctgatgcttaagtgctcagaaagttcttcaggagcttgagggctcttgataagcatgaatgtcagatgttctgtatcttccagaggctggatgctgactatcagagtttggcttgtgtttggctgatgagcaaacctggaatgaatcagtgataaggacaattgttctcaagctggctgtacactggggagttttcccaactacagattcctaggtcctacgccctgagattctaatcgaatcagtcttgggtgcagcctgggcctcagttttttcttaaagctatgaatgcctaaccaaagtcaagaaccactgaatcgggggattcattgcatgtctgtggtagaggaatgctgctcatttgtttatagatgtggcagtcttgaatgcaggtgacattttcataccagggtgtaataccgcagaggaggggagaggctggatcttccctgatgtacctcctggacttttggagtgtgattacaatgccaatccagccacttcctctgagcatgcttgggacgactgttagacctgctgtgttgagttagaatgcacttgacctgctcaggccgtgaaatctatgaggaaggggagtgagatggatgtagctcatgagccagattgcaggtgtatccaagttgcatgtatatcctgaaaaaatcctggctctcacgaggctcagcctgaacacagttttgcattcaaagaaacaatgtccattaaccaagtataataaagaaataaatcccagtatttacttgcatcttttgaaagaacattaaagggaatccagctcataaccccagcagcacttcttcagtccttcttccccttttctttggcgcctggcatctctcactgcatagcaaagctttcccccttgattcccggtcctcacacgcaggctcaaggctctgtttcccatcttctttcttctgtcccccttccttttctcttccaagca

SEQ ID NO: 80582 - DNA, 1008 bp, Homo sapiens
cggagcaggggagaattctgggtttacagctggctggagttccagtgagaccagctccatgggtggccatactttatggaagtccccaagggcaagaggaattttggaggaagtgagtcagggctgaaaggtccagcctctcctccattaacaagcttggtggaaagggggtgtccttttattaaaggagacagtagaggtttcttagagaaggcagctcgagtaagtttaggacaaaggacatttccctggccccgggacaatggaaggctctaaaaacgaggttctagtggctgccataaatgaccctgctgtaacgatgggaggggtggcctaaagagacagtactgtggctctccagggagctctcctcttggaagagcagatctgaaggcgggaagactggttctaaggccgaggacattgccccgagctttgtggaggcactcaggaacacaaaggggcatttccagttgggtttggagcaggaagaagaacgaaaaagagaaagtcctgtgtgccatgtcagtgggtggcagcatggactcagcctcagctattggcaccaaggatctgaaccagggaggacccagaaggggagcccagcccctccaccagcttgtgggagagcgctgctgcccagtgaagcctggagagaggaaacaactggattctcccaaagcgggagaaggtggagtctccagccacccagctacaagctaggaagacgccttgtagaaggctccttacagggaggaaaccgagttggaaaggcgagacagcagtgtgggctcacccggagcaagacgtgtgaaatcagcttttgacagcgtggctgaatgaggatctggagatgcgaggcgctgggcagactctctgactagatccctggatatgaagaggcaaagccagctctagatggattcatagtgagtgtctgcttctgacaataactggcagaaagctgatgagcctggagcagggctgtgaaatgcaaatccagtgaaa

SEQ ID NO: 80583 - DNA, 2675 bp, Homo sapiens
ctcatgagggtgtatgccctggttcatacatgtaaccctcacatgtgacacacccagttcacacccattcatgcacacataccttctcttgtgcacacgtcccctttcccagtggtacaccctccttcatgtgcacgcagatgctcccagctataccagcttgctagtgttctgcacaggtgcttgccttggccctctgaatccctgacgcttggtttttctgtgttgcagtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctccacaagtgcacctctgaccagttcttctctcagacagagagcctggggaacacactcctagacagaaacacaatgcgtgagctcattgccgtgagccctgtcatccaagtaaggcctctggctgtgctacacgtttctgagtagagggccaatcccacaggtggctgcacagggctgcccacagatccaaggtcacagagggatcagaccccttatcctggaagcccctctacttcctccagtgcttgccctggctctgcaaatgcccctccttgagccagagccccaggccctaccctgtggcatggactcaacattggggctagcccagccagacagaaacagcaagtgttttcatggtacagaaaagtcatttgcagacctcagtgggaggctcttggccttgctctgagtggagtgctttctatgtcccagggctctgactgggctggggtccttgaggggattggaggaaggagcatgggatggagagctaagttcaagcagcctgggatctctagtataggtggctgaggctgatagaagacaggagggacctgtatccatggggtttggccaactctggggccggtagtggaggaggggagagctggatccccagctggtgaacaaagtgtttggagggcagccgagcctccccttctgactgctatcccaccacaaccaggatcagagctgcatttgggggctgatgtgtggctactgccagcagaccccaaggtgaggtctctagatggtgagtcagcagccctagaggaccccctgctcccaccccagagctctctgtgaccctgggtcctcaccctgcccttctctcctgcccagcccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgagg

SEQ ID NO: 80584 - DNA, 3665 bp, Homo sapiens
tggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaacaggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaagcctgatgctccaatcacagactctgctcagcatccccagaggaaccactgagaagccttttgcctggataggagggggctctcccaggcataggcttgtggccacttgcccagcacaactgtgttttgtggggcgtcttttaggacttagcagagctgagagccctttgttgctcaatgctgtgagccttaagcatgtgaatccccccacatgacaagtggggagacccagggtaggctttcctttggatcatctccaaatgggagtgccatgtggcaggaaagaagcaccgatttcaagaattacttcctagagaaagtcaggaactagagaccagagtctgcaggaactttgccactgcccttcactggctaatcctgtacttctctctgtgttccttgagtgacaggtggtaaaacccttaaaaagggaggtgtgggaggcccaggactttggtaacaggtgatgaatgtgttgtcttggccatcacaggtggagcttcagttagtacccgagggattcccctggcacaagcattataggaattagtccaccactggcgtgggtgagcagccaggtaatgggaattgatcagtgccaccacccttgaccccaactaccatcccagatgcccagattccagtcctggagttttattctctcagcttgatcctttgaccaagaagatccagtcccaatatgtcacctgtgcttcatctttggactatatctcaggtgtttacgtgtcaactaatgggagcttactgggttagaagtcaggacactgagtttcaatcctcacttagtagtctgtggccctctttggcacattaacctccctccttgatcctcaggctgcacctctggcaaatgggagaatgcggctccttttgacttcaagggatctttgtgggaaccaatgagaaaatgtgtgtgaagatagctttttggtatattttaaaagtgcacaaatttaagatcttactgctttataaagtgctttatgaattataggaaaataaacacattttagatcttagaaaaaaacaaaaaaacatgggcttgtcttcagggtagtaaagaacaagatctgggatgaacaaacaattgtgggggtcctggggtctgaaggagccaagatcaaggggtcaaccatggaggggctggacaggaggtggcactgtgctcccagcacacccagatgggacatttcactcactggggcccggagtagacaacaagctttctatgtggcagctcagcgaagccctgctccagggtctccttctgaggcctgaagtcatttaaaaatctgctttgcccctaaccccaacctggctcttagctccagcagctgtcacagagcctggtcaggctgttttcccaccctctacttccccttgtcctggcccatgtccacccttctccctgcccatgtccaccattctccctatcccagcctcactctgactcctggccccaaccctgaccactctccatgcctcagagtctcaccctcagcctagccctgccagcaggccccatctcctcctctgacctcagccttgtctccgcctcacaccccaggtgcctccagcacctaagcctagagtaaggggctcccttctcatctttcctcactcctcacaattaaggaaactccatggctagtgtgcataccacccgggctggaatgcaccaaatgtcaagtcaaagggggtaggacacagggaaccctgcctggcgagaaggggagctgagctagggctgctcccggactctgccagcagagggcgctgcagcgcaccccccctccccccccccccccccgccacccggtgcctggcaacgggcatgggccacggtagtgctggtggtgctggtggtttaagctcaggcagctcagtcctttctaaagtgctatgcgtgcttcctgtggtatgggagataactgtagatacgaggcacgtggagaaacatttttttaaaatgttaaaccttttatatttagtttaacatctgttagaaacaatacaaccaggccatgcgcggtggctcacacctgtaatcccagcactcactttgggaggccgacgcgggtggttcacttgaggtcaggagttcgagaccagcctggccaacatggtgaaacctgtctctactaaaaatacaaaaatttgctgggtgtggtggcccgtgcctgcaatcccagctattcgggaagctctgaagcaggagaattgcttgaacctgggaagaggaggttgcagtgagccgcgattgtgccactgcactccagcctagatgacaagagtgaaattccgtctcaaaaaaaaaaaaaaaaaaaaaggaa

SEQ ID NO: 80585 - DNA, 1013 bp, Homo sapiens
aggtctctggaagctacccccaccttctcatccctgtgcttgaactttcattttaattttttcatttagggcagtgtttctggacctttttataattattattattgtcctcttaaggagcatttttagcatcttttcccaattgtgcctccctgtatgaaattttaataccatagatacactgtacattccataggattttctagatacaagatcgcatcatctgcgaatagagatggttttacttcttccttacatggacatatgtatggactgtgagcctttggagggtcagaaaccatggtaatagccaagatggtcaactgcccttcctcccctgccttttcatcctctgtggggtgataatgcctctgttgagaatgcatgatttagggtaaggccccaccccgttacaatgtaggtaagaagtggtcacgggaaggagtgggtgggatgcgggctgcacctctatgtgggtggagactaggtgggccagatggagggagatggaagggaatggagatccaggtttctgagaacacactcgcctgtagtggccttggtcctggtcccaggcacaggcacaggctgagcctggggctaggggaggaatggggccagtaccgtcacttatttttgtctctgaatccagatgtcagctccagacccgctggacctgaataaagcaaatacctgtggagactctgttgagagaagagtctagaatttcaacagattctccccatactaaaagcaaacaaacaaaaacaaaatgaaacaaccaaacaaacaaaaacaaaaaacaggaagtttggacgtctctgttcacccttacaaaatgcatttgctgtcaagtgaggggaaaattccttcattcttggctcaaggaacttccttaaactaagaccagctgcctggactgtgctaaattcagtttataaatattataaatatcccaaacttgatagccaagcacattacaaaagctagctagctaaccgcagaaattttcc

SEQ ID NO: 80586 - DNA, 1142 bp, Homo sapiens
ctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggcctt

SEQ ID NO: 80587 - DNA, 1045 bp, Homo sapiens
acaagaccgctgtggcttgcacaagagaagtcacaaataacacaaagtacagagcgggcaaatgatgtaaagcaggaaagggggagaacctggccaggccgattgcccagagcgagccggcacgtttggcctgggagccaagtgtgtgcgttgtgtgggtgggtggggagcactcagtgaatgatgcatgcacaaccgtcagggtgtgccaagggggtgcacctggggaatcagggttgaaaacacactgatttcatagtcctagaaaggggctttcttgggtgaggaacaggagagacagggggatcaagaaaggagactgtgctcctggccagcctaaaacacacgggttgggctgctgtgtgtctcagctgaatccccctaagatgggaagaggcggggaagagagatggaagaggaaagcaacagaaatgggaagcagataaagattctctctctcccctcccttcttcctgcttccaatttcttgtcctcttttgctgtctctgtgggtcttcctaattggaccagtccaggctggcaacaggcccaagttccaatgctcagggtcctaccccagcctcaggtctgtcctctggcataggtggtggctgtgacacttcttggggcctgagcccagattcccttcccagaccagcaaagctgttttctttcttttttttttatttttttatttttaaaatagatcagttttattctgctagttccataaaaacaatgtaaacacaagcgttctgtacatcttcttggtgaattcacataatgctttgttccctgatcctttaacctcctcgtcttcttccagtcattttctgtttggaccactggccacaggagtggagtggggttggggcttaggagagagcaatgtggctttttcgtatgacttgttttattgcttgccctctcagcacactcctgttactcctaacacaaagtctgagatttaagcccttaaacctgtaggtttcaccatcagctttttctttttcttttctctttttttttttttttttttttgcat

SEQ ID NO: 80588 - DNA, 1058 bp, Homo sapiens
gcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcccctccgtgtctgcctggaattttgtctggatctaggagcctctgctgggagataggatcaggagctgaagagtcagggcagccagcctgcctgcccacagtggcaggggcctctgagactccaaca

SEQ ID NO: 80589 - DNA, 1044 bp, Homo sapiens
agatccattctatatttaaaggccatttcttcctccactctattttttcctctctgctcctcctccaccatcatcatcaccatcatcaccaccaccatcatcatcatcatcaagttttataagtacagtgcagactccaacccaacccaccccagcaatttgtgtctcacttcccacagacaaatccatggtattaagacatctgtatctggtttctctcaaagactctcagacctaatgacctcagttcagaccttggatgctttacccagcagactccaaacgaaggactgcctgccatgcccagtactaggagcagggctgggtacttccccctccttggttgtgctatgtcagtgcccagatggctgatgtgagaggcttgtccagccaggaggtgcttgtggttcctgcttctagaggtggtgtgagtcaggggctgaggtctgcatccttgggggaaggtggaggcttagcttggggagggcagagggttggctggttggcccctccggggcagctgagcaggagaggttgctctgagccctccacagggctgagaccagggagggatgccttctttctcttcccttcccatgtgcctttccccatgatggcaccttccctcttctttctttcctggcctgttttttcttttattttgtttttctcttgagacagggtgttgctctgtcacccaagctggagtacagtagcacgatcatagctcactgcaaccttgacctcccaggctcaagtgatcctcctgcctcaggttcctgagtagctgagactacagacgtgcaccaacaagtccagctaattttttgaattttttgtagagataggatctcattatgttgccagggctggtctcaaacttctgggctcaagcgatcctcccacctcggcctgcccaagtagtgagattacagatgcaggccatgcacctggcctctctttcctttactacctctgcttagaggcacaagaagggggaaccacgaggccaggatgtggagagggcaggagcaagtggtttat

SEQ ID NO: 80590 - DNA, 1042 bp, Homo sapiens
tttgaagggaggccttgggggcactcattatagcaggggttcccgctgggaccagatccagaagtttggttaggaatacaagccctcgccattgggaagggtcccagggctgatgggggtgacacggagccccctgcaccctggccatctctcctgggggccagagtggctcatcttcttgacccctgcggccctgctcactcccccatgcccctgctcttctttagccatcctggagaaaattctctcttgtcgcacctaagagggtcctgaaacagcaataaggacatctagcccctgtcttcacatagcactgcagttggccaccctttccccaccttctcctagagcattattttgggaaagggacactcccggaattgaggttggatactcagtatagaggcctctagaagtttctccttaggtctagcctcctttgcaggacaactttctgtggaaacctgtggcctgggagacagtctcttctccagccccttcccctctcgagagagcagactttggatggagctgggtgcatttctagaatgttctctcaactggtggaggtgcaaggagaaaggaagggcttgtttcctccctcgctcaggttagaaggagctggcatcagaatggggccggggagtcccatgctcagctctgtgtgctgttcttcccaccccagaaaccctgcctcccacctatgccttctgtgtccccagccctggttctgccctgggaccttgggatgggcctgagggcagtggctgggagtctgggagctgtcactcctggggcagtaccgccccctgctggccacccagagaggcccggaggctagaagtttcattcagtgcctgctggtcagcccagtgccagctgattggccccgtggggctggttcctgggttctccaggaacagcctgggtgcgctctggcacagattctggcttggtctctggcaggctgagtggttttagacgaatttctcttcctgactgggtgggcctcaatttcctgatctgtacaaagagtagggtg

SEQ ID NO: 80591 - DNA, 1201 bp, Homo sapiens
ggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgtatgaaaataccaaaactacatgcgggggggtgggtgggaaagggaggggctgggaagggatgggttggggagcgggggtgatcccagtctgaggctcccggggatgagataagagtctggagacgggcatgggttcttggagagtggcatgagctggctctgccctgggagcccggtctgagggggacgttgttggagcccctagtgttgggggtggttatgggagggggtggggtgagggaaacgggagaatgaaggagaaaactgagccctagtttcaccgtgttcatttggaaggacgagccgggtcctcagggggaggttccaggactctgcccttggcgttgagggttggggggcggggggcctcctcccttcctctcagcccccttccccaggggctgtgcttccatgctcctagcctcccaccttcgctcaggacatgttataacttaggctaaactgtgaaaattccggtggggatggcctggg

SEQ ID NO: 80592 - DNA, 1050 bp, Homo sapiens
accttctactgcgtgggcttctgcccctcatggtgggaaggagatggcgagactccaatgctggccttgccctgggaggatggggctcctggccgagaaactggccgtcatgggaggcagtggctgtgggattatgtggccatccaaccctctggatctcccacaggtgaatggcactgtggtgccacttggcgagatgagaggctacgcccccttcagcccggacgagaactccctggttctgtttgaaggtagggcagtgctggagcaggcgccccagggggatgcttctgaactgggctgggagaggagtggtcagctctttgtccagtgtccggaggagggacttccaggagctgcctgcccttactcatttctccctcccactgaccccaggggacgaggtgtattccaccatccggaagcaggaatacaatgggaagatccctcggttccgccgcatccggggcgagagtgagctgtacaccagtgatactgtcatgcagagtgagtcaggctccggctgggctgagggtgggcaagggggtgtgagcacttaaggtggcagatgggatcctgatgtttctgggagggctccctgagggccgctggggccatgcaggaaagcaggaccttggtataggcctgagaagttagggttggctgggagcagaggaacagacaaggtatagcagtgggatgggcccagccctcttcaggaacacaaacagagggagccccagacccagtgcagggtccccaggagccaaagtttatcctctgctgagttcacgtggaggcagcccccaactccctcctcatcagggctctgccaattgagcagaagtgacataggggcccccagggaccttcccccagtccccaggcatgaagtcattgctcctgggccgatgacatctttgtaggaagagggcaaaacaggtgtggggtggaggtgcagggtctagggcccctcggggagttggacctgatgttctgagtcctattccagatctgatttgccatggtttgtgcagacccgaaggaggg

SEQ ID NO: 80593 - DNA, 1030 bp, Homo sapiens
tcatgagttccaggaggtcatgttgtgacttgagacaaggtcactggcctatctgcacagtccatgcgggctgtgggacaaggtcagcaggaccaatcaagtgggctgtatgtagccatcccacagggaagcagtcaccaggagacgactgtctacggtagatatctggattgagcacatggaggaactgggaggaggtggggagctggaaacggtgtcaaggttgactgagccctgcttctagtgtgagaaaacccagcttatattcaaaacggatgccagggcaacatcaaagcataggaattcactacattcacctgggcctgcacacctgtgctcacttgcacacactgtcttcagggtgttacgggcagaggtcaggacttcattagccaagtagcctctaactgggcctcaccctcggtaggctttggtctcctcatctgtctgggaagggctgaccttggaagcctccaagggctcatctctggaatacgatgttataagcacagattctggagtcagcttgcctgagtatgaacctctgctccaccccttactagctgtgtaatgctgggtaagttactcagcttctctgtgtctcatggtcctcatctgcaaaatggggataataaaagaacctacttcatgagagttcagtgatgattaaatgagttaatatatctaaaaatcatttggaatagtgtttggcacgtagtaaatgcgatggaagggttgggtggtaggggcatcatcatcgtcgtcatcatcttcctcctcctcctctggcatctctggtttctgatggaatgcagccctggcagcccagcccctgccagttctccctaatgggctttgctggctggctgcccttgctcagtctcccctgctggttcaggctaaggctaagactggggaaccttctgtttctcagcagtcttccacctgcctccctccctccacttggggttgtgtagccattctccgccctctccccgacccctgccctggctgtgggcccaagggcagg

SEQ ID NO: 80594 - DNA, 1132 bp, Homo sapiens
agaccacaagtctggcttgtccgcagctgggctttccccgtagagttgcccgggagagggtggcgaaggttcccccagcagttccgctctcgctcaggaaagccagtgaggcgagaaaaggctgcgaggggcggggggaggggcggggtggggtcagcgctggctccgcctcctggcgcttgggtctgcctgcggccgggcgctggctcagtctcggctgattgccgctgtcgctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggtaggcggcgccgcgcggccggtcaggcgcgggatcagacgctgcgcggggcgggtgcggagtgtgctgcacccggagggagtgcgtgcgcgcagctctgcgggtcccgggctgtccccgcgctgtccccgcgtggagcgtgtgggtttgggtgagtgtgtgtgagtgtacacgctggcacaccagagccggctgtaacgctgcggcgagcgagcggcgggggccggagccccggctaagtcgcaccaagtccctggcagccaggagccgcaacgcccgggcgccaggggagggggcgggcccctctctcggccccgagccactctgggtcctctggctcgggggcttcggcggaggacctttccccgcctgggaccccaacccgggtaccctccttttgagctgcgggctctgctggcgcgcggggcgcaggctgggccggcaaggggggcgcggaccccttgccgccgccgccgcgcttcggcagcgggaacaaagaccccgccgcctgcccccgcccccgccccggcccggagctcgggccaggcaagggggtgggcatcctgcagcgagcggcgggacatggtgcggtgcggcggcttggggtaccagggcgctgcctcagcaatgccgggaccggccgctccccccttgcccgcacgtggcagttgtcaccagaaatcggctccagcgttggggggcagt

SEQ ID NO: 80595 - DNA, 1172 bp, Homo sapiens
ttgctttgggagtggtgccctggagttgggcagtacacagtcagtacagtcacaagtagtggtccttcgtgaggataaccatactttaaaaagtgtgacccagggctgggcacggtggctcacgcctgtaatcctagcactttgggaggccgaggtgtgtggatcacttgaggtcaggagtttgagaccagcctgaccaatatggtgaaaccccatctcaactaaaaatacaaaaattatccaggagtggtgttgcacacctgtaatcccagctactcaggaggctgaggcacgagagttgcttcaaccagggaggtggaggttgcagcgagccgagattgcgccactgcattctggctgggcaagaggtgagactgtctgaaaaacaaaggcaaaaacaccaaaaaacaaatgttattagtctagaattcctgcagtggtatgttgatcagagcaccgtttttcatgtggtaagagtctcctctgctgcaacttgaatttgtttgtttatctgtgcaagatgcttacaagtgaatgtaaagatgcttactagcagttttcacatccatggcacaaatgggtttttctgagcaggcactcacattcttaaggggtgatgagggaagggaatgcacagaccaggctgctccttggcacatgctgaaatgatgttgccatgtctgtggcagagacaggacctgcgctatagggtaactctgaatgtcttgtcccccagaacctgtggacaaagtggctgccatgagagagttccgggtgttgcacactgccctgcacagcagctcctcttacagggaggcggtgagtgtgtgctgcggcccccagccaggactgtaggagagggtgtgaacgctggctggcgagtggtgtggagtgggagctggaagcccgttgccatggcaaccaagagttccttggggagtttttgccatgtctgtgggcctcagtagagccctgtctttccccaaagagcctgtctcagtcaggcgttgttgattccctctaatgataataatacaacctgcccgtatggtgacagccaaaagatcctcatactgtttctgctgggcctcattcttcgactttggctgaactgcctgcttactgccccttgacctagatgtcctcactggggaagtgggctgatgtctttc

SEQ ID NO: 80596 - DNA, 1015 bp, Homo sapiens
tatttttagtagagacggggtgtctccatgttggtcaacctggtctcgaactcctgacctcaagccatccaccccacctcagcctcccaaagtacaggcaccattcctggcttgtttctccactttctaagtttgtcatccactgtttcctaatgggacagggagtttgtgtctacttaaactcctttaagttaacagtttattttttagtgatacaaagtaaactttgtatccttttgttattatcgttgttctcattagaaaaaagctggaaacttttggcactttcctaatgctgcagtttattcccttgttaacaaatcttcctacaaactgcctcaggtggtgatttgttcagttagctaactgctcttgctatactggtattttcctgaagatattcaaagagtatttaaatagctcttggagaaaatatacaaagcctcagatgcctttttggtttataaatagaaggtgcttggaattcatgatttaaattttgcatgtgtgttttaaaagcctccctaagaataaagctaagctgtgtaaaagagattagctttgttacactggcaggttgacatctttttataatgttcatgattgctgtgactagttatcagtttgaaatttacccccctttcagttctaactgtaaaagacaaaaatgtctttcataccctgatgggaagtgagaaagaggaacagagttcctgacatccagaggttggcctggcactcacagccaggccctggaatccttttggggatcatgaacaattgtacagatccccagtagcagtcaaggccactctgagaccactatggattaagacaaaaacaagatccctattattgctgaacagaaacacaaaaacatgagcattatccaaaccacaaaggtgaccaagtatctttctatcttggctgatgagagtaacagctgcttcttggccaattacagcttccaccttgctctagttttccttccttctaggtaagagttattaagata

SEQ ID NO: 80597 - DNA, 1050 bp, Homo sapiens
cttgtcatgcttttttacactgtaagaagagctaaagcagaatgaaagtattgctgcaagcgtaactcacactttctgaagtgccaagagaggaagtaaaggcagtaagaggcaaattggaatgcgaatctttcacagaacacaaaaggcacaaacagggctataagataaacagaaaatgagaatttttaatctctactaattggcctagctttaaaaattgtacccttttttactctaacctggaaaaaatcttaaatccaagcagtttttattgctgaagatgtgattacttctccgtgaatttttgaagatactaaagacactttgttttttgtctttcgacccaatcctaaaacactggaacaatgcagatatcaagtcccaacatgtgcagtgcagcttctttcatgtgatgacaaaattgtacgccatgttgcaagtcctgttcacctaaaattgcccttgcatagtaatccattcagttatggagacttgctgaagaaacataactcaagtgaagtttgttgggggtgagggcctgcaggggagaggtgggggagtaaaaggagaagagggtgtgaaagtgatgtgtgtttggagactgattggtaagaatgcagataaacctgcccccagaatgcttttggcccgaaagacttttctttttgtgtttgtcagagaatatcataatagaaatgaatcagaaagaaaggggatgtgaagagatttacttcgctgtttataaaaaagaagcagcattaacttgttgttcagacaatgttgatatctgtttcaaattaattaactttaaaatctccagaggaattcccccgtttgcttttgagtgacgattgcaatttgagactcttgcctccttgcgtgtttctttcatgttgttgaaattggattctttttgaggctataatgtccagttagtatggctcagtccactcaacaagcaggctggcaatttgatcagggaaatttgaaaagcttagacccaagagcagcttgcttggtcttgctttttctatgagagtaaaactg

SEQ ID NO: 80598 - DNA, 1475 bp, Homo sapiens
tcctttttgaagctaccgtcgtccctcacatgcaggggattggttccaagacccccacatataccaaaatttgagcatactcaagtcctgcagtcagctctgtggaacccacatatattaaaagtcagtcttccatatacatgggtttcacatctcgtaaattttgtctttgatccaagttgggttgaaaatagtttacatataagtggacccaggcagttcaaatccacgttgaagggtcaatcataatttttcagtctttatgacctttgtagataagatgctccataaatcctacccactactctaaaacaactccttttcaggttttctagagccctgaccacactctggtgttctgaagttctctgaaacctttcaggattatgtgagcttaaaccatggcgcttctgaagctgtatctttccgtattagcatagggatatgtgtgtattgttctttaggtagaagtaagctttatagatactaagtccttataaatacacaatcactgacttgacttgggtccttaccctctcaccagaggctaatttctctacatgtgtcccagatcccatccccttccaggtttccagggacttgctccatcagtgaaccctccatttcctgactctttgggctcattctcttccaggccttttccacgtttacgcatcttctctctgtcagacttaaaaacaagcaaacaacaacaaaaacctttaatcttaaattttacctgagtcagttgttaacaaggaaatgagagaccacttttaaaaaatttcctcttgattgcacattattgccagctttttttctattcctaactatcccccacatccttgcaacaaagcttctcaaaggaattggttttactctttatttccatttgtcacctcctactcactcctcagcatactccagtctgatctctgtttcttccatgtccctgaagttccatgttgctaagcccagccttccctgacctcattgatttctcagcattattgaatacagagcactccctccttgaatattctcttcttttgctttctatagtccttcattctgcttatgcttattttcttttccttttcttttttctttctttcctttttttttttttttttttttctgagacggagtctcgctctgccgcccaggctagagtgctgtggcgtgatcttggctcactgcaatctccgcctcccgggttcaagcgattctcctgcctcagcctctcaagtagctgggacaacaggcgcatgccaccacgcccagctaattttttgtatttttaatagagatggggtttcattatgttagccaggatggtctcaatctcctgacctcgtgatccacccgccttggcctcccaaagtgctgggattacaggcatacaccaccacacccggctaattttgtatttttggtagaaacggggtttctccacgttggtcaggctggtctcg

SEQ ID NO: 80599 - DNA, 1015 bp, Homo sapiens
ccactgttcacagttcagagtttaaatttccttctggtattcaaggcatctcacagcccctttcaactttaactattcagactttctgtccttatatcctccctgtcaaaacatgccttgtttataccccactccatgctcatttagactgcaaatctcccttcaacccattcttcaaggccagcttaacctccacctctaagccatccagccttttcttctacctcctgagtaccttgggttttcctatttgttgtcttgctattatatgctatatgtgttcagtttgtttttccaacttcatggtaagactcccagtggtgggaacaattttttttttttttagtggtattctcagcagcttgcacaatgctctacctggggtaggttctcaggaaatctgtgttgaataaacttgtcatcaggtctttgcttctcaggacagaaagggcccctagagaccatctcatccaccctgtctcatgttggattccacgccatgacatgccatacagatagtcatccagagacaggaagttgcccacctcctgggaagctcactccattaccaggcagttctacttgttttaaaaagtccttctgtagacctgaaatcttcctcagggtaacttctgcctatcacactagttgtgccctctggagctttagaagaaaggaggaaaaagcctagtttctcttcactcactacctttagattttcaaagatagtctgtttatttcccctgtgtgctgttgaaatgggttccagggttgagatgctggagaagcactattctaattttgagtagcagtcaggtcagaccttgattcattatttttgaaggcctgtgtgtgcatgtcacagtgtaagctgccatcttcctctggtccattcagaggtgtagccctcttctctttttctcctctcccctgatcctctgtcttctgggggaagatgggcccattctactggaatggtctattttggagggaggggtaaaaagttagcaattct

SEQ ID NO: 80600 - DNA, 1004 bp, Homo sapiens
acttacagtgttgtataggaaaccaggcaaggtgtcttcccagtctgcaggaaagtggtgcatctcagagtgatggcttctggcgatcagccgggaatgagccccttctaagcaacgtgggcctttgtgtcctcctcttccaggattatcaagtataaatgacacccacgacacctacccttctccaacaaatggagatgattcttccacccgattccctctttattttggaaccaaatcaaaagccaaaaaaaaaaaagatgtccctgtaagggtggcagaattagtcttctgagttgtcttttatagtatgagtgaggatagcacaattgctaagcatcttcatctttgccctaaatgattgccttgccctctgtcctaactctttctcttcctttgcccctctcaactttgtgttttgttcccttttagaatggtggtttggcctggagtgatgatgcagatggaggccggggaagagagatctctcgagattttgccaaggtctgtaatacttcctttgtgatacagataggggcagttctgcagtggcttgttacagctgattcccaagaaataaggaccaaggtagccagtgagttgcatttgtagtgattcagatggtcatagtatatctggtataagacttcagcaagatggaatttttcactgtgtgtttttcttgggggattgggattgcagctgtatgaactggacggtgatcctgaaaggaaagagttcctggatgacctcttcgtctttatgcagaagaggggtgagtgtgcatctactcatcattccaattcagggaatactgatagagtgcctactgtgtgctagtcactgttagacatcctggcccactaatcctcatccaggaggagaagaggcatttactgccagttggttctggatttagccaattaaccgatagccagattgaagaggacagagaaggtgttggcacaaagtagatggaatgatcgtccacttttggccctgcc

SEQ ID NO: 80601 - DNA, 1049 bp, Homo sapiens
aagtgaaagaaaagaggcccctcaggatattttggaagggtctgaaatgatccatggaaagaaaaggccaacactttcttcttacccattggctttcgatgtttgtatttgctggcttggttagaacattcctgcagtttaatagtcaggtacataggcatctgcctttttttttttttgagatggagtctcgctctgttgcccaggctggagtgccatggtgtgatctcagctcactgcaacctctgcctcccgtgttcaggcaattctcatgcctcagcctcccaagtagctgggactacaggcgcgtaccaccacacctggctaatttttgtatttcttttttcagtagagttggggtttcaccatgttggccaggctggtctcaaaatccagacctcaagtgatccacctgccttgacctcccaaagtactgggattacaggcatgagccaccgcgcccagccggcatctgctttataatgcaccctcccaattctctttccttctctcctcactctgcacatccccaagagccatcttcactgtagactatggtgtgactgagtttagagctgagtgactcaacttcctggctttgtattcagtcatagcaatgggttcaccagccaggtcagccctcagaacacatggccagcaccccagcctctctaggagaaggccttcagcaacctgtgtggctccaccttcgtcaccctcaggacaaaaccataggagagagctactcccagtagcctgctcccagcatcctgttatagctgatcatgcatcccttggtgcctgtgtcaacaactttattgagacctaagaatgaaatcttcctctttatcctgggccaagctgtaatggcagcccccagcagctaaatattctaagttaacttctctctctctctatttccctccttcctccctactcctttacctttggcagccttattgccttcttggtgtagcctgcctgttactgttggtttgcgtaaaaaaggcaatcgaaagttttgaatcttggttttccccagtctctaa

SEQ ID NO: 80602 - DNA, 1104 bp, Homo sapiens
ccagcactttgggaggccaaggcaggtggatcacttgaggccaggggtttgagaccagcctggccaccatggtgaaaccccatctctactaaaaatacaagaattaaccaggcatggtggcacatgctggcaatcccagctactcgggaggctgaggcaggagaatcgcctgaacctgggaggcagaggttgcagtgagccaggattgcaccacagcctgagcaacagaatgagactgtcaaaaaaacaaataaaaaacaaaaaacgtgtttctttggcaaacataaagccaaaacagttgtaaataaaattgtctggctaatttaactccctgtgggtggtttctgaaataccattccctcatagattttccatttagtctttcagtgcccaaggggagggactaatttctaagtctaataagcaaaggctattataaacaatttcatttttccttcatcagtgaggaagaaaagcttgttttttgttccctaggaggtgaaacagaagtgtggtttcattaaagagtcaggatgatgatgacgataatggtgattttactgttacttgcatttttattataccatacacattacagaacccttgcaacccattatctgatctgctgctcccctcagctccagctctgtagagtagagagagcaaaggttatcacctgtaaccctgaagaagcagccccaaggttaagtgactcacctaaggccacagagcagacttagcacgcggtctcctaactcccaggccagtgtgctttgcttctcctgccttatctttgagaaacttgttccctagagctagcaaccccatcactcccctttggagaagcaggcaaacctcatgtcttcggcagcattcaccgcctccaagagggtggtggcctgcctccacaggccaccgttcagtagcgcttctgagcatctagctgatgaacacagggtagaacctgatgtgcaagatgggtcttcatctcagggtcagggctgtttctcagagaaatagggaagggcagatgtgacaactcagagtggcacagaggctgccatctgtcaaggcaggatggggtagggcttgggagacacagga

SEQ ID NO: 80603 - DNA, 1041 bp, Homo sapiens
gaagccagacacagaatatatactatgtgagtccatttatataaagttcaaaaaaatatatgtcagaatagcattttatttccagagtgggtagggtggagggatggatattgattggaaagaggcatgagagagttttctaggggtgctgtaaatgttctgtgttttggccagacatggtggctcacggcagtcatcccagcactttgggaggctgaggcaggcggatcatctgtggtgaggagtttgagaccagcctggccaaatggtgaaaccctgtctccactaaaaatgcaaaaattagccaggcatggtggcaagcgcctgtaatcccagccacttgggagccggaggcaggagaatcgcttgaacctgggaggtggagtttgcagcgagccaagatcacactactgcactccaacctgggcaacagagcgagactctgtctcaaaaaaaaaaaaaaagttctttattttgatctgagggatggttgtggaggtgtatttggaagtacacatctagtgagctgtatggttaaggttaatgcactataccatatgtaagttagacccactcagtgggcagttggaggtggaaggcttaaggattcttgtcagtctatactagcatattggcacatgcttgcctctggcctgtcttgtggaacagtgcaactacaagctgcacggcagactaccagacactgctgcctgatttcccagtgggagacctttttccttttcctttcccgtttctttttcctttccctttcctattaaaacttttgttagaggttcaggtggtacatgtgcaggttttttacatggatatactgcagggcactgaggtttggggtacgattgatcctgtcgcccaggttgtatgcatagtacccaataggtagtttttcagcccttgtcccctgtagtagttgccagtatctgttgtgatattctctatatgaacaagtcatggggggaaatcagcagtcatttctctgctggcttctggggagcagttctagagcagggcaagaatgaa

SEQ ID NO: 80604 - DNA, 1020 bp, Homo sapiens
ccaagtgtctactctgtgctggtactttactatttcatttaaacctcacagtcaaccctgtaaagtaggtatgcccccatttcccacattacaaaaatgaagtctccatggttaaataatttggctaaggtcatataccagccagtaagtggtagagctgagattcagacctgggcttctgtctctaagacctgtgccccttccaggacattgtcttccaaacagcatctccaccccaagtggcccctcttacctgatattcagcttacccagcggcagaggacccagagaaaggcaggcaggaaggcccccttggattggtgacctggttttgtcagcatttgagttaattacatgggtgatggaagcggtgaaaccaatagtagcactgaagaatgagggccagagaggaatcttttcttctggaacactctggaagttgttctgtgaagagtatgcaatgaacaactgacatcagttaggtagcatgttgtagctacaaccagaatggcaaggttcttgggtagagaactgcttcttgggacctaagacacaaagaatgacagtgtctaggtcccatgcacaatgggaagaattgctcctatctgactagcccagctctgaatggttataagatcaagaagtcagaaagcccttgtaaaacatgggcctaatttttcccagggcttcaaaacaaatgtgaaaacgccaactaagatgttatttatttcccctaatgaatggtgcttcaaagtagagcctatttaggattgagtggcagtcagaggaggctggggcagagtgtccggccatcccagacttttctgccaagtataccaaggttgcaatcctttgccctagagtcctgcccaacagagactgcttccagagacccaccaacctcaactgggtggtctctggtgctgttttggattattctccctgcttgcttcctttcctccaggtacatgaagtatctgtatgcctatgagtgtgagaagaaagccttgagttccccag

SEQ ID NO: 80605 - DNA, 1028 bp, Homo sapiens
gctctgctcaactgcgtcttctctcagccctccacacacactcacccccactcccacacacatacacacacacacacacataccccatctcccgagggctgacctcctctggcctcagcctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcacacaagcaggtctctctcagttgctttgagtggcctttccactggacagtactggggagaggtgagctccttcagagtgaaaggggactgagtgaactactcctgaccccttgatttctcctgaaccttctccccttcacccacgccttcttcaaagggaaagctcactgagctcactctcagctaaccttgtgtgttagcaggtttctctggcgttaccccagaagctcctagaaaagcctgcccggcagcaagccacaggccccgccacgccattggccaggattgagtcacgtgccctccccagagccaatgggagcgagggggcagggtgaccgggaatgaccttag

SEQ ID NO: 80606 - DNA, 1294 bp, Homo sapiens
ccatccctgcccagctgtccctggatccctgccctgtcctctttgggctcctccactaacctcacctgcatgccttggcctcagcagtagctaccatccttgccgcccactctttctctgtcttggagtgccttttcttctccccacacattcccccattttctaggccagcatctttccgcttaacctcctaagccttccttggtgaggattaggaacataacctcacccctggaaagtttgctccctgggcctatcttagctcccaggtcaaacttagagttgcagcaggccacagggaactctggaagggtatagaacccttggaggcactctaccatactccccttcccctgtacccctcctcctacagctggaggatgctgtcgttggacagggctctggagggcgggcttagtacctttgcaccctcccctctctgcccacttcccaccagtgtggatgcttttagcacaggctgtccccctttagccctttacagtggccttaccacaggtctcttgcttgctaacagcaaggacccagctgaccagcgtccccatcccccttttggcagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcggtgagtggtagccagagtgtgctggctggggcttaaaggcctcatctcttcctagccttctctcaggctggctggtccgggtgagtactgccagccctgtgcacgtgcactggtgtgcgtgcatgtgtgtgtgtatgtgttgtctggtccaggtgtagggctgatcacagggtcctggcctctgtgtcttctggctctttccagtggcaactgtaggaactctggctccgatgctggctggcccctggcctgtctatgtctacacagtgctccagacaaaggccacgtggtgcaagtggctggggacacttcttaggacacttcttagggatcctagtagagtggctggtatggtggtctgcagctatatggcctggtccttcccacccagagactgcctcctcgtgtaactgagtgctctgatgtggactgcacccacctctgcgtctcatctgcacaccccttcccaaaggcccccagtctggagtgcctcacaggac

SEQ ID NO: 80607 - DNA, 1046 bp, Homo sapiens
acggaaggctgtttctggtagtgatggtgaaatctggccaaggatgccgtctggaggcaggtagcagcttggctgtgagtggcagctgtcaggcatgtgcaagtctgcgtgggcgaacagaggcaggcaaggacaggctgggcattctgcagctgaagccggagcagccgctgaccagtctggatggttggacccaggcggggccagctgccttcttgcgccgccgttctcactgcatcttccgctctggcccaaagccacatgggagggtctgggagggagagactcggaggaggaggaggagggagtcggggcgatggctctcctcacagcgtggccctcagcagcagaggcaggtcatcttcctgagcgtttgtggcgctcctcttaaagataatgtccgagttttctttacatacctgtagctgtttttacttttctgtttttgaagtcagtttgtgtcttgacgtgtcccttgcaatatccctatcgttatatatgctgtgtgccttatgaaatgctgggatctggaaaatccaaccaaccaacccaccggctcctcaccgtctccacctctgcctttgactgacacctcaatctgtcaatcggaaccgcctaccatgcgattggtcggatggcgtttcggggggcggtgcatgcagagaagccaacagagcagtaagcgcagcagccggagtgtggaagatgacaaggagggtcacctggtgtgccggatcggcgattggctccaagagcgatgtacagccacctttcgtaaaactttacctctctactttctaccccccttgttagacgagacctctcctgcctggaggggcctctagtgcgcgtggtgccttagcggggccaccagtaattgcctgaatgacacagacactagcaacttccatttttaagagtgtagcagtgagagagaaaccttttttgtttttgagaatttgaatgctgtgaacttgcaggagctgccaaccccctgccctccagattctcatgcccaatttcttttctctcctagatgagattgt

SEQ ID NO: 80608 - DNA, 1131 bp, Homo sapiens
atctcctactatgtgagagccccaacttcatgtttttatcttgttttatgcccagcataacccagtgagctccccaattcacaaaacgcagggctgggaggccttcctcaggacacagagacagctggggtgaagactggactgcagtctaaaggcttccagcaagacctttgccacactcccctggttctgagtgtggggagaaggcacagtgcggatgggtgaaggcacactactaagcccctgggggtccagcagccccactgaaggcttccctcccactccttgcagatactcacaacttgttttctttgtccttctccttgatttttttgagcacgttgatttctagccgggcagcctcccggtacttgcccacgttgcggatgatcttcagggcaacctgagacttccctctggtacccgggaaggaaacagaggttctcatcagcagctgcccagtccttccccaaccctccaccccaacccagcaactcccaacaaacaccactccaggagcagccggcactgaagagagcagatactggatgcccagcctgccccatgcaacaccagacctttgcccacccaacagcaagctccctgagatctgtgagttaatgctcttagcatccttgccatccttaggcttttatgttctcagccactgccagctcccaaaggagtgtgggagagtagaggccaatcctgcttaaccagtgccagtccaagagctcacacagtgacctaacctataggccaggcagccccaaccctggccaggctgtcccaccgagaaccctcctgcggcgcctcttgaccttcctgagcttgtctgcaagtctgagcaaacagggatgggggttccaggatcgagtaaagatctggcaagaggtaggggtaccagcaagggtacctctcactgtgaggcccagggccactccctttaccacacccctctccagccgcacctacctgccacagtgtttatcagtgaccacaaaatgccaggaacccttcttaagtgtccaaagaaggttttaacagtccctgctctgtgcctcccacccccaacctcaccccaggaggccatctgcagggagccagcagagaaggaaacctgctgaggct

SEQ ID NO: 80609 - DNA, 1105 bp, Homo sapiens
tcccagccctgcgttttgtgaattggggagctcactgggttatgctgggcataaaacaagataaaaacatgaagttggggctctcacatagtaggagatacccaaaggagggcctttctgtggcagacacactgagcactctcctccacgcactgtgctgagcctgggcagatgggtgaatccagcacagaccctcacgaagctcagcagagtgagcaagtggagaaaagcagcaccagtcctgcggagtgcactagcactttccatctctccctcagcaactctgaggcagggctgcttccatatcataagtagggaagctcggagggcttggaccagaaccgtggacatctcccctaccccccgcaggaagcttagtccttgcccagagctcatctgggtattgggtgatggctggtggggagaggtgctcttgctctgatttctcttgcactgtgtgtatctgcattctggtgtgtgacccggtggcctaggagagagttgggaactgtcttcatctgagagagggggtgaggcaggcccccagcacacagcctgagccctgcccatcctcctcctccagcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatgtaagtgtccaccctcaaaagaagcatgggcagccacatgcctgcagccaagtcatctggttacttgttgtccccattcattccagcacgttactaaccattctcctgggcctgagggacaccagatcccctttggcggaaaggcctgtctttgggtgggaatctcagtgtgaggatggaaaggctagggctccctccagggacctcctggaccagcctctctacccccaggcactcaggaagaaaacagaaacgaactgctctggaattggcctaaccaccaaccctgcctccctgcttcatgcatgggataaaaaggtagaagcctgacctgacagatagcaccacaggtcct

SEQ ID NO: 80610 - DNA, 1627 bp, Homo sapiens
gtggtgtctggaaaacaaagacacccttggggtgacctgggccctagtcccagcctgggctgctctctgctcatagggactttcagatggcactctttccacctgcagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacact

SEQ ID NO: 80611 - DNA, 1077 bp, Homo sapiens
accttaccttctttgtgttaggcactgctaagtgctgggcatccgataatctgcacagcatcctatgaaatagatactgttaatgcctgcagcattgctttcattaacttcagtaagctactaagctcagtaaagagaaccattggcaactgactgaggagaatggagagctatggtacttgctgtgagcttattaggagttgaggagaggtaaaggcatgagccagagtaatcccagcagaggtaagtcttgaactggatctccaagaaaaggcggttcagagtttggaaagtgaaaggctttctgggcaggggatgtagtttgagcataagcaggaaagagccttacaagtgcaggagaggatgagaccagccctgctggagtgaagcagacacgttggggaagaagagcagacaaggctgcagaggaactattaagtgttcatgggtcagcaaagcggtgttgtggcaacagtgttgtgtggagcaagatctgggtgaaccacttagtgggaggacccagcaatgatgtgaggttggggtttgggacaacaggagtgccaccctatagacctggcctgcagtggattttgtccccctctggagcctgggacttggtgagcagtgggtaagagatctgagaccaataggtgctacaggcaattgtctggtatagggtgcaagggattggcaagtatgtagctgatactgcttcttcaccttcttttccaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaaggtgagcacttaggcagggctgggctgaaggcctcctccctccttagcagtttgatggtctcgtcatgccacccagtggcgacaggtggaaaggcactacgtgtgtaaggatggtgcttcgcctctaa

SEQ ID NO: 80612 - DNA, 1517 bp, Homo sapiens
agcagccttggcaacagatttttctttatcctcagtagtattcattctggccccagagtctctccttccttcaaaatttcatttgaaattttcatgaccttttagttccttatgctatcctatagcttccctatgtcccttgaaatcaattctccttggtctttctgttcttactttctacccctgtcaactttatcctgcataaaacagctcagcttttaaaaccttctgaccttggccctgcccactgctctacactgagccttcataccaccctctgggcttcaggcagggacatattcatctgcacatgtcacatgcattctggcctctgagaagttcatggttctccactcctacctggagtccctcttctattcattgtgactacagtcctgcctgtctttcaaggcatagttcaaattgagacctgacatctcctacctgtagctcctgatttgaaattgatactttgcactcgtgctcaggataacacagtttaaggctgttgtgttattttctgaagtttgcacctatgtatttttttgtttctagttagattataagactggggggccggacacagtggctcacgcccgtaatcccaacactttgggaggtcgaggcgggtggatcacctggggtcaggagttcaagcccagcctggccaatatggtgaaatcctgtctctactaataatacaaaaattagctgggcgtggtggtgcacgtctgtaattccagctactggggaggctgaggcaggagaatcacttgaacccgggaggcggaggttgcagtgagccgagatcataccattgcactccagcctggataacaagagtgaaactctgaactctgtctcaaaaaaaaaaaaaaaaaacaaaacaacaacaacaacaaaaagactgggaacggtctctgtatttctactcgttttattttctctgtttccccggctgttccccacttcaccactgacttgcttgatgtactgttactctataaacatttttaaatcatatttggaagcacttaactttgtttccctttttccttcccaactcttttttgagacaggtctctctctatcgcccaggctagatagagtgcagtggcacaatctcagctcactgcagcctctgcctcctgggctcccctgacctcagcctccctagtagctggtaccacagatatgcgctgccacccacagctaattttttttttttttttgtatttttagtagagatagggtttcaccatgttgcccaggatgatctcgaactcctgagctcaagtaatctgcccacccttggcttcccaaagtgctgggattactctttggccgggcatgagccacctgcctggcacccccccccccccaactttttttattgaaaaaaatttcaaacttacagaaaaattgctagaatagtataatgaacaaccatatacccttcatttagattcaccagttaacattgtgacatatttgttttatgtaaaatacatacgagc

SEQ ID NO: 80613 - DNA, 1590 bp, Homo sapiens
ctcataagattctttttttaatttttttttaaattttattattattttttgagacagagtcttactctggcacccaggctggagtgcagtagtgcagtatcagctcactgcaacctccacctactgagttcaagtgattctcctgccttagcctcccatgtagctgggattacaggcacacaccaccacacctggcaaatttttgtatttttagtagagatggggtttcaccatattggccaggctggtctcgaattcctgatctcaggtgatctgcccaccttgtccttccaaagtgctgggattacaggcatgagccaccgcgcctggcctaacactcatggtattctaaaggaaatactttaagacagtttgggtcagtcaaaacactgtgtttattatgtttattatgtgtaactgactctaagatagtccttgcctttaagttatgaaaatgtaataggagatggaaagattccatatatgcccagagtccagtgaaagtgtggacattaagtgcactaggtgttgagaggcaggagaggtcctgtaggctgcatcaaggaaggcttcatgatggaagccttgaaacatgggcaggatttcaccaggcagagagaaagaggaagatattcatgggtaggctaggcaggtgcaggtgaatagtatgagtaaagggctgtgtgggagactggtcattagctggcttggccagggcagagagtttgtgctggggagtagaaggaactaaaatatagctttggaccagagcatagagggccttgtgtgccagtgctatccttgtcctgtagtcatagggaacaactgaaggcttttggataggaaaatgacatgatccaaatctcttttaggaagactggtcttgtggtaggattccaggtggaacgagaggggagagaagagaccagagcaggaccagtcatgctcatgatgtagtttacatactagggatttagaccattgaatggaaaggaacacaaagatatgagggaagcaacagagggcaatttgataggctatgatgattgaaaacagggttgagtgaacaggaggatttggaggtattgaacctgtgaggcaggaagaatggcagcaagtcaagttatcatgagattgcacgaatttatagtgggccaagcctacatggttttgtgaccccccccccctttttttccctcctgcaatgctttgtgcctgagcccagagaaagcaaaggcaagagttgctacaatgagggatagggagatgtgggagttattggttattaagagctttaatgaggagttaaaagttatatagccaaagagaggctactaagctggtttccttatctataaagtgggctaatactgtggattaaatgagattatgtggaaaagtagctagcacaatacccaatctgtaattattattcagtaaatatttgacttcaaatgtgaatttgcaaaggccacctcagtaagattatttcaaagcatcagcatttatagaatacctactatgtgccagacactgttttaaatactctgggtaagtcatagttcatcaccttaggggcctctgagtata

SEQ ID NO: 80614 - DNA, 1264 bp, Homo sapiens
ttggcttctctattactgcccatacatttcaccagacttcaactctgttttactaattatttgttgttgcaaaaaaacagttgaagatggatgattggaatcattggctaaaaatagagttttaataaattacatttctttactatgctgttcttatctcctgttagcccaggacattgaaagttggctaatttcatgtaacagtgtagtgccttatgtaggtcattgtagatgataatctagttctattacctcagtgattattgtttctttttttagcattagaaccttttcttcaaacctatggcatataaaacagattaaagcagtgtgagagaggtaattcatcacatccgtgtcccatcccttcccctcaaaccacattactaactgggcctcttggaatatggtttgaaaaccattgttattgaatgatcctaagagctaaaggggaagtcataatcattttagtaagtagagaaggaattgagtataatatttttattttggtttgaagtttggaatataaggaatataaatcttgaatgctggtagctgctataaggagaactgtggacgcagctaattgcatttggaggaaagccagacatggctttttttttatagataatagtaggactctgttgtatttggtttcgctgagtatagtagcttgcatgtgctttccatgtgaaaaaaaaaaataggccaactgtcaggctaagaaagactgctaaaaaaaaaacaagctgctgaactgtgtcagtcttttgctggcagattctggtaggcatgcctgtttattaaggtggtttccttaagtggcagtgacagtgacactgtaacttgccgaagtccttcgatttttaacacctgtgtaaaggcaaacagcctagctcagaatcgggtttaatttaaattgctaggttttaagcctttcaaaggcagttatcatctgttaagtctggtactcctccagatcagccaactatctacctctgactgcttccttttttactgccctctttgtaaaagaagctgctcctgctgctagctctctatatctgtagtccaagtgctgctgctgaggctgttggtttatgcagcgtgtgatttccctggaactatttacactgcaggattttttttttttttttttgagacgaagtctcactctgttgcccaagctggagtgcaatggcgcaatctctgctcactgccaacctccacctcctgggttcaagcgattctcctgcctcagcct

SEQ ID NO: 80615 - DNA, 1081 bp, Homo sapiens
tgccactgcagtccggcctgggcgaaagagcgagactccgtctcaaaaaaagaaaaaaaaaaaagaaatggagggagaaggaagacaaataagactaaatgaactttggtagcaagttcttgactgaatagtaattcacaacatctctgaattcagtagtcattacaattttaggaataatttattgggagaataacagtatcaatgaagcaagagtaaataagaagtatgtttaagaaaataccaaaaccattgcaccccaccagaatgagtaagttgaagagaacaatagtaccaagttttggcaagatgaggagcagaaagaactcacgtatggtgggttgtataaatgtagatggtaatacaaaatggtacaaccactttggaaaactgttcagtggttcctaataaagtcataaatataacatgacttcctgtgttatatgcccagtagaaatggatgtatttgtccatcgcagaaatatactgtatacagtttaagaatattatttgtaataagtcagaactagaaataacccaactatgtatcagcagtagaatggataaatacattgaggcatgcttacagaaaacagcacagctatgagaaagaataaacttctgatacatgcaacaatggggatgaatctcacaaatgtactttttttttttttttttttgagacagcatctcgctctgtcacccatactggagtgcagtagcaggatcttggctcactgcaacctccgcctccccagttcaagcgattcttgtgcctcagcctcctgagtagctgggattacaggcatgtgccaccacgcccagctaattttttgtatttttagtagagacagggttttgccatgttggctagattggtattgaactcttgacctcaagtgatccacccgccgtggcctcccaaagtgctgggattacaggcatgagccaccatgcctggcctcacagatgtacttttgagcaaaagaagacaaacactctgaaagagaacctttatgattctgtttatgtgaagctcaaaatcaggctcaaataatctttcatgatagatgtcagaata

SEQ ID NO: 80616 - DNA, 1888 bp, Homo sapiens
tcctttccagcctgagggactggggctggagcctgacatggttagctccctcccaccccagtcagcctttttaatttttattttattttattttatttttttaccaactgtgagctgtgaaggtgtgatccagggtcccagggcctttgaagaaaggagtctggcttctggctggcacgtgtgcagggatgtgcttttcattggtgagcttggtgccctccaccctctcagaagcagctgctcttctctctgcattgggtcaggggcaaggaaaaagcagaaaatgttcccattcaccaccgcaggggggccagaccccaaaaggctgagccacacagagtggccctcggcaagggttggaaatttcggggacagaatgcagcttcctccaaacaagtataggtaggggttgagacccaggatccacagtgtgacatggctgccccccaaagggggcagacccacctgggtgcggttctgggctccatcttttgaaggattttaaaaccttgacaggtcatcttcaaagagccagggatgttgactgagtctgggaaagagaaagtagggacagattctcatatgtctgagggactgtcccaaatgagaaaggcatcccatggcagaaattgtcccagacacgtgggccagagctagggagcaggtgggtcccagggaagtgaatctgagctcattatagggaaaccatgaatgtactcattttcttgatttagaaaataacaaaacagcgctacaggaaatttagaaaatgaaacaaaaatcacccactatttcttcagcaggcagtgactgtgttagcattttggagttcactgccagtcttttccccatccttttccttcattgtcgttgtcactggagtgtgtgtgccgtgacaccttttttcatttaatactgcgtctgtgggcattttctcatggtgctacgcggtctaagtaacgttgcttctaaaaagctacagaacattctaggctggcctgctgcagcgccatcacccatacactggagcgtgtgcatttttcccctctgttgctgttgtggttgtcgttactatgagtcccaaaagcagccagggtgttggagggcacaagcaacttggcacccaactgaatgtgggttccaggcccagacatgccacttaggcccagggtagagggaccttagacaggtcactgacctgctgagcctcgttgatataaataacaggatggtaacacctacttcagaggaaggtgtaaggacagtgtcaactaactaaccaagggactctaaagtgcctggcacagccctttcttcactccctctgtgagtaggattggcattgttgaaggagtgcccactgctggctgcctcaacctgtggggaaggtgcctgagccacgggccaatgttgactgaccactcacctggcaaagaggtggtctccgcctgaggagcccctgtgaaaccccctggccctgaggttctagaatactatggccagtgcccttgcctgccttcccttctccccattaccatatgattggctggcctaggacatggggctggccctgggaagatgggctgctggttagggtccgggacctgactccacccattccccttccggtctcccagcatcagagctaaatagacaaggcctcttctctctctctctctctcttttttttttttgtgtgtgtgtgtgtgtgtgtgtgtgtgtgagatggagttttgctcttgttgcccagtctggagtgcaatggcgcgatcttggctcaccacaacctccggctcccggtttaagcgattctcctgcctcagccttccaagttgggattagaggcatgtgccatcacgcctggctaattttgtatttttagtagcga

SEQ ID NO: 80617 - DNA, 1033 bp, Homo sapiens
gggagggcgtgaaggcgggtaccaaactcagcctcatgccgtgagtaccacgaggaggggttggggagggaaggggccttggtcctcctgaaggagcatcaggagcaagcagggaggccagagtgaggggcttgggtgttggggagggcctcaggaggaggtgcagggtgcgggtgcgggacctcacagagcagggctgggggcagaggcaggagggtggcaaagaagggacagggagcagaagaagagggcctcaaatgcctgactgagcgagtgcgagccacgggtgccaagcagagggaaccccttcagaaaggggagccagggtcagtacctttgggccaccatgacctccagccctgctgctccccagttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggaggtgagctggggggtacagagccttgctcccaccctcacacaccctaaacccatctggggccctggcttctagctccagccccactgcttctgcgtggtgaccagccatgtggggcaacttctgtgagcccttgtttcctcacaccttggtggagcagctgctgcgtgccaggactcacctctgaccccacagtgccaccatgaggaggggagccttatcctcattttatagaccaggagttgaaggttcagagcagttaggggacccacctgaggtcccacagatataatttggtgccaggactagaatctgagtctgtctgatcccagagctaactttcctccagccactcacagacctgcatgctcagaagcgtgtgcagaaacatgagccatgcgccttgatcgccagggcccctgaggctctcgcacctgcacgga

SEQ ID NO: 80618 - DNA, 1020 bp, Homo sapiens
gtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactggggtgccttcccacaaaactagcctccggctctgggcccgagacagccgcaggccccagccactgaatgatactggcagcggctggggttttatgaactcctttct

SEQ ID NO: 80619 - DNA, 1033 bp, Homo sapiens
atttctcctgcctatttagtggagaaaaagccaaagcataggaaggctttcgcctctgcttctgaaactggaagatgtatgttaacccctgaaagaatcatttaagagtcatagtttttctgctaccttgacagtgcagatgtcattctcctctttggacagacaaagaagatacatctaaagaagggaaataactagtccaagtcttcatagatggctagaggccgagtctggacaagggcctgggtctactgcctccctgtatgtccatgatggcatgaacatttgtatccagacctgggaggcctttcccaggactcagttgccctgtggggagcacagcataacggattgggacaggccaactcagggtggcaggtttcttcccccttcccctcccaagtttcctgtctttccagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggtaaaggacagagtgcggtgcagaggtcagggtacagaagggcttatgctaaggccctcccgtgacttttactgccacttttaccccacccatgccaggctcctgcccaaggccaaatccaggctgacaactcccaatttagctctgcaaagccagatggtagtgacacatgcagcaactaagtctaagcaaacagctcaccggcctgtgccaggggagtttctctaagctcattccaaggggcttgttcctggtcttccctcatccaacccatgtctattcatatctgccatttactcatctgctttcaggaagagttcaacttgcaaggcagggcaggtaccctcagccccacccccatggagtctccctacacaagccggagtcccatcctaagcaactgtggatcaaaa

SEQ ID NO: 80620 - DNA, 1049 bp, Homo sapiens
catcttaccattcctgatatgggccctgggccttgccttcctgtagaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaaggtggacacagttatattcctggttgggtgcaatgctctggcctgggcttcccagcagacaccagactctggggacagttctcaacccccttgcccaagtggaacactaaaaggggccccacttagatgacctgttggcaacttagcattgcttgcctagtctttgtggagcagggcccttcttagttgagtgctgcttcccaactggtcatcttctccagatggttggaggcagactggcatagaggactcttaggatgccttccacctaggcattctgagattttccctagccctgcagctgccctccatggatggacttgtatctcggggctaaagaggcaggaaggggacacgagcatcctccctctcctggaaaggactgatgcctccagcactcagtcatttgatctttcctttaccttctgtgtgcccaaccttgtgctaagaagagttcaggaaatgactgtgatgggtgtggtcactgtcaccctaaaggtggggagtcaacacaagcagtaagaaacccaaaacagaacagactcccagcaatgagcttatgtggtgcaggcgatgaggtctcagcttcttagcctggcagccacaaccccttctctaggtggcccagagctctctttttattttacctctacaggtttcccattacctttgagccttagggcattatttatttgacccaagcatatttttttctgttcagtgtgtgtgtgtgtgtgtgtgtgtgtgtgtgtgtgtgtgtgtgtgtgtgtgtgtgtgtgtgtgtgtgtggtctctttctgttgccccaggctggagtgcag

SEQ ID NO: 80621 - DNA, 1018 bp, Homo sapiens
atgctactctgattttaagtcctgccagtcagtgtgggaaccacaatttgaacgcaggctatattggatcaaagctgttgttctgtcacagcctttgtatgtctgtcctacctaccagggatttttacactaaaatatgcatgttgccatggaaggatgccacctttcgactgttggctgcttatccacacatgcctcatgcacaggattctggggtagaagtgggagactacagagttggggctccccaacccccaggggttaacatgactcccctctgacaataatgggtgacctgtcacctgtttttggtatttgatatcttaaccccattctcccagagaatacaattcatggaaatttttacctaacttggcatggggttcatggagctcaggttaggaggcccagaactggagagctaaggcatacttcatcagcttagcacatgacgactgtctctccagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtgagtgaggggctatgatgggtgtccttcgtgtgccatgaaaatctctggcaagggtcacgatgtggaggacacctggggctgggtttcctgtcaagcccacttggcggagggtggccccagggcctgcccattccttcctgtaccagggaccaggcctctatgctgactgagcctgggttgtgcgagaaggtggcagagctctccctcgtgccctggggactgtcctgggcccatgagctgatgagagcagagtctgagctgcactgccttatcatttcttcctgcccaggtccctggctctgtcactgaatacaaggtcttggcactggactctgccag

SEQ ID NO: 80622 - DNA, 1034 bp, Homo sapiens
aactgaccatttctaccctgcctcactgcactgtcccaccaggtccctccagctttttctacaaggtaacaccctcctacatggggtcagccagctcagaaacctcttcttcagggacagttgcagctgaatatgccagagctgattattacaacaacgatgcagagggccttggttttggggtcctgccaccctcacccctagaagctgctaaacacccaggccattctgccctgaccacctccccaacagagatgtaggtctatacttaccttccacagccacctcccagcacacactgggtccctctacctgtgttgctgtctttctttacactgtgctacatttgatccctttccacatgtgcacttcacctctgcagacacaagaaaggcctggacatggtctctgcagatggggaaggggttctggatggagatgttcttgagctctacaagcatttgcacaaagtgctcagaatgttggccactgcatagagctgcagagtcccattccagaacagagtaaccatctgcctctcttcccaagaccccaagctggcatgactctggtctctgtcctatctctctgctgtgatgctcctagctagtagagtaagtcagcccccagatactgtatattcctctcaaccttccatggtttgagaaaaacacaaagatagatgtccatcaggcactcacaggattaccatcgtaaggatggttgtcagacaaataacaaataaggccgtatctttttattagacttgctcatcttctagtcaccccttgtggtagagcgaaaagagtgtgttgtccctctcatgcctctggtggtcacaggacactgagtaaagcaagagactggatactttcccatgtagaacctataccccaatcccgactattgggctgggaaccctgtctatgcccattcaaagctcaccatgtgggaggactgcttgggcctgggaggttgaggctgcagtgagctgtgattacaccactgcactccagcctgggtgacagagaccc

SEQ ID NO: 80623 - DNA, 1009 bp, Homo sapiens
tagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccgtttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcag

SEQ ID NO: 80624 - DNA, 1046 bp, Homo sapiens
tgcaatgaagcgatctcggcccactccaacctccgcctcccggttgaagagattctcgtgccttagcctcccgagtagctgggactgcaggcatgggccaccacaccaggctaattttttgtattttagtggagacggggtttcaccgtgttgcccagggtggtcttgaacttctatgctcaggcaatccattcgcctcggctttccaaagggctagcgttacaggcatgagtcaccgtgtccggcccaaaaaaaatttcttttgttaaatggcagctactggacacttttctgattgggaaggaagtaccagtgtataaacaacaaaaaagccacaaagctagtcgcttgtgggttgacagtaggcaggattaagtaagagcagtaaagggtacagagagacagtgatttccctggttgtagcactaagggttatttttaaaagatttctactttttctttattctttcctggctaattctttgtgttttctcttacagatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaattaggtatttgtttcatgtgtttgcattaataagcagaaaattaagtgctgtattggtttcatggttttgctgccctcttacatgctgagagaactgtgttaattctctggaaaccatctgacatgaaaatcagcttcattaatatgtttgggtgccctagcttgtaaattagctgaaggctagaagtcatttatatagaattttcttgttgacaccctaggcttaggggactggttgtctgtggggatagatcaaattgtgtacctttccaaaacaggttttaatgatgtttaaaagtggtcactgagatagtcttgaggatgtgctatgcagtagccaagccctcttacggtgtgttcctctcttagtgccccttt

SEQ ID NO: 80625 - DNA, 1112 bp, Homo sapiens
gcacccagcaagttgccctacttaccgaacaaatgtgttaacttaaaagtagatgacctgttttgttttgttttgtttcgttttttgagatagaatcttgttctgtcacccaggctggagtgcagtggcgtgatcttggctcactgcaacctccgcttcccgggttcaagccgattctcctgcctcagcctcccgagtagctgagattacaggcatgtgccactacacctggctgatttttgtatttttagtagagacgggatttcaccatgttgtccaggctggtctcgaactcctgacctcaagtgatccgcccgcctcagcctcccaaagtgctgggattacaggtgtgagccaccatgcccagctgatcacctgtattattctgtcctacctgcctctgcataagtaattaaaggcatttttaagttcatttcatgaattaatagacatggcttttgagagagttaaatgtgaatattctctttgccatcaggacaaagcaggacctcataaggaaatctacccctatgtcatccaggaacttagaccaactttaaatgaactgggaatctccactccggaggaactgggccttgacaaagtgtaaaccgcatgggtaagcgacaaaccactgaagaaggcaggaaaacaatccagagaggtgtgggtggatgacatttcagtgtgctatagtaagacctttcagtgttcttgttagaggtaatggccgtgagcatgaagagattttgagaataccagtaatggtaaatttaaagaactgaaatgatttctagttgttgtcattattttctttctttccttcttttctttctttcgtctttttttttttgagatggagtcttattctgttgcccaggctggagtgcagtggtgcaatctaggctcgctgcagcctccgcatcctggattcaagcctcagcctcccaagtagctgggactacaggccacatgccaccacaactggctaatttttgtatttttagtaaagacgggatttcatcctgtcggccaggctggtctcaaacccctgacctcatgatccacctgccttggcctcccaaagtgctgggattacaggcttgagccac

SEQ ID NO: 80626 - DNA, 1075 bp, Homo sapiens
cagccaggccaagatgctgaaaccccgtctctactaaaaatactaaaattagctgggcttggtggcacccgcctgtaatcccagctacttggtaggctgaggcaggagaatcacttgaacccaggtggcagcggttgcagtaagctgaggtggcaccactgtactccagcctgggtgacagagcaagactccatctccaaaaaaaaagttaggagttgaaaatgaccctcttgttctcaaaggggaaaaaaaaaactcaggattttttccttcaatctgcgtgctgttgcatagttctttctttccactgattcactaagggagatccactgtgatcttattatctagaatttgttaaaggtaggtttctctcattttataggtaagagaatggagacccagacagataagatcatacatcagtgattcagtaaaaatataaataactcatagtttaagtgaggctcttcgaggttgacatggcccttctttttaattttgcagggataaacacacttgttacctatgatatggttccagagcccaaaatcattgatgctgctttgcgggcatgcagacggttaaatgattttgctagtacagttcgtatcctagaggttgttaaggtcagtgaaataataatgctaaaattgttctgtaaatgagtgggctattgctgaggtatcagaatattctgtatttttgaatttgttaaaatgcctaaaatgagtccttatataactagaaggaatgtacattgcagttaaaatctttctagaggctactttggcagcatttattcaaggccttacaaattgtacatgatacacttttgttcagcaattccatttaagaatttatcttttttcttttttctctcttttttttttttctttcttttttaagaatttatcttggccgtgtgtgatggctcatgcctgtaatcccagcactttaggaggctaaggcgggtggatcatgcaatgtcaggagtttgagaccagcctggccaacatggtgaaaccctgtctctactaaaaatataaaaattaggccaggcgcggtggctcacgcc

SEQ ID NO: 80627 - DNA, 1010 bp, Homo sapiens
atagcacgggcgcggtggctcacgcctgtaatcccagcactttaggaggccagggtgggcggatcacgaggtcaggagatcaagaccattctggctaacatggtgaaaccccgtctctactaaaaatacaaaaaaattagccggacgtggtggcgggcgcctgtagtcacagctactcgggaggctgaggcaggagaatggcgtgaacccgggaggcagagcttgcagtgagccgagatcgcgccactgcactccagcctgggcaacagagtgagactctgtctcagaaaaaaaaaaaagaatttacacaaagcagtcatttggttcccttcccctttgggtgatggtttgggttttttgttatttttgcattgttttgccatgaataagtatctaagtaagttagaacttgtctttcctaaatttgcagatgcacacttaacatgaaaaaatagaattaggtgtagggtaatttatctcataccaaaaattcaatctcaatgactatcgtattcactggtatcctttgtttaaatattttaaagtaataaaagcaagaaacctaagtgctttaaacttctctgcagaaatgtaatgattcccttttgctacaaccaatagaattcttactgaacaatctggagtagaagtaataaaaagaacaattatgtattcccattaagagaatcttaaattttattatgtgtcattttgtgcagatctgaaagtaatcatgcccaatcattttctggttgaatgtttatgagtctgtgtactaatgtttctctataatatctccttaatgtcctcatttaggcttcattaactctacgcatttctctggctgtttttaggctgttttccagttgaatctcttttattttggtttttttgtttgtttgttttgttttgtttgagatggagtttctctcttattgcccaggctagagtgcaatggcgcgatctcagctcactgcaacctccaccacctgggttcaagtgattctcct

SEQ ID NO: 80628 - DNA, 1051 bp, Homo sapiens
tgctgggaaggctgagataggagaatggcgtgaacctgggaggcggagcttgcagtgagctgagattgcgccactgcactcccgcctgggcgacagagtgagactccatctcaaaaaaaaaaaaaaaatttaaatcacgtggggagagtctgttttagcccttcagaaagggatgtatgggtttttaaatttttatttattttaatttgtttgatatagagtgttgctctatcacctaggctagagtgcagtggcgcagtcatagctcactgcagccttgttgccctgggctcaagggatcctcccgcctcagcctcctgagtagctgggaccaccaaaccccgctaattttttaagttttttgtggagaatggaggtctgtctttgttgcccaagctggtctctcagtcctggcatcaagcgatcctgccttggcctctcaaagttctagttctgttttataaaagactttttggaatacaaccagtttgtaatttggcttccagaagacatatgatcaaatccttgaaggtggtgatctccttgacttggatttgctgttggtggtcatcttattcacagttaggaaacaaagcctagcactcatgtagtcaaatccatgcccagcagtgaacaaaacgaattgcttatcatgaagcactgttgtggatgggacaggtaattacctctggggaaggagtacatagacctttcattgggtaaatacttaggagtggaattactgtgttatatggtaggtttgtgtttaacttgataagaaactgcttaaaccgtcttccaaagtgattgtatcattttatacttgcactttcagtattcagttaaggctagctttagtttttgaagaggtggcttataattttttcttttttgagacagggtctcactctgtctccgaggctagtgccactgcatctggccctaagttcttgataatagtgcattagatggttgttctaatctatgtttttacatagatagatagatagatagatagatagatagatagatagatagatatttttttttt

SEQ ID NO: 80629 - DNA, 1125 bp, Homo sapiens
tgtttgtgaaccgatccttgtcctccgcctcggggagctcctggtctgtgggttgggggaaccaagtagagactcggactgagcattcactgtcacaggcggcttaaacaagtaatgtcccagcttcccgatggggagatcagtgagggcctggcagactttcccagggacacagagagaaagggaggcgacagctagcgaataggagacttccagaggtgatgggatttgggtgggaggagaggcaagagagggcattccaggagaatgtatgggcaaaggcacagggatgaaaacgagcacagctgttgggggctgagcctgggagctcagccatgtgactgcccatggggtggtggagtctggagaaatttgcaacctgtcccctacatgttctgcctcacggagcagggctctgaaagagggagatggttcttgcaggggcatgattggcagagagattttgtttggggctacacaggtcttgctaacttaggtttgttctgggcttggtgagccttagggcaaagtctctagagctgagagggggctgtctctggtgaatgggcccctgaaagagggtcttaggtttagcaaaccccttggagagttagtggggtcccaggaggggagttctagagagagaccttgggctctgtggctgtttctttaaccgtttcctgagtggccacctccaagcaagttccccaagtcacctcccctctctgggcatctctttctagcacctttctctagagatgaaataataggactaagtagtgacctcccttgaggatgctccttgttctagtttagagcatcccccctttcttctccctcttccttttcctttcctcccctatccctctgcctccctgtccctatccccaccccttgccccccacagcatttcctttacaggctgcacttccttccctgctgccagccaggagtttcggaaggtttcctggaggaagtgtgatacagcaggtttgacagcagctttgggcttaatctgattgggggagggcgttaattgcctccctcccacccattgggaaagtgtccaagtcttaagcaagtatatggattgactgtgctctgtgctgggtccctcctggaaac

SEQ ID NO: 80630 - DNA, 1082 bp, Homo sapiens
gtctaacacacaggagattgcacaagttgtaactgtatgcttggagaatgttcacaaaatccatacctttgtgtatccagaaccccgaccaagaacagatgccgggcccccagtcgctgccccatcaagggtaatactatcttgacttctaacaccatagatttagtttttcctgttccaaaactttaagcaaatttctgcccagcttttaaatgttgcattgccttagcacttggttgtggaccattttctgctgttgactatataaatgtccaccaaagtcactgttctaacaaggtgattgctgcttggtttccttggccttaacttgccagtgattacttagcatgggtcagccaggcctcctgctgaactcccaggagcagagcatgtttgtaccctccagattcctataagacgccctgtccaggtgtcccccagcgtctctaccctgtatgtccctagcacagctgctcgtcctcccctggaacctccgcctcatctcacacaggcttgtcatgatgggtctccaccatccactcggggttaagtgggcagggagtcttccaattgctccctttcccctactccttaaaaccaagaccccttcaaacttgtctcctaagggtctcaggaagcacatcctgcccaccttgcctttccagcctcatctgctgccccctcatttgcactctgctttggccatagtggctttctttcccttatgatgggtggctcatgcctataatcccagtgctttgggagtccaaagcgggaagattgcttgaggccaggaatttgagaccagctgtgcaacacagcaagacctcctctctacaaaatattaaaaaattagcatggtagtctgtccctgtagtctagctactcaagaggctgaggcaggaggatggcttgagcccaggagtgccactttactccagcctgggtgacagagtgagaccctgtctaagaaaaaaaaaaatgtgaagctccttcctagtaaggaactgtccctgtacgatgctttcccatctgcctagaaggctgttttgcccggggaactcctcttcatgcttcaggtt

SEQ ID NO: 80631 - DNA, 2339 bp, Homo sapiens
ggatcatcacagctgacccggggaggtagggacggctgggtggggaaagcagagtggccggtggccacaggggccaatggggcagcacagccaggggaaggatgggcgtcttggattgtcgggtggaagactggaggtgatgttgtgcaatgtgtctcatccacagagaaagtgaacaacttcccaccattgcccaaattcatcccgctgaagccatgtttctaccaagacttcgaggcagatattcctccccagcatgtcagcatgaccaagcgcctctactacctctggatgtgtgagtgccatgggatgggggtgggccagggtggctggaggaggcaggaagactgggcgtgctgggcagcggggtggggtgcccacaggcctgactgtccttcagtcccacttgtggcatatgcatggaccataagtcttcccctgccaggctcccagaggcttcttccatgggccacctccccgactgggcctcagtttccctcaacctcccccatctaggcctctcttcccttccttcccctccaccctcctttcacagagcatctggacaggggtccctctctgcagtgtaatccctgtcttcttgcttcccctttcccttccactggagtaactttccagggaacctctggggactgtcaggacctcaggattctggatttggagaggaatccttccctcaaagccttatttgtcttgctttctctggaagattgctcaaagagaggaggattcagctgggagttgggagctgtgggatcaagtttgcctggtcactgtgcttgccaagcagcaggttcctcatttgtaggaagaaagtattggcttggcgattgctgtggttccatgcagctctgtgttgggtggtctatacctgtaagagtctaatgtcaggcacagtggttcacacctgtgatcccggcactttgggaggctgagccaggaggatcacttgaggtaaggagtttaagaccagcctaggcaacacagcaagacccctgtctctacagaaaataaaaaaattaggcctgtgtggtggctcacacttgtagtcccagctattcaggaggccaaggcaggaggatccaatgagcctaggagtttgagaccagtatgggcaacatagcaataccccatctctttaaaaaaactagctgggaatagtggcacatgcctgtagtcctagctactcaggggactaaggtgggaggatcacttgagcccaggagttcaaggctgcagtgagctatgatcatgctactgcactccaccctgggtgacagagtaagagcctgcctctaaaaaaataattaaataatctagaattctttatttagaaaaccttagcatcaatgttctaaggttttaaggctgagagtgtaaaggcctcatttctggtgatctgtagcagggggtgggaaaggtgtcttcttggggggatgggacttggctgtgctgaggctagttagaaggtacctcttaggcatgtgagggggaggcaagctggctatcctgtgctgggtgtgagccccaggatcccaagatacccgcaatgtaactgcagttgggttctgctatatgtgacactgccctgagtgaggcctgcacttagctgcctacctgggcagatgcttgcatgtgccgacaaggtggtaaaatatactgtctttgcagcaggtccctcatggcatggtaggaagaggatggggcagacagactcagtttcaaggcctggcttggcctttgagtgaagaagggatctcccaccatgtaacctgagagaaggggggatgggacaggtgtgggtaagtctgtagatgttgggaagcaaatgaagaagttacctctgatggcttccattttttccatcaaatatgatgtagtgtggagagtgggctcacaacgaggccatgtttgtcgacggatagtgaggacactctccaaagaaacccggcccctaagatttctgggccacacacaaggttcatttgacattggctgatgtgaatttacagtcttcctcatggggtccccttttttcttagcaacattcagctcaggtacagatgagaattatgttcatctagggtgagtgtggccagaaggcagggcaggggagggaataagaaaatgagtaatgaattatggaatctaagctggataaggagaagagtgaagacagaaagaagctgatggctagagagagagaggggctgagctcatgggtatccattccagagaggaagcagaataattgcagcagaggtgtttgagcaagggagctggggcaggttggactggggagagatgtgaaccaatat

SEQ ID NO: 80632 - DNA, 1046 bp, Homo sapiens
ttctatataaagagcaaataaaatcagttttaacaccaagcctccaggagattttggggcaatgaacagggatagaggaaatacagctgaaatgtacaggaagaaatgcccacccatgaggggccctgagatgggtgacacggtggtcaggccaggcttgtaggtcactgtgtctgacctgggctctgggaactcaacttctgggaacatctcatccagaagctggatttaagggctataaatatctccttaagtcctcactaggcacccgcaggtgctttactcccaaggaaatgtatataacccttgaggtgcttaagggttctattcagaagacaggaccacagatgcctggctgtttgaggccacggttgagccctccttcctttgtttattcagcaggtctttgtggacttagctttgttttcaaggaagggagtgccctgatgttagataatgatgtgctgcacagacccgcatgtgtgttagtaccagcatcacttttatctgtaaatctttgaggtccctgctggccgtgactcagtgacactgtgcctcctagttcagctagatgaggtggggacagaggggggggggcctgggtcctgttcttggggaacttttagtctggttgatgggctgggatttatatctggggaaccttgagagcagcccaggtctgtagaaggtcagagggatgggagatgatgaggttgcagtagcaaaggaagacttcttcaaggagctggcatgagtgttatctaagaaatagattagatagctgggcactgtgactcacacctataatccggcactgtgggaggccaaggcgggtggatcacctgaggtcaggagttcgagaccagcctggccaacttggcgaaaaaccatctctgctaaaaatacaaaaattagctgggcgtgatggcaggcacctgtaatcccagctactcaggaggctgaagcaggagaatcgcttgaacctgagaagtggaggttgcagtgagctgagatcgcgccactgcactccagcctgggcgacagag

SEQ ID NO: 80633 - DNA, 1046 bp, Homo sapiens
cccatttaagtgcaaggtagatggcacaatggctagaagagatgtttccacaaggccttttatttttccctttccatgcccatatctcgaaagagaaagtgtaaggtcggtttcccatgtcttgggcttggtgattgctgtgagtctgggagggtcaggggctgaagccattcttgacaaggacaagagcatttctaccaccctgaggctttggggcccttcaaaggggcttgctgggcagaagctctgggttctggaggctgtgctctccagatttctcaggagtgggtgctggggttgaggggtgggggttggttcgagctcccagcttgcgttcttacagtctttactcctctgcgtgtgtatgtgtgtctcctgtgtctctgtatgtatttgttggtacgggttgtgggtcttttgtgtgggtgtgaatctgtgaatgtgtctgcatctctctgtgcttgtctgcgctgttggcctggcttgattgtgggtctctgttgcgttactggtgtgtgtgtgcccatgtccgggtgctcatgtgtctctctatgggcctgggtgtctgtctctatgtgtgcatgtgctcctgggcctgcagtgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagtaagtggttggtgctatccgcagtgcctagccgtctctgcccatctcccctgtctcttctccatatcttttctcacttctttttttttttttttaccctcccccaaactcactttcccttgctcacctttggctcagattgctaggtagggcctgggctttctgggggtgccaagttgaggtgagagggctgagagttagtttctttcctcctcactctacccttgggtgggggaaatatagacagaccaggcctattttttcttctgtcatccccttcctcaggca

SEQ ID NO: 80634 - DNA, 1087 bp, Homo sapiens
gtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttgga

SEQ ID NO: 80635 - DNA, 1042 bp, Homo sapiens
acggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtct

SEQ ID NO: 80636 - DNA, 1032 bp, Homo sapiens
gcgcgggaggggaggttcggggagctgtgtccgcgagcgtgggtccacggctgtctgtgtgtgtccttattttcccctgtgtgcccatgaagctctgtttgcgactgtgcgtgggtaggcggccgtccatctgtgcgacctcactttcccggctgtacgggtggggccgcctggagcaggagggacccccgagccctgagtggagggtttgcatctgtacccgtccagcccgactttgtgctgctctgcgattatttgtccagtgtcgtttaatctagtttaaatgatggccgtgtcagctcctcacactgaacgcttacccgggctgcccaaagtacaaagtgtatttaaaaagttggtaaaattaaaaaaggaaagccatgggatgttggaagtagccctaggcctgccaaaaagtgctgagtgctatttaaaaattaggccaaatcttgtcagaaaagaacttcctgctgtccttgaagtatttggaagcaggtgctagatggtgagcaggagaggttgccaagttggggaagtggtggttgtcctggagcaggggtttccacatctctcacagtggctgggaagtagcaattcgcagtcactgcctttctagtagcccacgtgtgtgagtgtgtgtgttagatacatttatccctcagtatccgcaggggattgctgtatactttttttttttgagacaaggtctcattctgtgacccaggctggagtgcagtggcaggaacatggctcactgcagcctcgacctcctgggctcaagggatcctcctgcctcagcctcctgtgtagctggaaccacaggcataaacaaccatacccggctaatttttattttatttcatttttgtagagacagggtctcaccatgttgcccaggctggtctcaaactcctggctcaagctatcctccttccttggcctctcaaaatgctgggattacaggtgtgagccaccacatcaccctcctgtatactcttttttcttttctttttttttttttgagtcagggtc

SEQ ID NO: 80637 - DNA, 1052 bp, Homo sapiens
atcctcccaccttgccctcttaaattgctgggattacaggtgtaagctggagcagaagcctgggcagccggtagtgaggggctttgatgttaggctaaaggattcaggctcataatggatcttggatccctgcctacccaccacccacttcccttgtttggttctgctttgtcttaggctcagttctcatccttcctgtattgagcttgaacgtataccctgtctggccttgctttccttgctctgtctttagtctggttctgtgccagctccacctttgcccatatagggactggcaggtatccctgaaacctaaaactctgccctgaattaaactcatcagaggagacttaaacatcacaagctgaggctctttgctctgtctgtccctgtctttctggaggatagagaagctgccatttttctggctgtggcttacctgcttggctagtgccctgggatcttgaggctcagtaatcaaagcgtgtagccctataacctgcccacttgccaactctttttgctgctcaggagttcctgtgaattcagcagagcccggggaagtcaggtactacagctacctgtgcaaataggtgactccaacaggttctggttacagtaatagacttactggtttggaatttgatcctctttgcaagcaaatgaaggaatcctgccagccatcacccttcctggaattctcaggttgaactgattggacctcgcctccaaatgttggttaaatgatccactttctattcttcaagtatattaagcacacacatacacacacacaccctcttttttaggaaggtaggtaggtttgatccttagcacagctttgctaagcaggctaagtactgtatttcggactatagtgcctgctgtggggaagcagttgaagtcactaatacagattcctgccccaagtttaactgactgctttctgtaacctgtttcctaggaatgagatcagcttgatgtggaggaggttcaggggcctcagagataaaatttggcttctggttttgcaggaatctacctatcctagc

SEQ ID NO: 80638 - DNA, 1053 bp, Homo sapiens
tccctgcatttgtttttcccccagtgccttcaggtttgaaataatcagcataccaaagccgcatattatggggtggcatttcctgaactccttcatccacacccttcaaacttgggaggagaagacagacatcgccctagcttttgccagggcaggtgtcagcagaattcagagccaaaaggggatttctaaagatagagaaaacccccaactcaaggagtcagcaggcctcgggctcagagaaggatacatttctagggtgtctgtcaggacatccaggtctgtcgagggtgaggaaaagaaggctctgctcatatgcagtgtggagtaaattctgactttctggaggaccacttgacaatattgagagaaattaaaacatcttcatagtccttgatttacccacaggattaaactctgtggggtgtatttacaaagtgaaaggatgtccattatagcattatttataatttcaaagcaaaactggaagcaaacaaaatatccagcagtagagagctgtggtgcccttatgatttatgggacaatctctcagtggattacttggcaatgattcagaaaaatggggtggctctctctgtgctgaagggagcaatcatcaagatggaagcggaataagcagggtgtaggagctagcaaactggacccccccccccaaggccaaattcggctctgcctgtttttgtatagcctacagctaagaatgatttttacattttaatttttattatttatttttgagacagggtcttgttctgttgctcaggctggagtgcagtggtgtgatcactgctcactgtagccttgacctcccaggctcaagcagtcctcccacctcagcctcccaaatagttgggactgcaggcgtgccatcacactctgctaatttttttgcattctttttgtagatacaggattttgctatgttgcccaggctggtctcaaactcctgggctcaagtgatctgtctgcctccacctcccaaagtgctgggattacaagcatgtgccactgtgcctggcctgatttttacat

SEQ ID NO: 80639 - DNA, 1128 bp, Homo sapiens
tgtttgtttgtgtaatctctttcttgctagaggactctcctcagatatctgatactccttggctgttcttatttgggtgccaaaagttgattggaaactctgtcttcactgccagggacttggtactcatctggtattgaaatgttttgttggtggacctctgaattccatatctgaaggtttccttccctaccacatctccctactgccagggttatttgttttttccagaaggaccctatcagtagtctcctgcctggttgaccttgcgttcttagggtcaagtaggggaagcaggcttgggtctctgtttggtctgtagatactcacttctgctccaggactcctttgacctctgttgtgctaactctgcaagggtagtatgtttggctgccttgggtgggaagaagacctggggggactttagctgttccttctacaggtcaggaagtcctcctgtattcagctatctgcctcatgctcacctttgtggtactcactgcctcaagtcctaggctcctgggctctaattggcttgtgtctcagttactgtgtaggctttggatattttcttttctcatctaatctaatcttatcttgtaggatctgctctgctagtgcttcctttcgcttccatcttctgaaagcgcattggcacgtcttaactgctgttggttcctcttctttttgttcttgagaatttacttcttttctttctttgtttttttttttttgagatggagtttcactcttgttgcccaggctggagtgcaatggtgcgatctcagctcactgcaacctccacctcccaggttcaagcgattctcctgcctcagcctcccgagtagctgggattacaggcatgcgccaccacacccggctaattttgtatttttagtagagatggggtttctccttgttggtcaggctgatctcgacctccccacctcaggtgatctgcccaccttagcctcccaaagtgggattacaggcgtgagacaccatgcccagccgttctcttctcttctattccttgacaaggtctcactttgtcacccaggctggagtgcagtggcatgatcttggctcactgcagcctcgacttcctgggctcaactgatcctccca

SEQ ID NO: 80640 - DNA, 1014 bp, Homo sapiens
ccttctccctaattgccaccccccacctcatttattgagctttcgcctaccacgtactgtactggggtctgttctgagagcctcacaggacacagggagctcccaggctggaaggagaatgccaggcttgatcacccatgccgttgggaagggagtatcctctggtgaggggtacagtcctgaatgaccccagtcagtcctttctatggagtcaccaccttgcatagtgctgggcctgtggtagacatccaataaatacttactgcatgtatgcggtaactagcagttttacttttgcgagtagctgggagtttttcagagtttcatgtggtgaagaaggtggatgatgaagctgggacaggatgttttttggggtcacagattagtgttcttgtatacttgtcaatgggctcttaaggcactcctcaaagaatctgccagtgatttaagcatcatttgaataagagcacagggtgagcagaagaacaacttgtgtggccaggagcaggggtagggagtgcagagaagagagagcctgggtgcaatgtcatcaagaaggctttccctatagtcccagctacttgggaggctgaggtgggagggtcgcttaagcccaggagttctaggctgcggtgccccttgattgtgcctgtgaatagccagaatagccagtgcgctccagcctgggcaacatagcaagaccctgtctctagttaaaaaaaaaaaaagggaaaaggctaggcatggtgcctcatgcctataaccccagcactttgggaggctgaggcaggaaaattgcttgagcccaggagtttgagaccagcctgagcaacatggtgaaactccatctctacaaaacatataaaaaaaattagccaggtgtggtggtgcatgcctgtggtccccagctactcaggaggctgaggtgggaggatcgcttgagtccaggaggtcaaggctgcagtgagctgtgattgtgccactgtactccagcctgggctacagaggtgagac

SEQ ID NO: 80641 - DNA, 1915 bp, Homo sapiens
ggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctgctccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaagtggggcctgtccgtgtgtttggggatggtcggtttcatgttccgtcactgtgtgcttagccctttgctcgcaggctgctctccctgctcccagtccagaaggtgcttctgcaccctcgtgcagatggctgtggctctgtggacccctctcacacacatacttgcttgctctgggaaagccctctctcctgagaccccgtgggtcctcgtggttgttggtctgtgggctactgcctggtgagaaatgctggtcattagacccagcacgtgcctctctcccagggccagacatgtctttcatggtctgggtagaactgttacagcctccccattgctggtgaccatgcatcccactgaccttagcttggagggtggggggtagtgtgctgggcccaccctctggagaccctgcccctgctgggctctgttcccccagaggcttgttctcagggcagctaaggtggcttcctgggcctgtcttcccactccccctgggccaggggccagtccactggggcttgttggacctgtgtggcatcctggtggtggtcactgagcccagctgcactgtccctcctgtgccagcctggccttaac

SEQ ID NO: 80642 - DNA, 1032 bp, Homo sapiens
ttcaaagcccacagtgagctcacaactcaagtggggctgcagtgatttggaccttctcagcctttctcatgacatggcagggctgctctccgctggcaaatatggtctcggtctccctcaacatcctcttcccccagacgcttagagtggagggccctgcccaagggatttgcatccctttgcatgtcatttacaagcctgctgcccttgctgcctctgccttccccactgcactcagacaatgcctgatgttcctgcccacatcctgcagctggaatcagggctcagggcaggccaaagggcatatgaggtcacacagcatagccagtggcagaatcagacgtgggcctcctccctgcctgtccagggctcttcctgcctctgtccccaggtgctcctgaacagggggtgggacgggcagagctaggcatctgggacagtgcctttgtggctgagaagggtcagagcagctggtgggtgatgggtgggccctgagagccacgtgcactcacctgaagaccaggacaccgatgccctggaagccggggaaggcctcgtggtagaggggctggagctgaggatgggcagaggcatggaaggccggcacgtgccaccccccaccttccctcctgccctaacccaccccctctctgaccctaccacctaccctcgtccaccctccatcatcttggcatggtccctgcaatggtccctcacggaccacctgggattcccaggccccgcccaagctgttcctcacacagtggccagagataacctgccagtcatcctctgctgaaagcctcaaggtctgtctgggcgtcgtggctcatgcctgtaatcccaacactttgggaggctgaggcgggaggatcgcttgagcccaggagttcaagaccagcctgggcagcatgacgaaatcccttctctaccaaaaataccaaaattagcccggcatggtagtgtgtgcctgtagtcccagctactcgggaagctgaggtgggaggatggtttgagcccaggaggcagagg

SEQ ID NO: 80643 - DNA, 1354 bp, Homo sapiens
gcactttggaaggcctaaggtgggcggatcacgtggtcaggagatcgagaccatcctggctaacactgtgaaaccccatctctactaaaagtacaaaaattagccgggcgtggtggtgggcgcctgtagtcccagctactcgggaggctgaggcaggagaatggtgtgaaccgggaggcggagcttgcagtgagccgagattgcgcccctgcactccagcctgggcgacagagcaagactcgtctcaaaaaaaaaaaaaaaaaaaaaaaaaaaaaaaaaaaattaaataaaaataatgtcctctacgctcctgtgagtaacttggctccgggggctccgctcgcctgcccccacgccgcccgccacccaggaccgcgccgccggcctctgccgcgaacaaacccttctgacggccctcgctgtgcaggccaggatgcctctcccccatccgcccccgctgcggaaagttaagtttgaagaggggggaagaggggaacatggacatgaagaggaggatccacctggagctgaggaactggaccccgtcagctgttcgagaacttgtcttggacaattgcaaatcaaatgatggaaaaattgagggcttaacagctgaatttgtgaacttagagttccttagtttaataaatgtaggcttgatctcagtttcaaatcttcccaagctgcctaaattgaaaaagcttgaactcagtgaaaatagaatctttggaggtctggacatgttagctgaaaagcttccaaatctcacacgtctaaacttaagtggaaataaactgaaagatatcagcaccttggaacctttgaaaaagttagaatgtctgaaaagcctggacctctttaactgtgaggttactaacatgaatgactactgagagtgtcttcaagctcctgccccagcttacctacatggatggctatgaccaagaggaccaggaggaacctgactcagatgctgaggtggatggtgtggatgaagagtaggagggcgaagaagaagacgaagaagacgaggaggatgaagatggtgaagaagaggagtttgatgaagaagatgaaaatgtagaaggagatgacgaagatgaagtcagtgaggaggaagaagaatttggacttgaagaagatgaagatgaggatgaggatgaaggaggaggaagaaggcaggaaaggtaaaaagaggaagagagaaacggatgatgaaggagaagatgattaagaccccagatgacctgcagaaacagaactgtttagtatcggttggactgctcatggatttggtagctgttaaaaaaaaaaaaaaaaaggtagctgatacaaaccccaggacacccaccca

SEQ ID NO: 80644 - DNA, 1050 bp, Homo sapiens
tccagcctggggaacaagagtgaaactgtctcaaaaaaaaaaaaaaaaggatagcaagccacacagagagtgcagcaggcatggaggcgggagcaaggctggtgtgccccagcagcagcagggaagctggagtggctggagttgtgtgggtatggggaagaggggagagagttcactcgtctctgtgaggcccaggactttgttttatcccatgctgtacccccagcacttagagtgggagctagcacagagaaggtgcttaattgatgtttgctgagcagatgaatgcctggagtagacctcagagcagggtttggtggcagggtgggtcagggagagagtttactcaacagcctggtgataggggagaacaagaggccagagggtatccatctatgtcggggaccaggggtccctggtgggcagcagtgtgggagacacacggatcctggccacacctcaggcctccctccagcctgattacctgcctccctcccttgcagaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccaggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcag

SEQ ID NO: 80645 - DNA, 1154 bp, Homo sapiens
tcttaatcccactccaggatgggaaacccatggccgagtgggaagaaaccagctgaggtcacatcaccagaggagggagagtgtggcccctgactcagtccatcagcttgtgtagctgaggtctgggccaggtctaaccaggctccccactcctcccaacctgagcctgccctctgatctctgcctgttcctctgtcccacagggggcaaaggctacgggtcagagagcggggaggaggactttgctgcctttcgagcctggctgcgctgctatggcatgccaggcatgagctccctgcaggaccggcatggccgtaccatctggttccaggttgggccctactgttcacacaggcagagaccccaggaggctgatgggtggaaacgtggggtcacaataactggggtggtgatgctcagggtctgtctagaccctccaaggaccacactgttcctgagggtcacacccctcccctcccatgcgtcccagggttgcagctagtggaagtagcccaaggcaggtagcccaagtgaaagtagccaagggcagagcagctttgctgatgtggactctaacatgggggatgtcctagaggcttcctaagggagaagctacactgatctggatgggtgtgtgtgagtcctgcctctccaaggaataccgcccctgtgccaacccaggctgattcctgaattatccccatcccattttagggggatcctggaccgttggcacccaaaggtaagctactcctaatgtaataggctaagagagcagaaaggacttcacgcctgcaagggctacagcacccttctccaccctatccccctgcaaccctgggagtcacccctgggcaggataggaccctccaactccaacaccagtgtcctgcagggcgcaagtcccgcaaaaagaaatccaaggccacacagctgagtcctgaggacagagtggaggtatggctgcctgctcccgcctcctcccctgcactctgcagccctggctgcccctcccaggcagctgccttaccctaagagggcggggggagtggtgggccctaaccaacctctgaactgctttctgagcccctcagggacccgtgtctcctccatccaggacgctttgcctccaagcaaggccccttccaggacac

SEQ ID NO: 80646 - DNA, 1032 bp, Homo sapiens
tcccaaaaattcagacccccagatgcagggcaagacaataagaaagggtgagtgcaagcaaggagagcctcctgctaagaggctgaggtcccctctggttccaaggatgggatgtcagccttgaccttccggggtctgcagtggcctgggggaagaacaggcaagatggtcagctaagactccaggggctgccatggcagcctttctcccacctttgtacacgcgctcctaggccaccatcccatcctctcctgtagagccagtttctgggagtgatgaggaaagcccaccagaggctgcctgtcgccccttcctcctccccttcttgggcactgtgggagcttctgggtcctgctggaggctggtcccctcaggccgctgggttgcagtcctcttaggaaggtctctctttgcccttcgtgtcctggaaggggccttgcttggaggcaaagcgtcctggatggaggagacacgggtccctgaggggctcagaaagcagttcagaggttggttagggcccaccactccccccgccctcttagggtaaggcagctgcctgggaggggcagccagggctgcagagtgcaggggaggaggcgggagcaggcagccatacctccactctgtcctcaggactcagctgtgtggccttggatttctttttgcgggacttgcgccctgcaggacactggtgttggagttggagggtcctatcctgcccaggggtgactcccagggttgcagggggatagggtggagaagggtgctgtagcccttgcaggcgtgaagtcctttctgctctcttagcctattacattaggagtagcttacctttgggtgccaacggtccaggatccccctaaaatgggatggggataattcaggaatcagcctgggttggcacaggggcggtattccttggagaggcaggactcacacacacccatccagatcagtgtagcttctcccttaggaagcctctaggacatcccccatgttagagtccacatcagcaaagctgctctgcccttg

SEQ ID NO: 80647 - DNA, 1598 bp, Homo sapiens
gaggctgaggcaggagaatcacttgaatcctggagggcggaggttgcagtgagccgagatcaagccactgcactccagcctgggtgacagactgagatcctgtgtgaaaaaaacaaagttttacatttaatttgatactcatgatcattcgatggggtgagtactattatttattcccgtttcacagataaggaaactgaggcttaggcaggttgggtggcatgcccagggccccgtacagtgggagctggagttcagttgtgtggttctagagcttgtgctcggcctagtgacaggagctctggagtctgggagcacaaagaggggcacagggccaccaagtgggtcttggatctgccctccaggtgtgggcccatcgctggatggatctgtcagaacacggctttgggctggccctgctcaacgactgcaagtatggcgcgtcagtgcgaggcagcatcctcagcctctcgctgtaagtggggtacccaccaggcctgggagctggcatggagaaatgggtcttcccgaccacaactccaacagcttcagcgtggcccctacgcgccctcctcaccccagcttgcgggcgcctaaagccccggacgctactgctgacacggggcgccacgagttcacctatgcactgatgccgcacaagggtgagtgctggggacggtggggccttcctgcagccctagacacctctctgcccttccctgagcccaaaccccagcaacctggcttcctgccccttctagggacaggggagggtagcccccattctccaccagcattgtttcctggtcgtaccccaggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcaaggggtgggacgtgctggggacggggttccgaactgggcctgccctcggcccctcccaccagacgtgttcctctgcaggcggagagcagcccccagcgccgctcgctggtcctgaggctgtatgaggcccacggcagccacgtggactgctggctgcacttgtcgctgccggttcaggaggccatcctgtgagtggcggtgtgggattggggcgggggtcgagtctcgccctcgcagagccttcatggcccctcctgttctccagctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaaccctgctgctcagtccccttagggcccatcctcacgcttggggtgggggtgggaagtctggggtgggatggcttcccaggtatttggtgggtaggggcaagatcctaaggtacctgtgcgtg

SEQ ID NO: 80648 - DNA, 1074 bp, Homo sapiens
tggaagcggatcgaagtgatggccctgcccaaaccgggcggggcccacagcctaggtacgagctgaggggaagggttgctactgcagcaggaaggatggaggccagacagatcaggcctgggataccccgagggatctgggtgcccctgactggagagtagtagcacatcttccaccaacccatccccacctgcgcaagcttcctgaaaggtcaggaaggctgcactgatgcccaggcctcacccccagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcaggtgccaaatcctcattgccctttcccagtgcctggcaagtagaccccaggccatttcctctctccccttgccacaacactgcccacagcagcccaccagtggctctgggctggaacccacacatggagcagggcaggctgggcagtagtcccctgtccactgggtctactcactccaccctaccccaccaagagcagctggagacagcgaggtcagttggttgtacagcaccaatcccatgtccttccagggaggccattgctgagggcgccgtggggaaccagtttgtgctatttgatgatgtccccttgtactgggatgcatgggacgtcatggactaccacctggagacacggtataggctgggcagcatgtggggatggtggaggtggtgggaacacaggctgctctggatcagtatgtccacccctgtcccataggaagcctgtgctgggcca

SEQ ID NO: 80649 - DNA, 1907 bp, Homo sapiens
cagcagctggaatgggtgaagagccgctaccctggcctgtactcccgcatccaggagtttgcgtgccgtgggcagtttgtgcctgtggggggcacctgggtggagatggtaagtgcactgggcactcctcagccttgaactgtatgacaacagccttccctcaggtagccccgccctcccggctttgctggtgagtttccacgggccactcatccccgctgtgtggcagggctggctcattagtccctgggatctcaaggcctgggacttcaagggggaggagagcctccagcgctgtgacaagttgcatggcctagtcctgggcaccccctcaggcagatggacagtcaggcctgaaggacaggggcccttcctgagttctggctgtaactcccatgtttgagcagccctggcttctcctgcagggattgggttggcctgagcgcctgcctgctccccgtccagcgctgacctgggctgcctcccacttccttcactgccaggatgggaacctgcccagtggagaggccatggtgaggcagtttttgcagggccagaacttctttctgcaggagtttgggaagatgtgctctgaggtaggctgagagctgctacaccaggctgtgggcgagtggggctggcgctcgacttggagtgctgaggggctgaggctggggtgagtccgcctggagctctggttcctgcactccaggatcctctttctccacagttctggctgccggacacctttggctactcagcacagctcccccagatcatgcacggctgtggcatcaggcgctttctcacccagaaattgagctggaatttggtgaactccttcccagtaagcaggcccccggggggtcagggtcagagtgggcctcagtcccgcctggcccatttgcctctcccccttattgtggggtcctagacagaccaccaaaccctcactctgcctctgccagggtcacatagcaggcaggggcaggaccaagtctggaaggcctggctctgcctcagccctgactctggcctctctgccctgcttctgtttccctgctggtagcaccatacatttttctgggagggcctggatggctcccgtgtactggtccacttcccacctggcgactcctatgggatgcagggcagcgtggaggaggtgaggggtcacctagggtggtggggtaggggcaggctggagagggctggcttgttccaggctgatccatgctggcctgccctcacctgtctaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccaggtcaggccaggccttggctctcctttagccccaccctgggcccttgccatgagccctgccttccctcagacattgggcccaacccctcctctggaccttgtcctgtcccaatcctagaccacgggttcctccaaacttccaccctgggggtgggtgggggagaagctgaagctggtaagggctccagcccatcagagagagaggctctcctagggcgtccagggctggccatctgtgaacggggagctttctggagtggctcctctctgtaggagctggatcctttgctttggtgtggaagaagggtgagccatgtggtctccaaggctgggagacctaggcttgtggtctcctcagggtgcagctatcttctccaagacagctcttctcagcactggagagtgactcagagcagctgtgcacgtgggttggggagctcttcttggagctgcacaatggcacatacaccacccatgcccaggtcagggggaggttgcagggc

SEQ ID NO: 80650 - DNA, 1007 bp, Homo sapiens
ccaatgaatggcccgcccatgttggccgtgttggttttagatcttgggtctaaaagtttgagcctgggagatccgaacatgattttaatatgcaaagagggttccaagaccaaggcagtgctttgcaaagacaactttggaaatataagactaaacagcagcgtactttacatggttccaaactttgctacttattctctctgacagcaagacatgggatccatctggtgtttgtaccacaaccctcccacatgcactcttgtcacactgtgggatcctctgggtagtggatcctggaagcagacaggttgggctcagctggatgcctcctgggtgccccttccccaagtccccggagtactgtgccagtcccttagcctgaggctgtctccccatctttgtagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaaggtacttgacaccccctgtaccccctgctaccctctagagccctgctccaagaaggttgttctttgggtcagataaatgggactctgggaatccagagtaggacgagggtttccacctgcttgagggttgagagaattttcctatgtgaaggggaggagggagacggtgctgagcagggggaccagcagggaaaaagggttgggggtcaggggagctctgctgagagccctgagatcagtggagcctaggtctggaagctgtgcttgaaaaagggattaaggggcagaaccctgctgcagggcctcgggaaggacaaccagcgcagcttccaggccctgtacacagccaatcagatggtgaacgtgtgtgaccctgcccagcccgagaccttcccagtggcccaggccctggcctccaggttcttt

SEQ ID NO: 80651 - DNA, 1898 bp, Homo sapiens
tatactaacgcatgctaaaattgagaacagcgagctttttcagcccagagcctgtgttcgcatttctttggaggctttatggattttcatgccctcacatgttctatgttcttacctctttaacttctctttaaacagagaatccttttttttttcttttaagaaaaaaacagtggtatctaagacttgagcccacatctttcctttgctcctttagaagaaaattaggctttgtatttgaagggctcttttttggttctgcttcatttaataaaattttttttttctgttttgcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtgggcctatgcactcacacactgaagaaacaaggaagatgcctttcaagcctcactgggcctctctgggacatggccacctgacctgtgtgtggctggtgcagcctggcaccaagtgggctacctgttaggaacatgaataccttacaaagctgaagctggaacttttcccaaagggttttgggtatagcctgccctggaggggaaggaagtccatgcaagcaaagacatgcagtttgcttgcacacaccagcagagctaagactggagtctcctgtggcctaactttcaatgagggaaccggatgctgttcacactttgactggatggagatgcatttacaaaacagactggagaaggacttaatactcagatggattggaactatcatggtcactgctcctctcccctccccacaaaaggaaaaaaaagctggatttgattttttttttctggtcactcgagcacatctaagatcacccattaggttttatctgggacctgcagtttggctttgggattgatcatcttgtggattttattcctgacgattcccttgctgcctacccttttctctcctctggttctcaacctcaacgagttcaaatcagttgtcctttttagctcccgtggaactgttttgtatctgcctctttactagtctaccttagtgccatccaccagctttactctctgacacacacacgcacacacacacacaattttaacttgtttttttgtacataatgtacatactgtcaattttttattaaaagaaatatgctttgatgtgctagcataactgctctagcttcttgtgtaccatagtactgtggcttcagatttagtacctatgaacagatgtacaagacatttattacactttttaccaaagggagttaccattgtagtacttttgtgtaaaacttgtcttcccctttgcccccaacttttttttttttttttttgtaaataaataaagcttggttcttacttaaggaataaactctcaacccacgtcccttgtcctcaccagaaaatactgtgaagcagggattttgacttcagttccttatccagggtagaaacaggattttgcttaaaatacttgttacttgtcccaaatcaaaatattccaaaatcttagaatacttaagtcttttagtacgtgtttttttcccttgttcaaataatctgaaaatattttatatttgggtaagttgtcaagctatgtagtttgtatttctatatattttttcttattcacattggtgatggatgggggtgagcaacttaaataccaaaccagtgtttgaaaaaaaa

SEQ ID NO: 80652 - DNA, 1112 bp, Homo sapiens
ggggtacatttttctgcagcagttaaagagaataagacaaatctatcatgaaatgaaaaaatattcatgacagtaagtgaaaagttgaggacaaaatatatagtatgatcctattttgtcttaaaaacaaatcccaaagcagaactgtagctggtaattacatgtgtaaatttacagacagaggcctagaagtttctcattaaaactcttaactggctacatctgctaagtcaagtaggggatgggtgaagatttctgctttttattctgtgtacctttgcagttgaaattttttttgcagtgaaacaactgaacatttgtgtatgtatttaacaaattgggatgagtactatgcaagcatataataaagaaaactcactttggggaagtcacgggaatctgcatctggacgagctctcatcctccggggcttttctgcaataggaatctacggcggatccggaagtgtcaacgtggtcgagagcagcaggaaaaggaagggaaggaaggaaacagcaagaagaccatggagaatgtggatagtctggataagctggagtgtagattcaagctgaattcctacaagatggtgtatgtgatcaaatcagaggactatatgtatcggaggaccgccctgctccgggctcatcaggtgagaaccagtaactgaaatttctgtacacatctcccaccctagctaggaccaggggaggcccagagtcttctgattgtttttctttgtttatgcaaacctgttcttggagctgagacttaactgaggaagtacgtatgttggttgctaaggatgctgtgacaaagtaccacagactgtggcttaaatgacaaaagttgtggagactagaagtccaaagtcaagtgtcagcagtgttggttccttttgaggactgtgagggacaatctcttctaggcctctcctagcttctggttctttgctggcaatctttggcattcctgggcttgtagatccctgccttcatcttcatatggtgttcctacctgtgtgtgtgtgtctgcctccagatgaggtcacattcggaagtactgggggctaggacttcaatgtatgattttttgtttgtttgtttgagaca

SEQ ID NO: 80653 - DNA, 1032 bp, Homo sapiens
gccactataaattttgttctttaacaaaatgctctgtggggaaatgaaacttgtcagtgagccagcttctacctgtttatgacttctcataaccttagcacctcagaaacttagcagtattgctggctaacagaatttttaatccgtgttccaatacctactaacaatcatgtctttatagaaagggacttttttgatcttgaaatttatgaattcggggcattgtaatcatagaatttactagagtgcccaatgcattaggagctgtttttgtgatttccttccacctgtattttgtgtttgccatcttagcgctggtcagactacgtggagcgatacatgaattcagatactacctcgcctgagcttcgtgaacatctagcacagaaaccagtatttctccccaggtgagtgagccatgtcatctgtcagcagtccatactgtgcatgattgaggaatggagagttaaatgactttcacgttcttggccttcacatattttattcatttgttctatctgctggggatgctaattcaaggttttatatggctgtcacaacatgagcttacctggagcatgtgtcaaagcatctgggaggtgagagttgtagagaatcaacaataacctccgtactttggatgggaatgtgtgtcagagtctccatggttcgatggaagaggactcacaggactctgcatatagtcagactgatttagtacagcgagaagatgcaaagcagaatcagcaaagcgaaaaggtgcctgtggcaaagctggaggaagccaggctcaagcttcctagaatcctctcccagtggagtcacacaggacactcttaattcttccaacaatgaatgtgacaacacatgcaaaatgctgtctaccagggcagctcattagagactctgtgccaggatttttattgagatgtagtcatctaggcactgtatgcctagcatgtaccaaaatcccaaactctcagaaagaaagcacattttcagcataagctatagagtttgtacaaatagttt

SEQ ID NO: 80654 - DNA, 1034 bp, Homo sapiens
gaaataaaaaattctcaggtttccttccaggctctgaccttctccatgtgattctgatagttacctcctctattacgtcctagaagtgggattaccaatggacagagcattgacattttgtggttctggctacatgtgccatatttctttctgacaaaatatttgttttgtaaaacattcttactgacattgattattattttagcgaattctagaagtttgaaacatgaaatagtaccttttgctttaatatatttcattttacttgtagtaagtgtagacttttgcctttatcactggccacccaagatctagtatcttcctcatctcttcagttggagcaaagtttactaagtttattgcctctgcacctctcattccttgagaagatagattacagctacagagacggtcttttgtttacgcttaggtttcttatttgcagcttatgtttattcagagccaaggccaggtccagctgactattgagcttctggacacagaagaggagaattcggatgaccctgtggaagcagaggtatgagcaagtacatcacagaccccaggtgccaagcagagctggcgtgccttgagagtctgtccagtgaccctgtctgccaaaaggccaaggcacctcaggcctgtttaagggtcaggacctggatgcttaaagtacaagtcaatccagccatgtcttcagctgaagagacgggctgcctggttatagatgttaacctcatcttgcacttagtaaagctatctcctctaaggaagtcttatggttggcagctttcctgttttttcctaaagtataaaaaacaacaaatgaggtctttctcatgtcatcttgattctttgtgtcatgtttactttttattggactgataaagtccagagttttcaacccctgaatagacaggtgtgattatcatagttggttatggcagataatgtacacaggagatgcaggccatatgtatgatgttggggggggtcgtgtgggatgacttgttttggtgggaatgttggcttgt

SEQ ID NO: 80655 - DNA, 1070 bp, Homo sapiens
gatgtgtttggaaaagtattgggctaggagtcaggaaccttgacttttagtcccaaccctccttcttcagctgagcacccctgggcaataattcagcagctatttcttaaatacttaatgagtttcaggctttgtagttggcctgggaatatagacatagatactgcattcatgattctccaaggctcccttcctcaccccagctcacggtgagctttgcagtggtgcagtctcggctcactgcaacctccatctcccaggttcaagcgattctcctgccccagcctcccaagtagctgggattacaggctcctgccaccacgcccggctatttgtgtatttttagtagagatggggtttcgccatgttagccaggctggttttgaacacctgacctcaggtgattggcccacctcggcctcccaaagtgctgggattacaggcgtgagccacctttctgatgcattgtgtaaatttgtctcctaactggccccaactctctgtctagcttgccttcccagggcagttgtgaagatcaaatgagaaagaatatgtatgagagccaattgtaaatgattttaaaatgcaataaagatatgacctatagaaaattatttaaagatgcttagaattttaaatagtacgattatcctgagttctctatggttcttattttaaatagataggaaagttttaccatggaccactgatatggttgaaaatcctggcttgattattctccaagaaaatgatacagtggtttgtgtgattaattttctaaaattgccagcacccccccacccccccaaaaaaagaaaaacctttttggagttgaatgactacatcaaaggaacgttgactgtataatggagaaatgttttctgtgttcactaaaagcttgcctttgtttgcttccagctgcagcatatcgtgagtgatgagatctgtgtgcaggtgactgacctttacctggcagaaaataataatggggccaccggaggccagctgaacacacagaactcaaggagcctcctggagtcaacgtatcagcggaaagctgagcagctaat

SEQ ID NO: 80656 - DNA, 1239 bp, Homo sapiens
tggtggctcatgcctctaataccagcactttgggagtccaaggcgggcagatatattgagtccaggagttggagaccagcctgggcaacatggggaaacactatttgtattaaaaatacaaaaaattagctgggcatggtggcacatgcctgtagtcccagctactcaggaggctaaggtgggaggatcatctgaacccaggaagttgaggctgcagtgagccgtgattgcaccactgcattccagccaagtgaagccattacatttatcttacctattgtaggctggcttaagagggatttgtattaagaatacaataggcaacctcacagacatccaagtacagaactcaaaataggaccacaccatggaaggattgggctgggaggtgatttttctctcctgcatgccttcactctggacttctgctccatgcttgtgctttgctctgcagatgaacatacggcatgtgctccaggctcctccagcctctgaggctttggcttgccctcccagtacccctggtcccagtgttactagacctttccatacagatgctcctcctcaaaaaatctattgaacaccctctctgtcatctccaattagcaagatagagaatctgatctgcttagcagtgggggtgggagttccgtagctgtctctggatttgtagtgctgtcttttctgaagactcgaggaggggccagatatccaaaaagagagtatgggtggggaatcagtaatacagtctacttcaacaagaaagtataaagtagaggcggtggctcacgcctgtaatcccagcagtttgggaggccaaggcgggtggatcacttgagctcagaagtttgagatcagactgggcaacatggcaaaaccccgtctcttctgaaaatacaaaaaagttagctgggcgtggtggcacatgcctgtagacccagctacttaagaggctgaggtatgggagggttgcttgagcccaggaagttgaggctgcactgagccaagatcacgatgccactgcactccagcctgggcgacagagcgagactctgtctcaaaaagaaagtagaaagtggaagcatctgtatgtatgattgaagtcatgctttccatctgtttttttccaccttttcttttttctcctaaaacactgtatcttaatcttcctcatgatatcaggtactcataagcattattttaatggttgtatcagaatcctttatctggactcattgt

SEQ ID NO: 80657 - DNA, 1049 bp, Homo sapiens
acagatgatttaatgcaatttgtgaaatacaacgtagcgaatccatttttaaacaaaaggactttgacaaatgcagattacttcattattcataaaggatttaatttgcactcctatttttgtgttcccaagaggtttcccagtgctggagtatggctgtgtctgcctttcctcatctgtactttatgcttcattgaaatagctttatgagcaagtgacccatgtgaggaatgctcttgtgcaggctgggagagtaggttcctctctcagcaggggagccaacagctctttgaaggactggcttccctaggatattttcctctctgaaagtggcccagcagtaccataaagaagtatctttctagcatggtagtcagaatattagaagccactgttaaagttgcagagtcactctgatagtgctggtgattgtagtcacctgtcggaattcatctctgtttacattggaatgagtgagtatattttgaatacctagtgttcatactttcaaatgccatttaggccagctgtgggatttgccctgtactctatccctagtcttttcttagcaaggtaaggcctcaccaatcccatctctcccacagtggatgttgatgtagaagattattacccagctttcctggacatggtgcggagcctgctggatggcaacatagactcatcacagtatgaagattcactgagagagatgttcaccattcatgcctacattgcctttaccatggacaaactgatccagagcattgtcagacaggtgagggcatggaggaggctagggtgagtaagggaagaaatccttacctagagatgggccacgcaaggaaaaggaaaggcaactttttcatataacagtgtttatgaacgtagggttctgaagagaggaggggaggttaatgtgatgcctgatttctcatgttaacaaagttgcagtgtatgagcctgcctaccccatatcctttcttgctggccacctgtagagtgcagtggtcctgaccccagcttcctgcacaacttgtctatctcttacc

SEQ ID NO: 80658 - DNA, 1071 bp, Homo sapiens
agttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaagaacctagtgagtgccgagacctctgatttacagaggatgtgtgaggttgaggaccttagagccacctagacttgggactgcttcttttattaatagagcacaggcattagagtctgtgtagttaaactctctgaacctgtttatctgaaaaatggaggctctagttgcttgtggtgttgctttgtgcaaagtatcctatgcagggcttagatcatggacacttggtcagtggttggtactgtggacgcacctgggaagggggtatcacagttaatttctcaaatggcagatttctgggttactgccatctgtttcaaagtacagatagagactaaactgtcacagccaatttcaatccatgacagaacataaattcctagtgcttaaaacagaattttctcatatttttgagcaggacttctgtttaaccagtggggtttatggctcattcttaatatgtagaaatagtttatggaaaggagactggaactcaaaaggtgatatgagacatggagaacaggcaggacagggataaagatgtagaactcaggaaaaggaaagtaagtgagggttcaggacgctgtcatgtgctttatgtaattttgtgctgcctgcttccagttcacgtcataaattaggtacttgagctgtgagccaaaagctttttcatgaagcatttcttctgggctcttaaggaaatagccaacctgaggagtgtatcttcttcttctttttttttttttttatgtgttgctgatgtaggaagcccagatatggccctagctttctatctgttgaggagctaatgacactgaaaaa

SEQ ID NO: 80659 - DNA, 1248 bp, Homo sapiens
gtggaacaaggctattgaatatttaagtatttgaatatatttaaatatttcaagttaaaccaaaaaactctcaagacaaagcggtcttttgggattgttttgattgttattgtttgttcataatggatcttagcaattcaggaaagttcagggaaacgtttcagtaaagtcatctcctgtttggttcctctggtctaaaatcagtagtcctaagcaaagcacacggtggtggtggcggcagcagcgacggtggtggtaataactaccatttatccaacttcatcctgtggttcttatgtgccaggtattgtgctaaatactttatgtggattgtatcatttaatccagacacagggttgtgagagtaataggtgctgttatccctattttgctgataaagaaacagtcttatgtagctagtagggcagaaccaggattcaaatccaaggagtttgactccctaccttattcttctaaacactactctattctattttgatttgggtcctgagcatacccttctttgtcttcctcttcagcttgatgtagttttagagaccaatctggcaacaatccgggttctggaagcaatacagaagaagctttcccgcttgtctgctgaagaacaagccaaatttcgcttggacaacacccttgggggcacatcagaagtcatccatagaaaagcactccagaggatatatgctgataaagcagctgacatcattgatggtctgagaaagaatccctccattgctgttccaattgtccttaaaaggtacatgagcaaatgtgcccttagtgctttagtgtacttcactaccggttcagtgtctcattaaataaggctctcattttcaacctggttgtcccatgagacctctctttctccccaaccctggttgttggaattcaggtgcagaatggaacttcttttgggggtcctgtgtaaccaacattagagaacaaatcttgtaagttcatggtggaaggctctgtgtgtatgtttgggggagtattttaaaatacagaaaagaaaagaagataattaccacccatgttcctgccacactcaggactaactgttgttaacatctttgtggtttgtttgtttttgttttgttttgttttgagacaagatctcactctttcacccaggctggagtgcagtagtgtgaacacagctcactgcagcctcaacttcccaggctcaggtgatcctcccacctcagcctcccgaatagctgg

SEQ ID NO: 80660 - DNA, 1785 bp, Homo sapiens
tgttttaccatgttggccaggctggtccagaactcctgacctcaggtaatccacctgcctcggcctcccaaagtgctgggattacaggcatgagccactacaccgagtctggaatctttactatatttgacaacctaagaattatgtgaacattaaagcaatattcttgatcaaaagaatggcttgttattttgcctggtttcggtacaactctttgatcaccactttaactgatctgagagtattttattagaaaaaggggaaaccaaatgctcagaagcagttcttcttaggcaggaaataattcatccctggtagcagatttctgatccaaaaccagatggtagtagtcatacctcaggataactgcatcctgcccctaattgcttgtcactttttggtttgattcttcaggaaattccctgagttgtttaattggtttaaaaactttctgggctataaggagtctgtacatctggaaacttatccaaaggagcgagccacagagggcattgctatggagatagattatgcttcttgtaaacgattgggctccagctatcgagccttaccaaagagttaccagcagcccaagtgtacaggacggactcctctctgtaaagaggtaaggccttccctagcaaagatcagccctgggtcctcagctttttccagaagggagtggtggtaccaaggattgagaatttatatgaatgatgaaattaagaacccttttaatcctttttaaaaagaaaatgttttctacttttttgtttgtttttgagacagggtttcgttttgtcacccaggctgtagtgcagtgatgtgatcacggctcatagtgcctcaacctcctgggctcaaatgatcctcccaagtacctgggacttacacatgccttcacacccagctaaaaatataaaaataaaagtttttagttttgtaaagattgggtcactcctcctgggctcaggtgatcttcctgcttcgtcctcccaaagcactggaattatatttccgcttatattcagcacccttttcttactaatagctttttgtaaacttgctaaaggtgaaatttgtgaagtaatattagttgcctatttctctgctagagttttgtcttttcattcagaatgcttaatcaccagaaagcttttttaggcttttgtttcagtctctcttcttctacccaaaggttttaaatgatacctgggtttccttcccttcgtggtctgaggactctacctttgtgagttccaagaagactcaatatgaagaacatatttatcgttgtgaagatgaacgctttgaggtacaagcttgtttggcatttgaagttgggggaaatgggagatgctcagtgagactatcagtacctgtctctgagggttattaagatggaagagccaaaggctcacattcttctatggtaagtgcttgttgtggtactttccatgctttatgcattggtcaaatgtatatattagtacatgctttatggcaaatgtgacttatctaggccactttagcccttttaactgaaattgtccattgatgactaaataatagttcttttgattttgcatggcattttaagattattatgttttgcatggtgaagaaaatcagtatcctaaggtttatagtactttcttgaagctgtttttaaattatttaagatctgtgtgtattgttacccttagcaagtatcttgccatggttagcaaaccagctctgagaactggcatttttctttcatgtttctggtattgattgctttgt

SEQ ID NO: 80661 - DNA, 1033 bp, Homo sapiens
ccacccaagtagctggaattacaggcgtgtgccaccatgcctggctaatttttgtatttttagtagagacggggtttcagcatgttggccagtctgggctcgaagtcctggcctccagtgatccacccaccttggcctcccaaagtgctgggattataggcatgagccaccacgcccagccacaaatttccccagtttttaaaaactaatggcagggcagctgggcaatatatgacctcgtctctgcaaaaaatttagaaattagccaggcatggtggctcacacctgtagtcccagctacttgggaggctgaggatgggaggctgcagtgagctgagattacacaactgcgcctcctcctgggcgacagagcgaggcccttttcagttccccactttaagaaaaacaaaaactgtttttcttcccgttgtctccataaggtccgaaaggctcttcggagtgcagaagcctacgaaaatttcctacgctgtcttgttatttttaaccaggaggtgatctctcgtgctgagcttgtgcaactagtctctcctttcctggggtaagtgaagtgaggggcttagccctgatgcatgatatggagaccaggtaatgtttgatttgtgagagtatatgataggcaaagttaatttacttgagatacatcagttgactcaaatgttagtgccagaagagtcctgagaagtcttctagtccagctctagagatgagaaaatagagagggcattaagtatttatcgactaatggccaagactagtggtctcctgatcttctaaccagtgctggatgtttatcaagaaaaatctctcccagagttctggaatttttttaaaaattattattattattttttttttgagatgaagtctcactcttgttccccaggctggagtgtgatggcatgatcttggctcactgcaacctccgcctcctgggttcaggtgattctcctgcctcggccccccaagtagctgggattacaggtgcctgtcaccacacgcccggctaattttt

SEQ ID NO: 80662 - DNA, 1081 bp, Homo sapiens
ttgcagcttgttggttgtggtggtacaacttctaacctgagatactagctgtcgaatcacaagttttaccgtttttgttttgtgaaatttgcttatgtttcctatcttggcatcagtgcctgatccagagaagaatatactcaaatgtttgtggactgtatgaatgcatgtcggtcaaatgttatcaggattgtggggccattttaatacaaaataaaccttaaaattcattttttggctgcttccttttgaactctctattgagcacatatatgattggctacaggttagtacagtaaattggcccagtaatatatcttacagttcaatctttttaaattcttaaaaatttttttttttagtttttagtttcagagatgggagtctcactgtgttccccaggctggtctcaaactgctggcctcaagtgattctcccatcttggccttcgaaagtgttgggattacaggtgcgagccactatgcccagctcatgcctgtaatgttcttattacctttatctttttattcctgtttatgaatagctgaattgactcacatcatcaagtccattcttagtaaaacacatgctcctttttggggggaatctttataaagttcagggaaaactgtaactgtgaatgaattatcagtgttttcatattttctgctgagtatgtgtggtacgttttcagtgctttgaaattcatgaggcatccctggagaagtgaagcttgtgttcccagctaaccttgtatctctgaccacttgaatgttacttttcaaaatatgtgattgttgcagcaagtgttcaggtttcaatttttctaattttacgtttatataaaattaagttcaggaaataataaatggaggaactctgaagagatgttaaatcttcatttggttattgcaacctacttatgttgcttgcaggcacgaatgagaaataaaccctctaaggacatatccatatgcagcaaatagttgtttcttctgttttccctgatacttactttagttcttcttgatccctgccctcgttggtgtggattcttgggaacttgtttaatattggccta

SEQ ID NO: 80663 - DNA, 1014 bp, Homo sapiens
tcgggaggctgaggcaggagaatggcgtgaacccgggaggtggatcttgcagtgagccgagatggcaccactgcactcagcctgggcaacagagtgagactccgtctcaaaaaaaaaaagaagaagcacttgaatatttttgcagcatgtagatatgtaattaatattaggagtgatagcatttgaggagaaaactagagaataaagggaaacaaggttgtgtttatatttttaaattggagcgtatttttcaacttcataataccaaattaattaaaattatgttatttaaatatttgtctttttcagttataacttgttcactgtgttggggggtggtatgcccacatgcacttaaacttcatcactaagatgaaatagatgatcagttctgggagtcaagcttttactaaacttgggtgactggtcctaagtggcgtacatcatactggagtgagaattgacttgcatgctattgcttttggtttctgcaggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtaagctggagccaaccaagggactagaatgagggaagagaaatagtggttttaggcaattataaaactttttttaatactgtgttagatattaaaaattgttgagtatgtgtaaggtaaaaaaaaaaataactgtgtactcaccatacaagtttttaaaaaaagaatgttgtcatgacctttgaagttccctgcgtatcccactctgctcccttcttttccctcccttcagaggtagccactgatctaaactttgtatttatcattcccttgactttatttacttaaaaaaactaac

SEQ ID NO: 80664 - DNA, 1071 bp, Homo sapiens
aggtgggtcctaccttctctgctaaggaagttgcaaaagcaatagcattttagtttagcaaatgatggctgtaatagaattggtggggagacaaaaaatccaggtggttttttctgatgccataaactgagagagatagtggagaacgattgaccattgaggaaaatttgggctacatatatagttcccatgatttgcagtgctgtatactggggaacacagaagagtctataaggattcaagtaagaacctggttttgctgtattaggaacattttcataaatgcttcataatctccagataattattttatatactataattttgttcagagataaatagcttagaaagattggcacttcgtaattaagagggttttaataatttacatacagagaaagactttttttcttttttaaggaaggaggtgtgtagtaatttgacaagattcctggtgaagtataattctttttacatcttcagtgggagcagacaagacactggagagctgtgcatggcagatgttagtacctgggaattttaactggaattaagaggttatatccctggcattcagtagtttagcatagtgcttttcatggctttctctcttttctgggcaatccaccagccaagagtttgttaagctttactttctgtaggcctttaaaaaaataaatagtatatgctttttcaaaatacaccttcctcgccccttgaaaaataaaagctgatatttattgagcacttactgtgtcacagatactgtgttaggcactagacttttttttttttttgagatggagtcctgctctgtctcccaggctggagtgcagtggtgcaatctcagctcactgcaacttccgcctcccgggttctagcgattgtcctgcctcagcctccacgaagaagaagctggggcgccaccacacgcctggctaagttttgtacttttggtagaggcagggtttcaccatgttgatcaggttggtcgcagactcctgacctcgtgatccgcccgcctcagcctcccaaagtactgggattacaggcatgatccactgcacccgg

SEQ ID NO: 80665 - DNA, 1041 bp, Homo sapiens
tacttttcacccagtgattcaattgactgagctactgcctattttccagtctccagactccagttggggtgacccactgcccttccaaaatcagtagttcttcccacctaccctgtctcctcagtggtaagcttcccccacctggatcctatgtgaggtccttagagtctatctttttttcttttttctttttcttttttttttttttgagacggagtctgtctctgacgcccaggctggagtgcagtggcgtgatcttggctcactgcaagctccgcctcccaagttcacgctattctcctgcctcagcctcccaagtagctgggactacaggcgcccaccaccacgcctggctaattttttgtattttttagtagagacagggtttcactgtgttagccaggatggtcttgatctcctaaccttgtgatccgcccaccttggcctcccaaagtgctgggattacaggtgtgagccaccacgtccagccgagtctatctttctattccaatttccaaccccatttcacagggaaactgaggctcagagggaggaagagacttgcctaagactataacaccagttgctgaccatgctaagtgcagaactcagattacctaactagtagcctcaagctctatcaactcttcacacagcaggccacaggctacttctttccctctactacccacactgaatcactcacctactccccttgagtctttctcaaatacaggctctccttcaatattcttctcaccggctgggcgcggtggctcacgcctataatctcagcactttgggaggcagaggcgggtggatcacaaggtcaggagttggagaccaacctggccaacatagtgaaaccccatctgtactaaaaatacaaaaattagccgggtgtggtggcacacgcctgtagcctgtagtcccagctactcgggaggctgaggcgggagaatcgcttgaacctgggaggcggaggttgcagtcagccgagaccatgctattgcactccagcctgggtgagagagtgagact

SEQ ID NO: 80666 - DNA, 1086 bp, Homo sapiens
acacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgct

SEQ ID NO: 80667 - DNA, 1043 bp, Homo sapiens
agctgagatggcaccactgcactccagcctggatgacaaagtgagactctgtctcaaaaaagaaaaaaaaaaaaaaaaaaggcctaggccaggcgcagtgactcatgcctgtaattccagcactttaggaggccaaggtggcggatcacctgaggtcaggagttcgagactagcctggccaacacggtgaaaccccatctctactaaaaatacaaaaattagccaggcatggtggtgggcacctgtaatcccagctacttgggaggctgaggcagaatagcttcaacctgggaggcggaggttgcagtgagctgagatcgcaccacttaaggttgcagtgagctgagatcgcaccacttaactccagcctgcacaatagagtgagactcttgtctcaaaaaaaaaaggcctaaatctaccttgccaccctccagtggccccaaagtattccaaggtagaacttctcccactacctcctctccaaataagtggtggttataacagtgctaaggaagggaatttaacattcacattcatttttttccttcctcatctgaaataggttattccttaaatttgccagatttgtagaccaaaatttcaaaaatattcctttcattaaaatcttccggccaggcgcggtggctcacgcctgtaatcccagcactttgggaggccgaggcaggcggatcacgaggtcaggagatcgagcccatcctggctaacacggtgaaaccccttctctactaaaaatacaaaaaattagccgggcgaggtggcgggcgcctgaagtcccagctactcgggaggctgaggcaggagaatggcgtgaaccccggtgggggcagagcctgtagtgagctgagattgcgccactgcactccagcctgggcgacagtgagactccgtctcaaaaataaaataaaataaaataaaataaaataaaaataaaataaaatcttcctggccaggcgcagtggcccacgcttgtaatcccagcactttgggaggctgaggcaacagatcacgaggtcaggagttca

SEQ ID NO: 80668 - DNA, 1049 bp, Homo sapiens
atatattaactagcttgacttagtgtctctgcaatccatacatattttaaaatattatattgtataccataaatatatacaatttctatcaattaaaatttaaaaacaactaaatgtcagaaaacagaatggaaaaatagccccataggtggaaattccatgagagtgttaagtccccaaagctaagtaaataatttttttttttttgctttcggcccgcaaagtaaataatgtcaaaaaaactaaaaactaaaatcaaaataaaataaaaaaaaagcctaaatactccatttactataaaaataaagcctccgctaatgtttcagtaaggagagggactacaaatcagacaatgatcttcatattaaccacaggatgattagaagaatctcccagtacactaagattcactcattcacaaatatgtcctgagtgtctgatatgtggcaggcactgttctaggtactggagacagggaagtcaacaaaatggataaatacaggtatctctgactccagagccccaactcaaccactgtactccactccttcagggcatatacgatgatgatctcagcagtactgatgaatttaccctccagccagccagtctcttagctcaaatgctcctgcaggaaaatcttctccaagggtcctggataggactgtgaattcagtttatgtgcttgaaacaacagggacaagagagttggaaaccatgatcctggggtcccaacccacatgtcatatatgcccaaatacaaggcagtaagttttccaaaaattattccccagaaagagaagggatataacaagtccttataatgtgtgtcatgttaaagaggtactatttaaattactttactgtgtgtcatgttaaagaggcactatttaaattactttactttgccggcgcagtggctcatgcctgtaatcccagcactttgggaggctgaggcaggcggatcaccccaggtcaggagttcaagaccagcctgaccaaaatgatgaaaccccgtatctactaaaaatacaaaaattagccgggca

SEQ ID NO: 80669 - DNA, 1039 bp, Homo sapiens
cagccttctgagtagttgggattacaggtgtctgccaccgtgcctggctaattttgtatttttagtagtgatgggttttaccatgttggccaggctggtcttgaactcccaacctctggtgatccacccacctcggcctcccataatgctgggattataggcatgagccaccgcacctggtcgagaaatgtttaatgttcagtttattcatgatctcatttttccttcaagttttaataacataacttttttaagaggcatatatgtatgctgatgtgtggtatgtgtaggatatctgttgagatgagaagtcagaatagtttttgatccataaagcttacggtagacaagaacttaacattgttatttttaaaggtaaatcagcttctaatttcttcagtttgtttaaccacttttcctctagctgctgagatcaaacctgaattaggctgtagactccccctgctgggtaagaatggggagaagagcagaaaacctaaacttgggcttgaagagtcacaggttccattacacttaaatcctcatgtgttttctccacagggagcatttccagctcgtttgaagaaggtgctgattgtgggggcacccatatggttccgagtgccctattccatcatcagtctcctcctgaaggacaaagtccgggagagggtaaggcaagcttgcccttttttatctggaggtgaatagatacagtgaattcctgccaattaattttctaccttcaaaaaatcctcctggcgtgtcttctagagcctgttctgcttctgttagtgcattcacttatattctctacctgatgcattagtcagttcaatacagactgcctctcttactgtcctacgagcttcttgaagttcaaaactaaacacagtttatctggttctcactttctatagcaccttgcataagatagtactgaaggaacgtgtcctggaggtaacttagggatagctgctacttccaaaatttatcctagtgctgcataggcctttaatatttaacagcttgtaatata

SEQ ID NO: 80670 - DNA, 1091 bp, Homo sapiens
ggtgggaattgaacagtgagaacacatggacacaggaaggggaacattacacaccggggactgtcgtggggtggggggaggggggagggatagcattaggagatatacctaatgctaaatgacgagttaatgggtgcagcacatcaacatggcacatgtatacatatgtaacaaacctgcacattgtgcacatgtacccgaaaacttaaaagtataattaaaaaaaaaaagccaaaaaaaaaatgaagggattgaattgccttctttaatatgtgactaatgctgtcttatgtgtacaaaggaaccatgagccaaaggagacagaaatagcatttgaaaaggaatagaacattttctgctcatcaggtattggagacaaactattcctgatctggggctgtcacacttggctggtggagtgctgataaaccttagcccttcacttctgctggtaggaagtcattaacactgaggagcttttcgtgtttaacagttcagttaactctggcccctcagtgttgcctgaagctttggactcagatgggaaacttcacttggtcaaccctggtttcctgttgatccgttcccagtgggatattaatcctttaatagcagttagctttttttcttcttgggttcttgcataatgcttgatgtggtagatggaagagtcccatggtttcagaaccatcctatttggtttcattaggcagatgggtgttaggcctttcttcatggttatttggccttaccctttctgatgagatttgtagggctttgagtttgaagtgcacatagtcccttaacggatgaacaagaaagactttctatcttgcaacatgtggatatcagaataaagagacctgataatatgggttatcttttaaaggaagaaaatgtttgtaaactcattgtgaaagattctgtgccacatgtagttttaagcagttggttctgagttcccaatatacatttatccagattgctgggagtagacctattaatgatttatattttattttattttattttattttatttttgagatggcatcttgctctgtcaccaggctggagtgcagtggcaccatc

SEQ ID NO: 80671 - DNA, 1012 bp, Homo sapiens
ttagacattgccagagataaaatgcaaatgtagttcattcactccttcagcaaacatttgtgcctaccaggagataagcttgtcctaggcccctgccaagtagaggggttatggaggtggacagtacttagtccctgcccttgaggagctcacactcctgtgagaaaagaagcccaccaggacagtttgggagaagaggctggagagagatagcaggttttagattttgtgtcatggatgaaaggagctaagaaagaactttgagcaggcaaggtctcttgagatttgtgaactggaggtctttggcagctgtgagaatggaagattgtgttggaaactgactaattagtttctgctttgtattcaggaaatggatcccacttcctgtggcttcagtcagctcccatattgcttcccatctttctaggactctgtcatggatacaagtacttcaccattccctccagcagcactagtgtcctgtggacagattttcacagggatccaggtcagctcttgtctgacatgcagtggtccctgcatgttgattagttctgggaacagatttgggcagaggtagtagttatttggagcctgattatacaacttcagtacatccagtggaactagtcttagtgtcggctcttagagagttgctcaagctgaccttgtaaaattggaagactccccgctcccaccctcatccattgatgatcctgctggctgcagattcaagcatttgcctacatcaataagctctttcctgaatttaggtcaattctgtaataggaacattgtgttcctcttgccaaggagcatgttttaagtgcctaaacatttagtctctgtttgataattttctgagtgctctagtctgtgctatcagcagccaaccatatcagttcagaagctatgcatgctagtgtcaatagtgacttggccatactctgttcagaaataatcaggtctggaaggactacttccccaaagggcgcacacaggcactacaggc

SEQ ID NO: 80672 - DNA, 1068 bp, Homo sapiens
ggattacaggtgtgagccactatgcctggcctgacagagattttcaattgcttgggccagtatcatttataacgtactaattccttgttctaatttctatttcagtttaaatttgtggggctaaagaacttcccttgcactcccgaaagcctgtgtgatgtgctatctatggatttcccttttgaggtaacgaaaccattgtctttattgccttgacatgatgataggctgcagagagacttagttacacaaagtcttaaaatattccttgattgtgctgtgtcaaagcatcagaatgggacaaagctgattctggagaaaggatgtacttgctgcccttcagagcctgagctccacccatgctggataagtcagaatgctggcactggaagggcccttaatggacagctcgtccaactccctcatcttacagatggagaaactgaggtccggagaaactgaggcccagataggagcaagacttgcatgcctagatccttcttgtgtgcctcttcctactgcaagctgagacccaggtccctggtttggctgtcgtggctgcttgtaaagtgaaggtgcttctgtgactgaatgactccaacaaatgtccaaatccctaatcctttcctcaccaaagaagatggcccttggggacagcagcacttgctgagcaggagcatgagtcaggtgaccacctcattccagtttgctcaggactcgccctgttttagcactgaaagtctcacagcggctgggcatggtggctcacgcctataatcccagcacttgggaaggccgaggccggtggatcacttgaggtcaggagttcaagaccagcctggccaacatggcaaaacctcgtttctactaaaaatacaaaaattagctgggcgtattggcagatgcctgtaatcccagctactcgggaggctgaggcaggagaatcacttgaacttgggaggcagaggttgcagtgagccgagattgagccactgcactccagcctgggcaacagcacaagactctgtctcaaaaaaaaaaaacaaaaaacaaacctcacagccccag

SEQ ID NO: 80673 - DNA, 1095 bp, Homo sapiens
tacatgtattcacaacctacaaatttggtaactaaaaccaaatatatttttataacgtaaacaaaagactgtatgtatctttttaaatttccaaaagcaaaataatttaaaagaatgaagaggcccggtgggcgcagtggctcacacctgtaatcccagcactttgggaggctcgaggtggagagatcaagaggtcaggagatggagaccactctggccaacatggtgaaaccctgtctctaccaaaaatacaaaaattagcctggtgtggcagtgggcgcctgtagtcccagctacttgggaggcaggagaatcgcttgaacttgggaggcggaggttacagtgagccgagactgtaccattgcactccagcctgggtgacagagcaacactccatctcaaaaaaaaaaaaaaaaaaatagcatggggtgtttttgtttatattagagtttgaaatggaaagtatttcatctttctgtttcccttctctgtggcagactgatttccgattctactggatgcattcaaagttaccagaagaagaaggactgggagagaaaaccaagcttaatcctgtaaggcctggtgttaggatcactgagttccttatggggagtagtgtggattggtctgttatctaaatataatcattatgtatgaaatgatcttttttgaggcagcatggtataaagggaagagtatcaatcatgtagatctgaattccatttttggcttttattattactaatttaacatcctatgttctcactcataattgggagctaagctatgaggatataaaggcataagaatgacacaatggactttgggaactctggggaagggtaagggggatgagggataattgggtgcagtgtacgctgcttgggtggtgggtgcaccaaatctcagaaatcaccacaaaagaacttattcatgtaaccaaacactacctcttccccaaaaacctattgaagtaataataactaaaaaaagactaaaaaaaatttattactaagttaagttaataatctcacttacccttagattttccatctgaaaaatagggtaataacatctaatttacagggttgt

SEQ ID NO: 80674 - DNA, 1047 bp, Homo sapiens
attttgagggggcggtcactgttttagccttgcaaaggagattccatcatttcttacttccaccagaatccccaagttgctcccaaatttggagcttttgaattaaatgtgtcgcattatagggcatcttcctaaaagacataaagacctgccctggccagatgcggtggttcatgcctaataatcccagcactttgggaggctgaggcaggcagatcacttgaggccaggagtttgagaccagcctgggcaacatggtgaaaccccatctctacaaaaaatacaaaaattagccaggggtggtggtgtgtgcctgtagtcccacctactgtggaagctgaggtgggaagatcacttgagcccaggaggttgaggctgcagtgagctgagattgcaccattccagcctgggcaacagagcgagaccctgtctaaaaaaaaaaaaagaagaaaagatatgtccttatgccttttttttccttccagcaagcggctggattatgtgaaccatgccagaagactggctgaagatgactggacagggatggagagtgaggaagaaaataagaaagatgatgaagaaatggacattgacactgtcaagaagttaccaaaacactatgctaatcaagtaagtggtccagagaagatgagacccagctaatctcactccctttactatgcagtcaaagcccactgaaataaatgctgtcataaagagaggagaatgaggcaggaaaaaggaataggaactgcaaagaacatgccagtgtacgtagatcatatgggatgataagtagagatggcttactgtgctatggactgactaggaatcactgatggaatctgtgggtagtggggtttgggaactattagcctgtgctgttaccaaaggctgccagcccactgcagaaagcccctgagctattgatatagtaacacactccatatccttgtcattttttttagttgtcactgcacagctgttctggattgggcctgcccagcctaccactgactccttccacttccctgggtggtagagtct

SEQ ID NO: 80675 - DNA, 1044 bp, Homo sapiens
ggctcacacctataatgccagcactttgagaggctgaggagggaagattgcttgagcccaagagttcaagactagcctaggcaacatagggagatcccgtctgtaccaataaattttaaaattggctgggtgtggtggtgtatacctgtagtctcagttactggggaagctgaggtgggaggattgcttgggtccagtagattgaggcaacagtgagctgtgattgcaccactacactccgacctgggtgatagagagagaccctgtctcaaaaaaaaaaaaaaaaggaaatatctgtaggaaaataatgttattgctaatatatgactcatttaccctttaacttccttttgtctcatggaaacacttgtgattttgcattaagttaattttttttcaggaatgtggccatcatatcataactgcataactgtctgtatacaggagatgatatgaaatgaatgaaccattttcttacgttttcctttgtagggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatcgtaaggaagctttaactccttgtcttctttctctgggctaggagctatgaaccattccgaaggctctaggcttgtctctacagactctcccttcaaagtagactctttgtaggctgatcttcttgcccacaggttgggaggggtaaatcctggcagaggtaggtttcttttatacccagagcttaggagaagatgaggaattagggagacaccgaagtttgaaaccaaaagctcaattatttggttaagtttttctttttttcctggcagctgtactgagctctgtggtttaggaacttgcgaaagccacgcccagactttcactccccacatttcctgggatgcttgtgtttggcttctgcactctgaatgctggtattggtgtggtc

SEQ ID NO: 80676 - DNA, 1112 bp, Homo sapiens
ggcaggtcactcgctgctgactctattcttctctgggctcctgggacgtataaatatgactctatgtaagaaaaccagaggctgggcgcagtttgctcatgcctgtaatcccagcactttgggaggccgaggcgggcggatcacgagttcaggagttccagaccagcctggccaacatggtgaaaccctgactctactaaaaccacaaaaattagccgggcgcggtggcgggcgcctatactcctagctactcgggaggctgaggcaggaaaattgcttgaacccgggaggcggaggttgcagtgagccgagatcgcgccactgcactccagcctgggtgacagagcaagactccgtctctagagaaaaaaagaaaaccagacagattaaaaagttgcacttacaaagcagttggggcatttattgacatttaaacaagggaggagatcctgaacactagtctcgctcagtttataaaaacttgaggccaaactctccatcatctgtacacagcttaaccacggccaggagcaagaattcgagttaaacgaattgaaccagtccaaccacaagacgataaagggaaacagggcgtggggatttccagtttttccttttacattacaaagtttccaacacaagaagccaacaataccccagtgctgcaccaagttacttcccactgtttcccaaggcacagtcaattaataatcagtagtccaagttctaagaacattccctggaaaacaaggacgcacctcccgtggctctatgcatggcctgccactgatgaatcaaattcttaagaacctacgaccgtctgatacccttgaggagagcaccctcatagaatctccagcatcaggcctcagttttcccatctgtaaaagacagccatgcaaagtgggagatccgctaggcttccagatcgaagtcatcgcgctcctcattgtactctagcacgtgccgcttgatcttggacgagtccacccaagtgacaaagtcctccatgctgcgcgtgacaaggaaggcggggtcggtaaccacgtcagggcccacgcgtacgtgcccttgctccacaaaggccacggcagcctgaaggtgctgcgcca

SEQ ID NO: 80677 - DNA, 1059 bp, Homo sapiens
gctccggctgcgcagccggggtcgaagagttggcggcctgttgtgtaagcctcagtccttgttttcccggcctggctcgttgtgaagccggacacatccacccttggactcgattcaggcggctgctgcttttctccttgcccctcttggattttccggatttttgaaaacccagtggcccaggagcaagaggaggaaggaggaaggggcagatctgcagaggaatgtgagagcctcccaaagcgagagccgccaaaagaatctgggagccagagggacagccgagccctgcccgggtttctggaatggtggtttcagagtgagtctcttctattttagaacgttgttccagtggaaagtgtcgaatttttcccctcgcagggcagatttctccaggtcacttgacttttcttctgggagtaggagttaggagagattcccctctaaccccccagaggctgctaagggaggaggagactgtggacatgagccctccctgctcacaagcatatgcccggagacctgatagggcagtttctgggccatggacattgctttgaagagggggagactggacagcatctgtgggtgctgagaccccaccttaggacctgagagattgaactgtgtaagcgccattcagctgcgagtgcattcttggactgccttgtgagcatccccggtctgggcaggaccctctccttcccatctttctataccacccagcccagccatggcactgaaaggccgagccctctatgactttcacagtgagaacaaggaggaaatcagcatccagcaggatgaggacctggtcatctttagcgagacctcactggatggctggctgcagggccagaacagccgtggggagacagggctctttcctgcctcttatgtggagatcgtccgttctggcatcagcaccaaccatgctgactactccagcagccctgcaggctctcccggagcccaggtgagcttgtacaacagccccagtgtggccagcccagctaggagtggtgggggcagtggcttcctctcaaaccagggtagctt

SEQ ID NO: 80678 - DNA, 3323 bp, Homo sapiens
tggcttgggggcttctggcccatctcggtccccgtctcctagccccgaggggggagtccgcggcggcccaagcccttgtggggtccatggccgccctcagccggcctgctcccgggaccggggcggggcggggcggggcggcgcagctccggctgttgtttgagcccaggccggcaaggggaacggcccttaagttttaacgcctcatttttcagtcggattttccttcttcccgcttgttcagccaattgtttttaagtttgcgtttaaggagaaactgacaatgagaatggactcgttgacggaggaaaagttggaatgcagactctggtgctgtttgagcgacccctctcccccgggcctggctgcgcgctgctgtgttctggaaaggagcatagtaccgtcgttgcggcaggtggtgttgagtgtgtattcgtgtggcccctcccttgtgtgtaagcctcgaaaatggataggtgaaaggagatacgcgccagggctgctccccggaaagatcacgtatgtcacaaagccgaaaagacacttttaaaaactcactcattaagcggaaatctcattagaaacccaaggcttggtaaaggaattgaagtattaagtttctccataaaagtgtatcgtgaagctattcgtcgtgaaattgatgtaggatattggtccaaactgcagaatattctcttggttataataggcgtcaaggtggtggcttcgggctccttttcaaacatggctaaaaccaagtcttgtttttaactccctttggttgagtcagtgggtactcaagtgcctgcagggtggctggcgtttgcaaaaaccttgatgttataattgaccttaaaatggttaccagactatctgggcagaaggtgtgttaatttcaaaaaaaaaaagacaagtgctgtactgaggagataattcatttattgaatgaatacgtctgagtgttctgggcactagtgttgcagaattgagtgaagtcgtcctcgctctcagaactcagtcttcttgggggaagagttcaataaggtgacagctcctgtggtatcatcaggaaagccaaagcaactaattttgacttgggggaggtgcgcttcagggaaggctttgatgagaggctgagacagttagagatgagcttccacaggtgactacaattttggaaggctggcggaagggcattttagactgaggaaactccacccaaagaagacacggagatttgagaaagtgtggtttccttagaagtagaaaatttatgctaagacttgagaagcccacgatacaggctggagaaggggaggattttccaagagtggaaaacagaaagtgtagtagttgtcatgaagcaggtgttttaaggagacgggcctgaatggcttcgagggtgattactctggtagaagttggggcatggccacgaaaaggtagggctggtttgaatgataggagactgaatttgtaggctgtggggagctactaagtttactcaggtaagttgggagaatgtatctttcatccaggattagaaatggttctctacagtgggtggcattaggaaatgtggttatcccagtgggggtggggtggtcttattgctgtgccggcatttagtgctaggagtacagggataccaaatgttttgcaacgttcaggcagtctgccacagcaaagaattatcccacctaaagtgccactggtgccccatcgagaaccatattgaaggctggtaagagtctgctgcagataaaaataaggagtgatgacctggattaggcagtggcaacagaaatggagcaagaagtgaatgagacactttcagtacaaggaggatttagtgaggactagtgtaatggcacccaccgctaggtagaaactattaaaattgacttgctagtgaaatatgacagactatcaggagataattatcatggcagctgctcagtacaaatgtctgctaactttttattatggaaaatcatcaaatgtacaaaagttgaacagtgtaatgtagccagcctcaacaatgataaacttttggctaatcttcatctgtactccactttagattattttgaagcagattccagacagatcacttcatctgtaaatatttctgcttgtatcttttgaaggtaaaagactcttttattttttattattattttttgagacggagtctcgctgtgtcgtcccagctggagtgcagtggtgtgacctgggcccactgcaacctccgcctcccaggttcaagcaattctgctgccaccgcctcccgagtagctgggattacaggtttccgccgccacacccggctaatttttgtgtttttagtagagacggggtttcaccatgttggccaggctggtcttgaactccacctcaagctcccaaagtgctgggattacaggagtgagccaccgttcctggccgtaaagactcttttaaacatggatgactgttttgataaaatgacatggcttgttcatgtcgataccatttgcttagaagggaaagatcaagggaaaaatggggttggatttcaaatgatttggtttgatcgatgatttgttattctctaaagttgtaactctggaaaaggtaatgagtttgacttattctttaacttttcctctttagacagttcaaatatttgaattctacatgctaggacttgttttctttatacttaccaagaaacatccttatgcagtttctctaatgtttgagaaactaagttgttttttacacacgtgcatgctagttcctgaagagtcctgtacaggtgctctgctggcttttcctttcaggtttctgtatcagctgtatttctccctgtagaatgtgcccctgacctccaccccttaaccttaccccatttgtctttatatgcctgaccatccgtcaaggctcttctgggtcatatttagttcatgctgttatttccccttcctcccttctttagtccttactatttttgctttggtcatgttttcttatgctgtattctgtaagcctttaaatttttctttttatggtggcaggggagaatattttataattatgctttgtgctttttatcttccactcaataaatgcttcataaatatttgagtatatagcgctattctagctgtattgtatttgaacaaaaatcttaactgccttgtaagttaactgctaagaatttgtcaaaagtgcagagataacatcaataacttgtcatggatagtacaaaaaggtctctaagggcttgatggaagtctgtaaattgacttcatatgagagtgtaagaagtgaaaaagacc

SEQ ID NO: 80679 - DNA, 1050 bp, Homo sapiens
accttttgttgcccttcctttttaagcctttcctgtgcatagtgaagaataccatgactactagtagtttggtgttaccgcctttatttgtgctaaagtgccagcgtttttacccaccattgtatctgcacccttacagcatatgtcaacatgttagtattcttgtaaaaatagtttggacctgggggtctgaggtccccactttgggaaccattgaaataggtacttagatctacagtgtatcatatcttttcatctacaagattaaaaacatgatttcagttaattgtttttgtaattttcttaatatggttttgaggggtttcagtccagagtgaagacatgtatgtttcttggcttatgctgaagtttactagacaaatactaacctaataatgagatcctaagtgtagttgcagtttctttagcctaagggaaaagaaacctaaaaactaaaacagtaaaaatggtccagatggtgtattcccaatgtgtgctgaagaatttgaagaagaaaatgcagtactcaataagtggtgttaagaacaggattaattctggagagtttctcatttagcctgtaaagagatttggggcacagtaagagttagaggaatgaaaatagtaaataacccattattgaccaggtatactattaatgatgtcctccatcaatacaacttattcttaaaagaacatttggtaaaatgctttaaaaatattcagtttctgtggcttcagctataaatcagattatagttctcaaagcagtgtttcctaaaatcgtttctgtgaaattgttttccatgacttgaacctagttgttctgaagctaatatacgataataatggcttttccccaatttataatagaaaatcatacaaagtaacagagtaaatgtctgttagtgggtgaaagcacataatgcttagttcattagctttttaaagaaatcacatgtaattgtgttttaaaaaagatatgggcctggcttagtggctcacgcctgtaatcccagcactttgggaggctgaggtgggctgatcacg

SEQ ID NO: 80680 - DNA, 1553 bp, Homo sapiens
tggaaagagcaggagaaggatgggcaaggcagacatcatagtctctttgtagcctaatctcagaagtgatgttattacttttgctgtattctctttgttagaagtgagtcactaggtccaggggcgggaattttacaagggtgtgaatgccaggaggtgatggtgatcggggccattttagaggctgcctaccagtgttgaagaaaatcattgacttctatgagctgtagcaacagacagtgctatgcaaggagaatggttgtctcaaaagtccagctcctcacaaggtttttaatatgttgccttttccccccatacattttgtttaaatccatggtcatcttgccgtttagtggtgtggtttaattgcatatttgggttagtctgtatgtaaatgtttaacatgtgtctctgtgttaaacaggaatcctatccatcttcttcaccgatatggtttgtggattctgaagacccaaatctgacatcagttctggaacgtctagaagatactaagaacaacaatttggtaagaaaataagccaagctattttctcttttcctcatgaacattacatatagaaattaaatgttaagagataatatgatataaaagcatgattaatgattataatcttgtaggaattaaagactagtttgtttgttttttttccttcaaattctatttactacctggtctctcttttatttcccacatgtataaccttaatttagattacaaattagggatctctttttccctgaattctaaccattaagccaaacaagcattttgggtagagaccactagccaaggtgggaagcagaaaaaagaccaaggtaggagtgaagggagagatggggagaatgacaccagaactagtatgagggaattgccttttctttcaagggtctgtaagtctgcagtaaaagaatagaaagttttatttttgtttttagtatataaagaaatataactttccatgttgaaaaagtttttaatgctttttttcttgattataaaactcatgagcaagcattattgagaaaattagtaaaatatagacaggaaaaaaaattaaaatctcccataatttctctacctaatataaccactgttgacatgatggttattttctaccagtatatatttttcctttgctagtaaaatacatatacctttatacatgtgtttaaatagttgaggtcatggtctatatagttttacatcattttaaaaaacatttactggccaggtgtggtggctcacgcctgtaatctcagcactttaggaagctgaggcgggcggatcacttgaggccaggagttcgagatcagcctggccaacatggtgaaaccctgtctctgctaaacatataaaaattaactgggcatggtggcgcatgcttgtaatcccagctacttgggaggctgaggcaggagaattgcttgaatctgggagacagaggttgtggtgagccgagatcacgctattatactccagcctgggtaacagagtgatactccatctcaaaaaaaaaaaaaaattactgtat

SEQ ID NO: 80681 - DNA, 1899 bp, Homo sapiens
tgcagttttcctagtgaattattgttattttttatacagacacttaagagcctactaaatatcaagtgttacaggtttcatttaatctttaccattctgggaaagttttcatttctttgttttacagatgggtagactcatactcagggaattagataggatatccaaggtcatctagattgccaggctctgtctactagatatttgcttctgtatttttaaatgaatatgactggaatatataattttgtaatccatctgtaacaacactgcctgtgtgtgtctgggttattttttctgttattttttgtttttatttttttggtagcctcattaatgcattaatgttctcttgtctgaagttgtaagtttctcagaaaacgggttagcagtgagaaattggacaatgtctggaacttccttcctctgcccttattgttgtcattctgctaggtatcagttgtagtgattataccccaagccatagtaactttcttacactagagggtcctgaaaatattttaaagactattttttaaatctgtaagctgcagttgagcagtaacaaactttttcatttcctactggattgattacagtagtcataacattattgatgtcttctaagggctctttaacataatgcttatttactgaaatgtgttttgtagcttcgtcagcaattgaagtggttgatatgtgaactctgcagtttatataaccttcctaagcacctggatgttgagatgctagatcaaccactacccacgggtcaggtaaagtaaaaattctctagtgttcaagagctaaataaattgtctcaagcaaaagtcaaactaggatgatttttctttttattgttcaacttatttagaagttagtttcatttttgttcctattgaattgttttgtttgttctgttttaggtactaaaaataaacttttcattctttggagctgctggtatttactatacaggcaaacaattgcccttctctctaccaccacctttttgttaatattgctggtttccgtaaatgctcttgcttctttcatagtttgtctttggttattcaattaccttcacctagcaatgtcatctccttaagtctgtctgtgctttttaaagactaaaccaaatgttatctcctgcaagcaacagaaatttccactagctcaccaccatcactaatttcattctggatttacctatttaggcatctaaatatttattacctatttattttttttttactataatacatgataatttagctcttataccacccacttaccactcacctccccttcctcaaatattatctttagtcatataagtaatcactaattatcattaggactttgtagagtaaagccaagttttctagaatatttaagataggatatttcctttcttggtgcagctttttgttttgcagtgtcttcctcataatagtaatttttaatttaaaaaattctgttgtagccctttctgtgaggtttccctttcttctgaagcctttggttcctctgtgcccatcttggcaggttgttctttgggttggctgtgcagatgccatcttgaggtttttctcatctgctctcctacagtagatccattgtttcttggatcccatgccatctttcttggctgaccctttctcattttgcctgactatattctcaggtaaaaccctaagaaagcatggaggagtacattttctgagctctagcttctgaaaaatactgtccagtgtttggtttttggagccagaccgtgataggtttgaatctttgttctgctacttactggctgtatgcccttgggctgattccctaattgctctatgcatcaattttccattggcaaaatgggggaaccagtaataatattagtac

SEQ ID NO: 80682 - DNA, 1184 bp, Homo sapiens
agaacagtgcctggtgcatagcacatccccatcaacgttgacttctgttatattctaccctccctcacacttgattggtagtttggttgattatatatttctaggttgaagataattttaccttagaatttcaaagtctatgctgttgtcttctaaccagtcgtggtggtgaagcctcatggcattctgagtttcagtcatttatgtatggctttctctctggaagcttttaggagtttgtcttttccttggtgtgctgaaacagcacaacagtatacttagtgtgggtcttttttcactcattgtgctcagtacaccaaatggataggcctatggataggctctttcaaatttggaatcttgaatcttctcataattttgttaactttctcctttccattttatttgttcattttgaagtgtccgttaatgggattttagacctcttgtcttgagtcttgtatctcatattatttctaaattatttttctttaattttaaaatctgaaatatttttctttcaacttttggaaatgttatttggacagtcatagctttaagttttatttattgttgcttaaccaattatcccaaaacttaatggcataaaacaacaaatttgcctatctatcactattgtatggcttaactggggctagttggacaggttttctgctggtctcatttggcagctctcactatgtggtttagacggtggcagggactggtcatctggatgctcagctgcagtggaatgtctgagacgacttcttcacccacaggtctgctgccttggtgtttcttcatctggcctttctctctgcatagcgtctcatcctctcgggcctcttcatgtggcttctctttctccaagaggatagtcagttcctatttttggcttccagaagcacagaagtggagctgccaggtgttcttaaggcttagatctggaacaggtccaatataatttctaccaaattctgtaggttaaagtgagtctcagggccaacccagactcactgtgggatgggcccatccaaggacgtgatgacaggaggtgtggttcattgaggaccaactcccaagatgagccctgagttctaagaaccttttcttcgctggttattttttattcatattctatttttgttccatggttgtattcataagtgtctttaaggagc

SEQ ID NO: 80683 - DNA, 2618 bp, Homo sapiens
ttgttcacattgccatactattaaaactttttattgtgagagatgacatgtattaaaaatatgtaaaacataagcttagtgtaactcataattagagtgaatacttgggagccaacacctagccagcacccaggtgaagagaaggaacattgctcgcactacagaaaccttctgcaggcttcttcctgatcactgttcctctgtgcactcatctttccttacatttctctagtgttaccacttatgtatgcatccttgaacaatacagtgtagtgttgcctattgctgaacttttgaaaatcatactgtatgtattttttcgtacctttgttgtgcttaacattgtgtgtgaaatttgttcctattgtgtgtagctatagttcttttgcattgctgtatttattccattgtttgaatacaccctaccatttatccccttgactggatacagacatgtgggttgtttccagtgttaggaacagcgaatgctgctgtgatcattcttgcttgtatttcatggtacccctgtgccagcatttctctggggcacatacttaggggcatgaggatcaatttcttcttttactcaagagttatctaggaaaaaaaaaactttttaaaaagcattttcagatggcttttcagttatttttagtgcatcaatatggtcagagaatatggcctgtgacctttcagctgcattatcagtaatcgtttagacttcactattggtgttactgctgtctttgcttcttattgctgctccttgtattatgtgtcctgctccctgcccctcaagtatatccctgaataatatctggttgttttttttttttttaacctagaaagggtttaaagggatgtgcatggagagtgtcccttgaatacttgctgtctgttatttgttcaacaaatatctgactctgtataaagtattccacattggtgtggagaatctggaggtgaacgtacacagataatgcttcctgtcttgatggagctagatatagaattctaagttcataattgagtctattcccagttctttacgcttttatcttctgatatttgttacaaatgaaaagtctgatgcctatctcattcttaattctttctgtgtattttattttttctttctggtagttggtatgattttctctgtaactgtaaagtgtgggggttttacttttcagttttactttttttttttgaaacagggtcttgctctcttgcccaggctagagtgcagtggtgtgatcacagctcactgcagcctctaccttcctgggcataagcagtcctcccacctcagcctcttgagtagctgggactacaggtgtgcactgccaccgtgcatggctactttttaaaatttttttgtagagatgtgttttcaccatgttgcccaagctggtctcaaacttctgggctcaagtgatcctcctgccttggcctcccaaagtgttacaggcatgagccaccgtgtccggccttcagtattcctatggggctttcagagccacttaatattctaaagtctttctttagctcagcagcacttgtctcttttgtttctttttattccccttcatcctctggatgaatgttagatctctatatcttcaatgtcccttaactgttctcttacttacatctcttctgttttctcccccatctcctttttttctctgttctaaggaaatgtcactgtttgtttttcttaatcataaataccttgttgggtcaagtccatagtactctggcccttctacaagtggttttttgggggtggaggggatcttatttttactttctagaattgtgcttgcatagtaatctgttttttattttgtggatgcagtatcttcccaattactgctaaagatcccaattaggttttaaaattctatttatttccttcattagtaatgcttcagatcaattgtgcttacttgacttggcactttcagattgctaattttcttcagctctctggtgatacctggttatctcctcatttatagatgagatatacccttgatcagtatccattgttgacctgagtgtcttcagaattgtcactcttttctactgtggcctccccctcctggtttgcagacctgtgctcttcctatggcatgaggatggggaggtgctggctggtgagctttccagctcctgagctaaaaggaagaggtggagtctaagattttgctgctgcattgagttatactaaaaacactctctgtcttttctgtctggttttgacactcatagaggccatcaagatagggttcctatataggagagtgatccttaccaactgtagatgggacaagtacagtaaagaatgtctgattcttctgaaaaaaagtggtccctgcattatttggattgagtctgtgactttctcaagcccagcagtctgattccatctcctttgtatcttccagcatgtccttatagttttagttcactaagggtattctccttgtatttgtttttctgctactgcggcagacctactctttttttataaaattctgtcatttcagtggggttttgaaaagaggaccaggccacatcttgaaatgaaatcatcttagggtttcccacga

SEQ ID NO: 80684 - DNA, 1710 bp, Homo sapiens
ttctcattttaaaatgagggatagtaactgggctgatggtgacagacccagatgcatgtgagaatcacctcagagagcttttgaaaaacagattctctgggtaggctttgaaattggcatttcgaaaatgctctttcaatcgttgatgcaaccaaactctttgggagttttaggctaggtatatagtctttagatacccagaatagtttgatttggaatataacaatttagggaaatgaaaaaagggagaattacattttggaagctgcttgcttccattttccattagtttttagaagacaatgtgtctaaagagatgcagatttaaaggaaatacaagttaattctgcatgggtatgtttacatggaattctccagctgactaatccagaagagttctaataccctctgtgatcatgggtttgtttttcttgagaattattccatcagagtgtctaataacagatgcttagatactgccgagacctttgttggtcttacttgatctctggatcctggtttcgtgatcttttacatattctgtgttctaacctgaactggccttcatggttaaagatgcatgtataaacagtgtcctggcgagggcttaccttttgaactttgtcaaaaatggatatgaaagtccttcctaaaaccccatcaaattcatttctgaacttgataaattgtaaattgtgtaaattggttaagttgtgtcttgtagggaagtattttgttgtaaaatgtttttaaaaagaaaatttgctttttagtgaggtggtaatcatttcataattcttagttttgtgaaatgtctattatcaataacacatctgactgttcaaaatgtaaggcaattgaatttatgtaaatgattcaggctttccaaagttaaaaagggagctattttaaggaatcggtagtttgggagattttattttaaataagccattgatcttatgcatatagccatataagtaaaatgttttcttattttaaattagattatgttttaacatttttttctgttttgctttatatttgattgcttttctttgttcctaaggcagccattaagttgaattgttcaaaattgtttcatttttaaaagctgataacttatttgttagtcaaagctggatttaaagataaacattttaattttaataaactgtctggtagtgggactccagtgacagatgtttgagagtttgtggcaccagtcttctaatgtactcagcctgtgcatatttgttctgtatagccctggcagattctttctctgtttcagaatgggacaacagaagaagtgacttcagaagaagaggaagaagaagaagagatggctgaagtaggtattttatataaaagaagagttcataaatttcttcatttttgaacatttgagtaattctcaaatcttttttatagactactattaatgtggaataattgaaagcacattgtgtttggaatggaatataatttcccaactctggctttacctctaactaatgatatgcctttgagcaaatttatctgaattctttggatttgatttcctggaaaacaaaagcttttaacatttagcaccaaaattatatttatgtttaatactaatcagtacttaatctgtatttggttatttttaggaagaggaactactaagtttaaaaaattttatgtttgcataaaaggagaatttgagaa

SEQ ID NO: 80685 - DNA, 1056 bp, Homo sapiens
ttttgctattttgcacatgcagattttgtgtttatttttgtggctgcaaggttgaaataggtatccttatgcctaaattagtgtttatagtttaaactagtttcttagaatacaattctagaagttgagtttctggaacaaactaggaacacttaaggttcttgacacctgctgctaaactgttttaaaggttcctcttaataggagatttagaagatggcttatttggtaatagttatgattttgtaaagcttttaaatctgctttacccagagtctagattttaaataaaatataggatataaaaggtgggagcctcttgaatggaatgtgggggctttttctctctccctataggatagttacattttgtttcttgttcctcatttgagtcaagaataatttaatgttattttggcataagaaactgctgaagaaaaataggttgaataagctaacatttttcgtctctttgtaggatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatgtaagtgtgtgtagatatctagaacctggacttttgtggttaaataattgtagttaataccaggcaattcattaacatgcccatctcagctgccctcttcctccatttctgccttagtggtggattcagtcatgtgtgttttaaaacagggtcttgctctgtcgcctaggctagagtgcagtggcacaatcatagttcagtgtagtagccttgatctctcaggctccagtaatcctgctgcctcagcctcccaagtagcttggactataggcacatgccaccatgccaggctagttttttttatttttagtagagatgaggactctctgttgcccaggctggtcttgaacacctgagttcaagtcatcctcccatcttggcctccgaaactactgggattacaggcatgagccaccgtgcctagccttagtcatatg

SEQ ID NO: 80686 - DNA, 1088 bp, Homo sapiens
aggctggtcttgaactcccgacttcaagtgatccacctgccttggcctcccgaagtgctgggattacaggtgtgagccactgtgtccggccacaacttaatatctcttttacgtgaagcagcaggatgtgaaaagaacactgagtctggtgacaaacacacaatttatggtttcactttcctcagctctaaaatatggctagacagtacataccttttggatgattgctatcaaaaataaatgaaaatgatgtgtgtatatatataaaatgctcagagtagggaaacatcaaatgattgtctgaacacttactactttttgccttgtgttagagctattgaccaactccgtgaaatctgagtagcagttactttgtcttgggcacaggttccccaaaacagggaatgaattgttaggtaagtagatgccaaatgttgaaaacaggtagattactctccctccttcagtctaatttatatattaatctaatttataatttttagtagagcaaagaaatttagtcaagcccccatatcttgattacttaaaaaacaaagtttgtcatttgaattaatgatgactgtactttatgtcttgtgatcgattccagtttgagttatagtcaaaacaactataagttactgaacacttttgcatgatggatactatgccaagtactttatacttcacatatcttcacatttagtcttcatagccaccgtgtgaaataggtatgcttcatattttagagataggaaaaacttctcatattttgtagatatgaaatgagctaggaaacttgatttttccccccttcaaagtatagtgcaatgtttaaaatctttaatttcacgtgaccaaaaaatagttccgtttgtatttagtcttatgataagatattgatgtgttttcatctttagagatgtccctgcactgaaaaactgaaaccagtcgcatgtaggcagatgtttctcagtgtcttaatgtgcgaactagaccatctgtgtaatattcttgtttgtagtcttatgaatggaactctattttagtaaataatgtgtcaccttgagtgtcttctagtattttca

SEQ ID NO: 80687 - DNA, 1021 bp, Homo sapiens
ctgcgcaggcttcttggatactggctggaatatatttctgggccaggttgatggttacatgagcacataatttacaatagcttcttaaggtatatctctatattttatgtacttttctgaatttatgtgttatatttaataaggtttttttttgtttgtttgtttgttttttgagacagagtcttgctctgttgcccaggctggagttcagtggcacagttttggctcactgcaacctctgcctcctaggttcaagtgattctcctgcctcagcctcctgagtagctgggattacaggtgcatgtcaccatgcccggctaatttttttatttttagtagagacggggtttcaccatgtttgccaggttggtcttgaattcctaacctcaggtgatctgcctgcctcggcctcccaaagtgctgggattataggtgtgagccaccacacctggcctaataagtattttaaagatgctaaaaataatggttaaagaatagcaatggaatctagaaaaaatgttaatgatttttttttttttttgagacagaatcttgctctgttgcccaggctggagtgcagtggcccaggctggcgtgtggtggcacaatcttggctcactgcaacctctgcctcccgggtttaagcagttctctgccccagccccccgagtagctgggattataggcatgtgccactatgtccgcataatttttgtatttttagtagagatggggtttcaccatcttggccaggctggttttgaactcctgacctcatggtacacttcccttggccttccaaagtgctgggattacaggcgtgatttaatatggatctggatgagatgtaatggtttaaaatctgtggatatatgagatattttgatggaaaaagcaatacttcctttgtacttacaaaaaaggtagtaattttctaaaagcttcttacgtagcttttttatgtgtgtgtttttgcttggggatatatcttatgattgaactttcttgaagtgacccaaat

SEQ ID NO: 80688 - DNA, 1089 bp, Homo sapiens
atggtcagaaccatttgattctcacaacagaatgggtaaaaacaatttgaaccataaaaccatacagatcttcatagcatggatagggtaaggtcagtgtcattgtcaggggaaaaactcatggctgtaacatggtagagaaagtttcagatgtaaagaacacgtgaacgccatttaaggaaactgattcttctgcccctattctttggaatatttagggctaagttcttaattactgatatcatacaaatctgaaagtattatgttctaagaaccattagaaaaaattgactagaatttcagagggattacattagcatgataacattagaatttttaaattacccatagtcctgtatccctaacaactgttgtcatgtttgcatgttattttctcatccttacttgtgtgcatattttcttggtaatggcacttagaaattgtttaaggaggaataattctcgagaattttgtatgactccttttttctttttaaggtatgtattgggtggaggagcattatgtatggaacttctcacaaaacaggtgacttttcttacgatactccattttcacccacaatttagtgttttgatcatgtaaattagattgtaagtagaaaattctttaatagctcctactcttaaattttagtttatttttaaaatagcgtctactttcaagaatgaaaaaggtaaaccaataaaatgacattgtacttggtgctgaatctatgctaggataggcattaagagtgacctttatttaaggttctaatttgctcatgttgggcacttagaacattggtttgttgtttttttttgtgagattctggaaatgttccaattttactttttccccttgactacagtctttttaacactgatttgctgctgttgagttatataccattttgttaggccttcccaagtgggaatcagaaatactactgtattttagagatactttgttcttctgtagggctggagcagtgcctactcaatagaatcggtcatcatgcaaataaatgccaccttagtcaaaggcaaagccagagtgcagtttggagcaaataaggtacttctgtt

SEQ ID NO: 80689 - DNA, 1325 bp, Homo sapiens
ctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaattttgtttgtgctgatcatggcaagcaaaaaaaagattactttctcatttttccctcataagaaaactctgcttgatgtgtttgtaggctttattgagtttctggaataagatatttaaggagggaagtggtgaggggaggcttggaagacaggcagatttaacaagagaaagtgaaagtgtgaaagaacctggaaatagtctgtacaatagtcaccttttcctccgcctttttcctcttccattctcattataaattcaagtgctactttttccttatggctatccttagttcccccagtgaaaataatctgctccttccttagcatacccatggcctccttgcacacaattgacagattatttcacatacaagaagtccagaggtaggacaactccaggtactgtacatctgggctttgctctgcttccttgagatttttctatgttggtttcatcttttggttgcatgttatgtgcagcccccttacttgatccagaggtagataaatggccctgtcttctagtgtctccttaggaggtgaggaaatctctaaaagcaccatcccatcaagcacactgcctcttgcctttccttggctacatcagggacctgtgcccacccctaaaccaatggtggtgaaaagaatgaaaccatcgtgattagtttgcacaaatggttctcaaagccttatttggggaacactggagacccctgagaccatttcaagaggttttaaaagactattttcataatattaaaacatttgccattttcactcattcttccatgtgtacaatggaattttccagaggctacatgatgtgattttgcaacagattgaattcagaagcaaatatgagaatctatttgtcttctattaagacaaattaaatatttgcaaaaatgtagtgatgccgtcactggtaaactgtcctctttccctactttatatcagccacaaagaaagaa

SEQ ID NO: 80690 - DNA, 1739 bp, Homo sapiens
gaggtggtggagcgtgtgctcaccttcctgcccgccaaggcgttgctgcgggtggcctggtgaggagaggaggcggaggcgggaagcttgcctggggacacgccgtgggcatgtcccaggctggcggggtggggggagagacccttgggacccaccagggccgtccccggctcgctcgccctacctgaggtgaccccctacccgcgaggtatctcccagccgtggtgccccggggggacttccctgaggggcgaagttccccttaaggttttctccatatctggctcttcttccgaactagcgccctgactgacacctacctaccccggggactttggatcccgcagggatctcctgctgctgcgccagcgggtgggggtttgtgagctgtgggagagacgaaaatgaacgtccgttcgcaatcctttgtgcgtttgcgtcctcagcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgaggcaagtagcaaggggtgtcatgcacagtcatttgcaggttggtggttcagtctttgagaactatttttttttaaatcccagttttgttaattaaaggaacatctcgttccgtgaaaagattttgtaaacatcagttttagtgactacacggtaaggatgtgtcatgatttatttgaccgttcatcaaatgttgggcctttttttttttttttgagacgtagtctcgctctgtggcccaggctggagtgcagtggcgcgatctcggctcaccgcaagctccgcctcccgggttcacgccattctcctgcctcagcctcccgagtagctgggactacaggcgcccgccaccatgcccagctaattttttgtatttttagtagagatggggtttcaccgtgttagccagaatggtctcgatctcctgacctcgtgatccgcccgcctcggcctcccaaagtgctgggattacaggcgtgagccaccgcgcccggcatgttgggccttttaagtatccacattttcactattaacaacaacgctgtgcagaaccttcccttcacctgcttcccttgaagcaactttttgttgtctgttttaccgggaagacaactgggtgtgtcttgctcagtgagcacacctagaaagccaagaaccaaaacttaaagccaaatatttcaacttctgatcctgtactcttttgcttctctggcccccaacttcaaaaggggagccaacaccaggagagatgaagactcgaactgtggagtcagaggggctgcagggtgtaccatctctggggagtggaagggaaccatttgacagtaaagtgccaacctgctgctctgtcactctgtttactttagtacggcttacagacagacataactacggtgcagccgtcacaatcaggaaattatcactgatacatttctaccattttatcctcagactcggttcagattttgccagttgtcccagtaaggttcttcatggcaaaaagatctgttcccaattgcaatttgctctgagtaagtcctgtttctttaatctcctttgatctggaacagtttctcaagctttgcttgatttttcccaatcttgacacttaggaaaatcacaggctattttgtagaacatccatcaattgtgtcttt

SEQ ID NO: 80691 - DNA, 3313 bp, Homo sapiens
ctattaaattatagactgcaaatgcattaatgacaagagaaaatgttgattttaaaagtgaaaacagattatgaaattatatatttagtatcatctgaattattaaagacaaaaaagggagagtagaaaagaaagccaaaatgttagcttttttttccatttactgtttttaaaaagttttctatggtttttaaaaagttttcaaatttttaccacagcaggcatgatttttctatagctttaagagtttatacattgtagtggctgttaatagccagacagacttagttgtgaaccatagctttggcatataccagcggtgtgactttgaaaaagctactcaacctctctgagcctcaggtgctatctccataaaataaaaagaaaaataataattttcctatgcccttatagagttgttgtgaggattaaataatgaaaaggtaatgcatataaacattacttacaataccaggagcataagttctcaatagatgtctattaaatattcttttattagtatcattattaaagttcacatagttatagtaatgcccttagaggagttcctccattgtagtaaactgctggtgagacaaaaacatgaaaactctatccaaatcatacgtgctgtttatttgtgttttccaagttatctagtggacatgggtacttttatagccataaagaaagttgatttaacttttctattagaaatattttaaagtccgccaggcatggtggctcatgcctataatcccagcactttggaaagccgaggcaggcaaatcacttgaggtcaggagttagagaacagcctggccaacatggtgaaaccccgtctccactaaaaaaatataaatatttaaaaatatcaaatatataaataaaaatattaaagtacaaaagttggctgggcatgttagtgcaaacctataatcgcagctacttgggtagctgaggtaccagaatcgcttgaaccagggagatggagtttgcttgagctgagattgcaccacttcactccagcctgggtgataaagagtgagactgtgtctcaaaaaaaaaaaatttttttaaagtccaccaaaagctttataaaacagcttgccatttgtaacttctttgaacagtggaatgtggtgtcagctgtcttaactgtgctttgagaacatttcatattgaggcttgttatgtcactacttctagtgtgaattaggaaggaaaattcagcagttgcttttcagtggatgcctcataaactctcaggaccagacttttaatacttgttcaggagtaagaaacctgaggcctaaaagcttgctgagggttattctgctggtttgtggcagagttgccactaagacctaaatctgttttttgttttgtttggttttttttttttttgagacagagtctcgcctgtcgcccaggctggattgcagtggcccgatcttggctcagtgcaacctccaccttcctagttcaagtgattgtcctgcctcagcctcctgagtagttgggactacaggcgcatgcagccatacccggttactttttgtatttttagtagagatggggtttcaccatgttggacaggctggtctcaccctggcctcaggcaatccacccaccgtggcctcccaaagtgctgatattacaggcgtgagccactgtgccttgcccgtaaatctctttttctgtctcctttactcactataccaggcatcacagattcagatgactcgaaggtcaggcaggtagctgaagagggtcaggtagctcaatagtcgtagcaccatggcagtctggaaaggcttgcctccgtttagccttagttaagaggcacgtagtctaagtgttgccaaaatgtccagtttttaaaaagaatctggaaatccacattttatgtaaaaattcggtggaattttgaacattggcattcagtttacattttctgaaaatgctgtgtggaccaaggaaactatatccgtaggtcttgggcagccctgggccccacaggccatcatgctatctgtctcttttattagtttatctatgtagaatgtattctgaaacatcttggcattccctcaaattataatggaccaactttttttttccatttaactaacaatgaggctttgctatatcctaagtacttcattttattctggtagtaaaaaatatttgaaaatagctagcttggaaaaatatatcatccttttcatttaattcagctgctttgccgcttgtcttcaattggaaagtttagttgaaaacaggtgagtctgaataagcccagctcataggggagataggggacaaataagattaactaggggtaagggatgttgcatctgaggtccagagtactgagggagtttaggaaaaggttttggagaggaggtggcacttaaggtgtctctagagggaaacagtcttaagttccacaagaacagagcaatagaacatatggggaagtcggtgtgtctggataatattaatagtaagctaaggggccctgaaggaagccttgctggcaagcctggaaatggaggcttggagtatttgatttgataagcagtgaaaagggagtgatacagcctgtataccttccccagtgctgagatttttctgatactgtgatgcctgttcaaataaagcaagtgcatcttttgctggtacttgatgtttttgttctaagagcttcagttatcattatgaaaatgaactttttgagggctggaatgaagaaattataggtgtttagtaaatgaactgaaaatgaaagagcatgagtgaaaagtaaatgagaagtagattgactcagaatgccaacattgacctgaaagaaggtagggtaccagcagtttggatggggtgatacttttttttttttttaaatttctgcgatacatgtgcagaacatgcaggtttgttacataggtatacacgtgccatggtggtttgctgcacccatcaacccgtcatctacattaggtatttctcctaatgctatcccttccctaatctcccactccctgacaggccctggtgtgtgatgttcccttccctgtgtccatgtgttttcattgttcaactcccacttatgaatgagaacatgcagcatttggttttctgttcctgtgttagtttgctgaaaatgatggtttccagcttcatccatgtccctgcaaaggacatgagtgcatcctttttctatggctgcatagtgttccatggtgtatctgtgccacattttcttcatccagtctatcactgatgggcatttgagttggtttcaagtctt

SEQ ID NO: 80692 - DNA, 2706 bp, Homo sapiens
attcattgagtttttgaaggatttttcttgtctctatctccttcagttctggtctgatcttagttatttcttgccttctgctagcttttgaatttgtttgctcttgcttctctagttcttttaattgtgatgttagggtgtcaattttagatctttcctgctttctcctgtgtgcatttagtgctataaatttccctgtaaacactgctttagctgtgtcccagagattctggtacattgtgtccttgttctcattggtttcaaagaacctctttatttctgcctttattttgttatttgcccagtagtcattcagtagcaggttgttcagtttccatgtagttgtgtggttttgagtgagtttcttaatcctgagttctaatttgattgcactatggactgggtgatacttcaagggactatgcagaagcactgatggattcatgggatccaattccaattttttttttttctttgcagaatgttcgcatcttaccacatacagttctttacatggctgattcagaaactttcattagtctggaagagtgtcgtggccataagagaggtaaatatcaaaagaaaagcttttgcttctgtttttttatcatgtgccttccgttcggagttcaatattatacttgtcctgagagttaactgactttctgaggctctgggactgccacctgtagtatgcatcaatatatctatctttgaaccttgaggaaccctttctgcttcagattgatttctaaaccttgtagtgcaattgaaacaaattcgttagaaaggtgttgttctcaatttgagatgctttaattctccaggcactttttattattaaaacaggttgtatgacttggctattcaggccttttactgtattggaacatgaggtcccatttactaaagttatgtagagaaatggtgcatttttggcttgctgagggaaaaggcagaatgggtatccaagatgcgcacactcaggtcccaagttagacttagataatggattctcattgtctaatttgatccaggtgactgttgatgcaaatagtagttatactgcaatatcagctgaacagaaaggtacaatagcaagtctaaaattcagctgttactgctaaatttgacatcactggggcaaaagcaatatatgaacagaggggaaaggcagactagtggtgcaaaagatcagatttataatttaaaagccaggaccaaaacaggtaaagtgtttgttttaatcaatgcttttagacctttatttagagcattctcgtgttaaatgacttaaatatttccagtatttgcttttttactttttcattctcagatttgactttaaatggatgatatttatcattttgctactgtatttttacagcaaggaaaagaactagtatggaaacagcacttgcccttgagaagctattccccaaacaatgccaagtccttgggattgtgaccccaggaattgtaggtgagataaattagcaacttgatgatttcttccttgcattaatgtggggtcctttggattggtgagttatttttagcttagaaccacatttctatttctgtccatctaaaatacaataaagtcagtcatatttaccatggcattatatttgccttatattaatgtttattaagttattgtacttctcatctcaaggttacctgtataaatatccagtagtcattcataagaggggaatgatctcattctgccttcctccaaattaggaagtatttgtgggcattttcagagttttgtcagttcaagcagtattgtgtttggtgggtaggggtgagatggggctgggattaggagcaaagctgggccttactaggagacttctgtttctctgctttggtaccactcttcaatgtttacagcatgaggttgtgcccctttccatgcttgattgctgctggtgaatttttgctggtttttattatttttgattcttttctgtagttaactgggggaggagagattctgttgaggcagtaatggtgcaatggttagatacctggattcgaatgccggctgtaccgcttagtatctgtatgactttgagcaagttacctaacttcatggggcttcactgtcctcatcaaggaagtggggatgatgacagtagtaccttccttggagggttgtgagaattaaatgagttaacacttgtaaagcatttacaatagagatacacaaagcagtaagtaaatgttagctgtcatttatgtattgtttttgagatggagtttcactcttgtcaccaaggttggagtgcaatggcgtgatctctactcactgcgacttctgcctcctggattcaagcaattctcctgcctcagcctcccaagtagctgggatcacaggcgcccgccaccaccacacctggctaatttttgtatttttagtagaaaccgggtttcaccatgttggccaggctggtctcaaattcctgacctcaggtgatccaccgcctcagcctcccaaagtgctgggattacaggcatgagccactgcacctggctgctgttatgtttttttgttccaactcagtagtactctactgagaattgtcatttttaatcttcactgaaagatttttgatctgaatttgagtcttatacagtgaggtaaaaagaattttacatgtttacaaatgaatattatttgttcagttgctctag

SEQ ID NO: 80693 - DNA, 1789 bp, Homo sapiens
ttagggtaaacttttaaaaattggaattgctgtgaaagtgtatttactacccccccaactttttaatttgaaaaatatggagaagttgaaagaataatagaacagcatgataaatacccatataccctttatctagtttagcagttgaaaaaattttgcaacatttattttttctcactttgcttataaaaaatttctttctgaaccatttgaaagttaaatggcaaacatcatgacactacaccctaaaactgtcaaagctgaaaaacttttactcagatagtggcttgttagcttaatgattatcttagtgacctaaactgtagttatctagtttttactgactctattggtgaaactgtttaactttttctctagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtaagttacttttatttatcattaactgctcattttattgattaattttgttttctttttaattctggctagttggtggatattaggttcctttgggagaatctgaattaagtacacctgtcactggagatgtggctaattcaaacaggtgattcacagaggccagtgtgatacatgtttggtagaattgatttactttttaaattattttacttgcattaaagcccaagagaaccagagatgaaaaatttttcataaatactctgttgatgataaacttgtttgtatttagttctgaattttaaggaattcttgctctaatagtttatttcattttgctctatttttgttttgttaaccttttttattctagtaacaagcattttagaagtttttagaatacgcgggttagttctttgtgaactaattagaaagatgggaacaagtaaagtgaccctgatgagtcttaggaaatatatgagttaaggcaagtctatcaagcaaggggtgtgctgggaaacatcctgcaggtagtgtggatggagccctgaagtgaatttgaagaggtaaagggttggcttaatgtctaagcttggatgggaaagcttaacttaatatagtaaacaacaaacgaattactcaaggaaagcagcgtttagccttttatctacatctgcagatggactgattgaattcacttcattcattaaaaatcactgttggcataaaaactattcagtggtaacacctcatttttgcatagatcagccagcctatagagataaacctctgttatttgaaatgggacttaaaccagctggagtaaaaaattgtgtagcagcaaaggtaaaatttgttttactgatgaggaaaaaaagggggtatacacattgagactagtttttacaactatccctgacaatgtggaaaaaaaaaaaaaacttgcaagtcattggtggatgggaggggaagcacagaacaagaggcattagcagcaaagactcagccgggaacctcttaataatgtggaagagggtggtcaggtcaaagtagatggtggaaagtctcaacagccagctctggtgtgacacagggtagtgtagctattaagaatgctgacttagaaatgaaatcagtatgttgaagagatatctgcactcccatgtttattgcagcactgttcacaatagctaggatatggaattaacctaagtgtccattagctgatggtggataaagaaaatgt

SEQ ID NO: 80694 - DNA, 1021 bp, Homo sapiens
agggggcactgttcaccacactataagtggttagcgccttttctctcctttaaaaaataaaaaatctgtaaattctcactgctgctagcacagctctgtgtaaaccagtgtttttttttttttgttccctactgagagccagcttgcaccttggtctaccaagagttgctgctcagtacatagctgcttcattatttgtgttgattgcattatttattaacacaaatagccatttagtttttttaatagaaaaaataattaagattttgcataatgtttgtaaaaaatggaaaacttgatacagagatcgaagaggatataaaataagataaaaaataaaaaatggaaaatttgatagcttaagccactaaattgcccttaaggtggagtgcaagtcagtaacatttcattttgcagcatgtataaaataatttctgttttaaggctgtctttaactgttgctcttcatttctctgcaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagtatgtcttgtgtgcttctgatttcgtctgtgaatgaagggaaatggtctcaggttttgtcactttggggttaacaatttaaaaaacgtgtttaaagaattattaagataatagttcattccattttgtagtagacattggctaaggggcttactgaacataattctgcttacggttgaataattacatttttatatatattgtccttcaagaacttccttgagtcacattctccttaaaatttgacattgcctgttgatctttcctttgacagatgtggtactctgtgtgacctcaatgtgtcacctcctttctagtttcctcctttaaaggaaacacatggttagagtgtatctttatggcaaaacttctcaga

SEQ ID NO: 80695 - DNA, 2005 bp, Homo sapiens
gctgcagtgagctatgattgtgccactgcacttcagcctagctaacagagaaccctatctctaaaaaaataaaatcaccctccattattatatttttaatatacatctttcagaatttgacagctgaagtcggggggaagagatgttaatgtaaacaatagcagaaggcttcgtttagtggatatctttgtgtatattaataaaattataacattccttttaaggaagtcagaaaggtaaggaaactgtactttctaataaccggatatgggtttcagaaatcgttatggatgtgcattgcccctttgtatttgtgactgaaaaaaatggtggcttctcttgatctgccttgtgcattttttatgtattaattttgatttttgaccctattttactcacctatgagggtgagcctcagattaaccataggctgctaaaggcagcagcctcccgtcagtgaatcaggaggattttgcttctatacttaaaaattttaatgtttcatgagatattgccacttttctaaattttccaggaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggg

SEQ ID NO: 80696 - DNA, 1047 bp, Homo sapiens
cactgtatatgccgcccacccattagctacttagtagccatctcattatcagagctcctgttgcagtatcacagtgcttgtgttcaaataacccttattttacttaataatggccccaaagtgcaggagtagtgatgctgtcatattgttataattgttctactttattattagttattgctaatcttactgtgtccaatttataaactttatcataggtacaggaaaaatagtatatttaggttttgtgctgtctgtgatttcaggcatccactggggtcttggaatgtatcccccatggagaagaggggactactgtacttaatgctactgaacttaaaaatggttaaaatggtaaattttgttaagtatatttcacaataaaaagtcagtcagcctgaaagagatgccattattaaataatgctatcagttgatgtgttttattgtgctcagaattatcacttatcaggagggataatctgttcccatactttactcctgtacatgagtaaaagcatgtcttttgtttgttaggtttgtagatctttgctatatttgtaatgtctggagccacattaatttttaaagtgcttgatggttaaataaccatgaagaaattctcagagaatacaggagttcgagaccagcctggccaacatggtgaaaccctgtctctactaaaaatacaaaaatgaaccgggcatagtggcgggcgcctgtaatcccagctactcaggaggctaaggcaggacaatagcttgaacccgagcggaggttgcagtgagctgagattgtgcctctgcctgggtgacaaagtgagattccacaaaaaaaataaaataaaaataaatgataaaaaatatatatatcagagaatggaaagattttaaatttatcgtggtgttaactggaaaggttaatgctaggggccaaatctgatataaacaagtttgggaatagaatcctgccattagatcttgaatgcacaagtaccatgcttgtaattcatcaacagcattttccccaaaaggtttgcctcttgatt

SEQ ID NO: 80697 - DNA, 1050 bp, Homo sapiens
accagttttttccagttcacagtccagtaatgtttcttgaagctaaatggtgctctgtttgtttacatgactaaaaactgagttattttattcatgtgaaaggtctcctatgttgtaacaacttccttgaatgccacagaatcgaatgaatgtatttcatgtcaatgtactaaacgtagcttctgtgtttgggagcagataattggtggtattcagccagaaaaccaatttgtataacttagattctgaatttcagaatttctcacctagtggagtatttgtacctgttccagcatccatcttcaattccaggaaaacatgggtgatcctttattgcttggtattcacctcattaggtggcacaactgtttgctaaaacagtttgtgcagaagtaaggtccagaagtaatttagcaagagagttacttacataaagactgagagctacgtagttctgggtaaatgctggtgcaacatgacctctttgtgttttgtataaatgctgtgctagtactaccagttgtctatatccacttaatccacccttacttttgaaggagtcgattaattctgtttgcctgaaatttgataattgtatcatcaatgaagtcataacattttcataaatgagctagagctttaaaagtagaatccttgtacacagtcattggtaggcagtgtttacttttttgtttggtaaatatctgaaattttaaaattcatttttaggttagccagtcctacttcctggatagtaatgtaatatttaaatttgtctttgcctttccctaggttctgttttgacctaacaatgataagattgtttatcctttgaatttgcttaaaattaccatcaggtttctactttcccacaagagcatgtgattgctttatcccagctgtaagataatagaacaacctagtgttgcttggtttactttgtatgcctttttctatttgcataaaccctgatctgattacaaacttgtatttacaccattcccttgactccttccaactcaaagtatttattgtccagttaaaacattt

SEQ ID NO: 80698 - DNA, 1091 bp, Homo sapiens
atttacaaataggtatgaaactagtcggtatccacagggcaatctgttttattatactggacaaaattcatttgcattagcataagttttctacaatttacagagttgtaaaatagctcgaagacaatgaaaatcacaggtatttatagaatcagataacccagaaaggtgcatttgacaggacacctggtcatctttttctattgtctgcttcagtctttctctggagaacaatccaggaagcaatccttgacttcttggcccacttagacacaaggtcagccaggccctaatctttcaacatttcagctggaacttacgagattctttgagcaagcatgggggcaaggagtttgtcttcacctatccctgcatccttagctaggtgaggccttttcttgctgtctcactttcctccatgcatcttgtgacccatccagaggatcacttcagagccaaacattgcacagtgtggaggtgggactctgatgggagaaggtttaacttggcaaagaattaccattggaataattatcgagagtgacctggtaaggtctggtttcaccagggccctccctgagggtcattcccaaccagtaactgcccatagagccacaggctcagacctgggacggtccctgctgcctaggccaaggcccagctctgtaccctgtccacaatagtagcacccccagtcttcgataggtggaattatcatttgtcaggtgataaaacaaagactgaaatctatttaagagaagcagtttaggagtacaaacatagaatatatgaaaagctagttatatgaaagtaaaatgataaaggttgagtttcacttataatttgaaaaccaacatttattgtgcttcttcattggacgtgttgtctcaattgtattttggtctctcagcaattttgctggaccttgctatgtgtttcactaaactcacttttcaaaaggagttgtcaggattttatgaattgttttattaaccccagaaatttttaaggctttcttaagatcaaatggttaagatagactggctcgtggcactcttattagataagagttctgcattttcatctgtaaa

SEQ ID NO: 80699 - DNA, 1146 bp, Homo sapiens
ttggcactttttccaattttgtgaccaaatctcttctttgctactctaagaaattttatgtcaggaactattatctagtttcctgacctttcaaaagtgtgttcttttgtatctctttatttcactgtcttctatagctaaacacacatgctctattaaaaagcaaggctcatttgtttaataatgtgaataactgagcttcaaactcttgtagttaaaagattcatactactcaatgaagttggtatatctagggaataaatagccccaatgagtactgtgtgaccatggtattatcacaatctgaggtctcccctcagtgtagattgttaagagttaaatgaagtacattgtgagggatctcatctctcacagcagatacacattgattaggcttacagagctagtgtctaaagtaagcattcttatttatttattgagacgtggcctcgttatgttgcccaggctggatacttcaatttgttaatgtatgatgatatataactgacacaggcttgagttgatgtgagccaggcattctttttctctgtagactgacatgtatgggaagccaaatttgtaatcagaatattttaatggatatagagaaaacaagaaaacaacaagaattatataatatgaaagtctacctgtaattagtctgatgcatttatttccacaagagagataatctgacttagaactgtaatgcatgaagtcttctggctacaataccctctctacttaacagtgcttagataggcactgccgatgtttgcctctgtgcctctcctttctgtgagtgtcccttgccaaccaactcctcagactgacagctctttctttagatatgttaatgcatattcagctagtctctattatttaaaggaactttgctttattctactctgatccattgactttataattcaatttgcattatataatcttatttccttcagctctaagtattagacatcacatcagtttcccacttgtacttaatacacaacctaaatatagttgaggtgtgatatagtttggatatgtatcctctctccaaatctcatgttgaagtatgatccctagtgtttggggcgggggggcctagtgggaggtgtttggatcatgagggcagacccttta

SEQ ID NO: 80700 - DNA, 1013 bp, Homo sapiens
ctaaaaattttatagtttgttgttcagttttagatttaaacattttttcattatgatttcttctgtaacctataggtgttttcctatccttttatatttatatccgatttaatggcattgtggacagagtacttggtccgttaagctatgcacttaatatctatctgtatactagctatctgttatacctcactgaataagttgaaagaaagaactaagaatgctggaatttggagattcattaaaatggaaagaaacctaggttgtcatcctgcttttgtacgttggatagatgcgtttttagtgtattttcaaaaagttaccaatgatagagaatggccaagtttgctggcaacccacaccaggtgtaaaaatgtgtatagtttcttcctaatatcagaatgtaaaagtagtaattgggagtagctgaaaccatgccacatgggttcatgatggatagcaaggtcaccacattgcacaacagcaggaggctctgtggcttggcaccctctttgcaacgtgaatgtgtattctggagttgctaaacaccctggaaggaagtgaagtaggggagtggggtagggaacaaaagggcgactgagaaaaaaggataaaaaaaatagtgactgcaggttcagtaacattgaatggcagatatatttaaaatcatattttataaaaataattgttttccaattatcttaggagcacacctctaatgtagccctgtaggctgtaatagcaatagctaagagtgataagctcattttccatcccacttcatactgttttctgtatttcctgtttctattatgacatctcaaccatcttgtcactgagaaaccccagacttatatttgactctttattgccctcttgtccagttgtcaaatcatatttctacctttgctgtatctctcatctctctagtcctttctgttcttactatcaatatactagctcagagtttcttaactccttgctttgtctatagaaatagtccctaaccaatt

SEQ ID NO: 80701 - DNA, 1029 bp, Homo sapiens
caacaaatcactatggtatccttgaatctttccagcttcccacactttttgtttttgttagtccttactgttctctgtagtgagcaatgaaacctctaaaatgcaaaagctttatgtgttgtttgggggaacagcaagaaagtagagaagaatcgggaaagatctggcttactcttgagccggtgttgggaagagaggaacctgtaaagatggggaaaaagtcacctgagggttgggatgtgtgacgaggcagcaaatggtacgtggggagatggcctgggatggagaagagatctgtgtgggttcccttgtaatgggaatgcataatgtttttgaagaacttccaaaggagactctggattccttcagccatccatcaactctcccagtggcctgagtcactagaaaggaaaaggagcctacggtcattcctactggctttttacacagacaggtgaatccttgcactgcctgcattattagcctgttgcattttttaaacattaaatacctgttggtgtcatccctgtttgagccagggtctgagagttcactgccaaagcacttaccccatgtgtctgagaagcatcacagcctgagatgtctttggtgtaagcagtcccaggaaggactccacatatatctttcattcatctattgtttgcagtagttcttgggccgtagcaaaatcataggcactttgaggactgattcatctgcagaacactttagaatggactacactgggatgctaaagggagttcatggttatggaaagaagcctgggagaaactgctcctcagccacaaaggcctcctctcctcctcccggatggctttaattgctgccctaggcagtctgaattacccgccaggagaggatttccccttcaaaaaacacagcctccctaaaactgcttttgatttgtaatagaaactacttagtagctaggacagaggctgataactcctattcccagaactcattaaaacaaggaattttaataagtatttttgccctttgcagccc

SEQ ID NO: 80702 - DNA, 1103 bp, Homo sapiens
cccagggcctggcatggtgccagcagacttgggccccagtttcagggcctgtcattagagttcaacctcagaaagtttcttcaatctctctgagcctcaggttcttcaactgtaaaatggggttagtgatacctgcctcacagtgtcgctggaagggttaaaggagcccatgtgagtaggggccttggcccagtgtccagtgatggatgctatggcagtgctgctggtgacgcctcaggttagccactcttgccctttgcaaaagcttccccttggtaggtcttctaattacaccgcaagagtgactcagttggatgttgccacctttagcacttttttaacaactgttcatcaccccatgaatcaggagggtgctctttgccagcacgtggtaatttccttccctttcttccaattcagccatctttcccaagtggctccatgcccaggcctgtgggattctaatggggctcaggcctgctcgttgttcttgaggaccagcctgggaggcaggcagggaagcagatgctgaccaagccagggacatggtgcactgtcaggtgagtccaggggggccacaggagctccaaggacacccagcctagtggtgaggacaggcaggacactgtcacggtgagcataacccagaccaaggtagaggggagaaagaacaggctggacagaggcatgggaggacagccagaggggcaagcaagccagctcacgaaggggctgagtcacactcaatgttctcttgaggcaatgggagcccttaaaaaaaattatgtcttcttgccgggcgcagtggctcacacctgtaatcccagcactttgggaggctgaggcgggcggatcacgaggtcaggagatcgagaccatcctggctaacacggtgaaaccccgtctctactacaaatacaaaaaattagccaggtgtggtggcaggtgcctgtagtcccagctactcaggaggctgaggcaggagaatggcaatgaagccgggaggtggagtttgcaatgaaccgagatcgcaccactgcactccagcctgggcaacagagcaagactgcgtctcaaaaaaaaaaaaaaaaaattatgtcttc

SEQ ID NO: 80703 - DNA, 1080 bp, Homo sapiens
ctgtaatcccaaggcactgtaatcccagcgctttgggaggccaaggcaggaggatcacttgagtccaggagttggagagtggcctgggcaacacagtgagaaccccatctctccaaaaaatgaaagaattatctgagcatggtggtacacccctgtggtcccagctactcaggaggctgaggtgggaggatcacttgagcccaggagatcaaggcttctgtgagctgattgtaccactgcactccagcctgagcaacacaatgagaccctgtctcaaagtaataatgataataacaattgttatatagtataatgaaaaagctttcggatgattaaactcccagatgtctgactaagtggcctctagaagaataatttaccatcaataactaaacaaatctctgcttatcgccgtgaagcaggttacacattcccaaaagagaaacacgccaatgcaaatcaacacctgcaattcagaatgtttgttcttgtgcctttggatttgaggctcacgtttgaaacttgtttattgtctctgactatgcatcttaatgtgtgtagcatgtttctctggattagcagttacctggactataccatgttccaatcttagacattctggcatcttctgcacatctctctgaggaacccctctaagggaaatacacagatgttggatatcctgtagcctgtattttaagtcaggctacatcaaaatacttaatgtattttttaataccagctgttttcacaacatacaatgccaggtaggtagaaacttaattttacttctagagatttgaattatttttagtccacaatctattaaaataatactacattagagtctaactgcagtggtgttagaagcatctgtggggaataccaaactatttgtactgataaactatctgatattaataaaagaatgatttgaatgatagcttttcctttttttttttttgagacagagtctcactctgtcacccatgctaacatacggtgcacaatcttggctcactgcaacctccacctcccagagttgagcgattctcctgtctgagcctcccaaacagctgg

SEQ ID NO: 80704 - DNA, 1041 bp, Homo sapiens
aaccatgaggaattagactaagatattagtctaattgcctgtacatgttttttaaaaaggagggaaaaagcctctcttcctgagagagctatcagagcctcagagcagccgccaaaatccctatacttgttctgggttattgtttcagtgcttttatgtttattcagaggaccatgtttgcaagacagtaaaataaagtcctgttggtcatgtggatccatttggaccatttattgtgatcagaaaggtagaaatggccctggagcaactgccttcagtttgttttggcccagaatctcttatttccttagtgacacttatggttaaagtcaatggaattcatttttggggacacagggggttttaagtaatttcatttatattatgtttatgtttactgccagagtgaatcaacatttttattagcattttataatgcacatggagcttttaagacttgaatttgctgtagacatgtatgacagaaagactcgtttacaggactactggtcttttccaatgcttgctttgagaatatacctaaaagagtggtgtctagctaaatagcttgctttaaaaatctttatgttagaatttgtttgccgggtttttctgaatatgaatgttagtatattttgattaacagtttaacaaatgtccctttatgaatgaaatgctagtcagaataaactgaggtgaccttaaaattacctattgaaggctgggcgccgtggctcatgccagtaatcccagcactttgggaggccgaggtgggtggatcacaaggtcaggagttcgagaccagcctggccaacatagtgaaaccccatctctactaaaaatacaaaaattagctgggtggggtggcatacacctgtagtcccagctgctcgggaggccgaggcgggagaatcgcttgaacctgggaggtggaggttgcagtgagccaagactgtgccattgcactccagcctgggtgacagagtgagactccatctcaaaaaaaaaaaaaaaaaaaaaagcctattgaattacttctaa

SEQ ID NO: 80705 - DNA, 1555 bp, Homo sapiens
gaaattactccattgtttcaccataggtattatgttggctgtctgtttttagtggataccctttatcagattttaaaaagttccctacaataggcagtgtcatagaatagttaagaatccagactttctagccaggttgccaggattcagcccttggtgttgccacttgctggctgtgtgactttggacaaatcacttaacccctctgtagcacagttttctcaactatacaatggtgataataataattcatacttcatactgtagtattaaagattaaatgattttaaagattaatatgtaaaacaggcttaaatgagttaatatttatataacacttaaaaactgtgcctggtatatagtaagtgctgtgtattagccatttttacagtactgtcataaatccttgttttctaagagattttgttttattttgttttgaaattatgaacaggtattgaattcttatttctttacctgaggtttgacacacttactggattttgttagcacattaatatttgttgaacttaatagagtctcagatttacgctacaactagcatttaatttctatggccttttaaaggttggcgtatttggtggtagtttccatttaatacttatttctagattgccttctattagcttttttgatggtgctgaccttaccttcctaaccacctgaacatataagcatattgcaattattaaagaatctgttttctaatgccagggaaatgtgttcttacgcttagtgcaacttcttagtgggagtagattattttgtgtatattttggtattttactaacagaccaactgtccattcataatggtgagactaagtgaatagaagtcagtttaaagttaccaggtgaataagcagtttttgaaaaatgtatcaagataataaattttgtttctgggttctcttttgaaaattcactattgttgaaaagtctgtgtaggaacaaactttatagacttacttgtatacagctaggactgaatttatgggctgcctttctaacttgctaaaaagctgaagattgacagctgctttcatagtgctttatctagcttggcttttaactccaagagaactgtgttcacaaattgatgctctgttcctttggggttggtatagaagcattaaattgtactaaaatattcatatgtgagtgcatttagctgaaagcaattgatgttttgttcccaagaggacagagagaaatgctgtatggacctgtactccagaaaaaaccctaagcatgcttcttaaaggtaattacatggcctggattatcaaagcccatacagtgaagtttaaaacgacaaagaagaagttgtagaatttataaactgtggtttgtatatataaattatttggttgtacaatagttaaaaacttaattgccaaaaaactaggagttttaattatatctttggtttgtcttctcagctaatttttactagactgattgctctaaacatttattccagaggtccaatatcagtgaagttctttatccattatcattttattatataaagt

SEQ ID NO: 80706 - DNA, 1045 bp, Homo sapiens
gtctcaaatcctcttaaaatcttagcacattcatacctgttctttatgacctattgtgttttcaagatattcctcctttagcatgcacagtagctacattcttcctaagttgttgcagctcatagttttgagttactgattgtattgtttttggagaaggaagctttgttcatattccttttagaggtgtagtgtaccttcttagtgtggatgcctgttcgagtttcttccttctaggtgtggtagtacctgtcctgcttttaaagacatccagggttatacagatatctgctgatatgtttcttcaccgttatggttcattttttcctatacttaatagagttagaagacaactggtcaatagttatttcttgccttgtctgtgaagtaaattccaagcatcaaaggagtgctagttttgttgccttttgctgttgcttttaagaaatagattgtatgtttcaggaaatgctctatgtacagtgaagtgtgatgagaaagtgaaagtgttttctgtccgtggaacatcctttgatgctgcagcaacaagtggcggtagtgccagttcagaaaagggtgagtgttcatttggagtttttttgttttgtttcttacttttttaattcatagactgtattataataagagatgacctctgcctacatttctaatgaatagtatttgaaagttcaatttaaatgatattcccaagcttatacaaaaataataaatatgtataacttacatctttttcacattatctttggtactaggatagttgctttggtagatcaagggagtgggagacagaggatctattaagattaagcttttttactcttgtcactgtttcctattatatttgggtgattcagtataacagaagaatgtaataggaaacgtgtggagggtgtcacactttaacatatatagtgtcttatttgaacctcatagaaagaaagttattctatattcagactcagagaattgaatgatttctggagtcatacagctaatgtggcaaaggctggaatctagtctcctt

SEQ ID NO: 80707 - DNA, 1024 bp, Homo sapiens
acaagcaaaaacaatgtcaaaaatgaggctgatgctgggcacagtgtcatgtgcctgtagtcacagctactcatgtggctgaggcaggaggatcacttgagtccaggagaccagcctgagcaacatagcaagcaagacccagtctcaaacaaatacccacccccacaagaaaaaaaaaaaaacaactattgaggttgaaaaagagaaggaccaaaatgtgttcattggacttagccataatgaagtttttggtgactttggaaagattggattcagtgttgtgaaggtgaaagccagtttgcatgagtaactgaaaaaatggaaggtgaggtaataagagttggtgtctgtggaaattattttcaagaaatttagctttgaaagggtgcagagagggtgataacctctttaaatcctgcccacaagaagtatactatcttataaaggccagtcaactttatatgggtatgtggctggcatgagaaagaaaacttcatattttgctatttgcaaccaagtctaaacagagtatagagaacttctctaaaagcatgatggtgtgtctgttttagtgatgtaacagtttatgtactgtttagttacccttatacatgtttagttgattacattatcaatgaggaaacagttgctttttagtttttgataattttaagaaaagttttcatttagttactattcattgagtgccaactgtgtgccagagaggtagataccaagttcacagtggagaacaagacagacctagtccctgcccttgtgatgcaaacagattaaggaagaaacacattattttaagtgtggtcattgttacagaacatagagggtgtttgggagaggtttaatcttgttagaggactggaaaacactgaaaggatatctgtgaaattatgtttgcacactgaggtgccttaaactattgttactgagtgataaagtaatagagcggaggattttctttctttctttctttcttttttttttttgagacagagtctcactgttg

SEQ ID NO: 80708 - DNA, 1045 bp, Homo sapiens
tctcccacctcagcttcccgagaagctgggatcacaggtgcgcatcatcacgcctggctaattttttttttttttttttttttttttttgtagagacggggtttccccatgttacccaggctggtctcgaactcttgtcctcaagtgatccacctgcctcggcctcccaaagtcctggaattacaggcctgagctaccgcacctggccttagacatcttttttcttgtgcgtattccttgtttaataaaaagttctgaccctcccctcccctaaagagttcaaacccatgtctttcaggttagtgtcctgtcttcccctcaggacatgttttctcccggttggggatctagacataaacaagtgaaaatcatgaatttggggaaattccaggaacctgagccagaagaatgctgctctatgcagcagttggaaaacagttttgtggacagattacaagtctggcctaagtgaaattataattgtggtgggggatggaatttaggactcagtaattttgtagagctaacagaaaaaaatggaatgattaagtaatttttactatccacatcgttggctaatgtgtatagacattacttccagatattcattgtggtttgccaaagactttgaccttgacttatttttaaaatttgaagtcaagctaagtagaatagctgttttttttgtttgtttgtttgtttgttttgagacggagtctcgctctgtcgcccaggctggagtgcagtggcgcgatctcagctcactgcaagctccgcctcccgggttcacgccattctcctgcctcagcctcctgagtagctgggactacaggtacccgccaccacgccccgctaatttttttgtatttttagtagagacgggggtttcactgtgttagccggtatggtctcgatctcctgacctcatgatccgcccgccttggcctcccaaagtgctgggattacaggcgtgagccaccgcgcccagcctagaatagctgttttaaagtcattaagaatgttggagagatttggatttctagca

SEQ ID NO: 80709 - DNA, 1326 bp, Homo sapiens
agctttgttattccatattcaaaacacaaagcctgatttctgttccacaatccattaaatattaaagtttgttgggaatactgccacagggactctgaatttcccagaattatgcagtctttcaatatgtattaaattttgtgtaaaaacttatagccataaactgtctatctctgggaatccctttccttcctcaattgcatagagctatccaaattaatagttaagtcttctgagaaaatcgtattctaaagtgaatctagctaaataactcccactttccacctatggcctcttttattgaattttttactatgcaattgggtatctcatattaaaagttcagtaagtataaaatacaacacttgtcattgttacaggtaatttaatttatggggaaatccctactgtattacaaaagatgtttaaagatgacttgggaacccgtaaaactgatatttattaatgtaactaaccaagcgtagatgtgacacctcactagggaccactgtaataaggcttcagagttgaatcctttccctggaaacccacatagaaaacgatgcacccctttgggtgggtagcaactatggaagagaaaagcttgtaatgttttgtacagtgatacagagagatgcaggaatcttaacacacaataaccacttttatctaggtaacttcccaatattcaaaaaagacagacacaatcatataaataacaaaaagaggaatttgatttttgattcatggatgatgaggaaagagataactaattagatgttgagataactaatgtagacgtttccattcatagcgttaaaacgctgcaatctgtcaaaagcaaaaattcagagctaattaaccattaatgaaattctttattcaataacctgttatttcctttttaaaaaaaatgagaaaacccaaatattctggataaatcaaaagtttttgacagtgagatttattcgaagttttagccccctatctaatggccagccagaaggtaaaaggagaaatctgtatttctgttgggaaggaatggtctaagttaaagaaaggaagcctcaaagaacccagacctgattattaaagccatttctgggcacttgagaggtaaagctggtcctcattaactctgcatatctcttcccttatctctaagtttgcagcagcatttcctatatcccaaagaaggggaatgttccctttaatatttgtgccagcatcaccttgacattcaggaagtaaaatataaatgcagctccattttcccacctcccattttctttcagtaattgccagcaagccttccatcatctgcaa

SEQ ID NO: 80710 - DNA, 1054 bp, Homo sapiens
cccgacttcagccttccaaatagctgggactacaggcgcgcaccactgtgcttgcctggttgctaatttttttctcattgtggagtccaaaaacatctttttgtaatttatataggggttaatgtctgaatatgttaaaggacaaactggattgtggttaaaatatatgtcatatattttatactacagatagattgatacatatagatcaatcaccttatttacctaaattgtgtcatggtttatttgaagtggatatctccattttatactcagatatcaaaataagtttaatttatgaatcttcaaagaatttaaccctcttttatttaacttttttctcttttatccccctctcagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacctgctctaaatttaactttttaaggtctacggtaaagatatttgcaacacttttgcattctgactacataatatgtttgggggctatttgaaatcaacttagggcgttgtattcattggtctgcccgaactctcctagcagataatcctctc

SEQ ID NO: 80711 - DNA, 1074 bp, Homo sapiens
ttactacaatacagtaatgctctctcaagaccaactgaaaagggttgagatacttttacaccaaatgattctaggcaactttttgaattctcatgtctgcttaaaataattttaattctcacgccttcacttactaatgtcagctggtgcttcttcctcttgtcaatttatttaaaccagcagtgtcttttctaattgctgatttcagtctactctaggccagaaagcccacttttattagacttgcttctgaaatgtgacttggtagattgagttggagcttggaagactttcttgtaagtaactggtgtggattttgtggaaaaactgggcactcggtgaaggcaagaatgtctctgatttgttcagtattccattcccagtgcctaacaccatgcttggctagagtagatgctcagcaaatatttgatgaatggactcatctctctgctgaaaggcccgcttgcttcttttcacgttcttgactgaattccatgtggtcacagttggaggaaaggtccctctgggtgagggaatcaggctgttttacatttatacaacgtgatagactctccatgggccctcctagccactccttggaattttatggagtgaatttgacagttgtcattttacaaatgtgaaatctgcaaactctctccaggagaatttgcatttttaatccagattcgtgatcactcactatcccacctccactttcctttttttttttttttaatttaaattttgggtaacaccaagtattaatattacaaatatatttgacataatagcatttctttcaaaaatataagaccagttttgcaaggcactcaaaacctgtcaaggctgctccagaaggcatccaaataaatggccatcctaagacagtactaatttagagtcatgtgttccaacagttcactcctgagaatctagtcccatcaccaacccttcctctctttcaagttcttacatctgataatttgagacaaacccttggcacagccagcacataaccaagaactggttatttgataccaagccaagaagagtataggtttttgaaaaaaa

SEQ ID NO: 80712 - DNA, 1048 bp, Homo sapiens
ctgacttggcaattaattctggctaaaaaggaaatatagtttccttgaaaattggtttaatttttatattcaaacttacatgccccttgacctgctcttatcagtgaaggttaaacagagggcactgggtcacagcatgctggacgtgactaattaaataaaggctgagctgagaaggtgtcactgcttgatttaaaggagcaaagtccttctgaagtctctttggggcttgaaaaacatttttttgttttggggctgtgaaacagacaaaaggcactcttaaaatttagcagtaattttgtttcaggaatgctcgctaaaatggctctgtttcacccactgttaagtgaagtgaattcattgaaacttccaaggtgcaacgtatccaacctggttcaagcccactaagacctcaaatcaagagatgagtttaaaactctgccttttcccacaggccagcagtggtgcttcattccagtgtgggctgcgagtatattctgtgggcttcgcctctcccctttgccctcctgtcgctctgtctgtttgacatgtttattaaatagaagctgcaggctgcacagacagactcagactctcttcttgagtcgcccaccgccgacagccctttgcctgtctggagaaaggatcccagaagtcccatagctgagggatttcatggttttagggagaattttttgttttgtttttttacattcttttgggagccttcggtttatagagctacttatttgaataataactagttgttatttacattttttgtttaaacataattagaaatatatgtttaactctgtgtacaagaaaatattttctccttcagaaaaaaaagtgttggaatttagctaaatggtagatttacaggtgaattttaggttctttatacttttccagattttctccagtaagaatatttgtatatgagaaaaattaagttattaaaaatagaataaataactgtgctttaggtagataatgtcttgatccacgtggtacaggcatttggtctactactgtcccttttcag

SEQ ID NO: 80713 - DNA, 1032 bp, Homo sapiens
acccaggatactaaacaaagtgaggttatgtaggctataaagtgtgggaagggtggttggcagcctcagcactggctgcagagtgctcagttgacactgctgcagcagcctggtcttccaggagaagaaaaagccacagtgcagttggtggggagggctgcatttattccttgaagtttcttgttaccatactatacaactcagatggtttgtttttaacggtctgcttgtcttgtttcatttaacctatacaaattgctaacatccattaagtagtttttctcaaagaactgaatgtttctttgtcaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcaggtaccaagtattggtttatatcgatgttaaccaatcaagagttagtattttagtgtagataggatgtcagattcttctcctgaattggggcataaggaataaactacaataaatggaattataatatatattataatttattaaactactattttctgggaactgtattagatgctctataacatctagcattctcatttattctcatagctaccatgcaaagtattattatacccattttacagatagagaagctgacagttaagtaatgtgcccaaggttacatgtttgtgaaccaggactagtaaccatgactctcccaccccaaagcctatgttcatcctttgccatgctgctatttataaatcttttgtctggaattctttatatcaggacattatcatctcatcaacttttaaatattaaggaaagtaatggtttcttacgtaaatagaaccaaaattagataaattgattgatatgac

SEQ ID NO: 80714 - DNA, 2117 bp, Homo sapiens
ggaaatatgagtttggtcctagacatgcctaagggttgttatatatgatataagattatcatatacatatacatatcatatacatatacatatatgtgtaaactttggtctacttggataatcttcaggcatgcctaggaccaaacttatatttccactaagaaaaactgcttatattctcaaacttggaaactatactgtctaccactcaaaattttatatttattatatatttatacatctgataaattacatgtttacacatctgatacattttatttaaaatttttaattactatataatttattttattatgtatatgaaatataattccttctgtgtacacatacaactggattttaaacagtgatttactcttgatggtttttaagaattcttaatctatttatctccattataatttccttctctaacctcaattgcttagcaaacttctgttagtaggacttactacaaaaacagattattctagaaagaaggtccaggtggtttcctggcttaatttacctaggaaattatttgcagtatcagtgtaagctacttctctgaaagagctgagaaaaatgaccccttattgttgttcttcctctcatccttcagtctcccaacatttcctgaacaccaccagaccacaggaatacagggagttttttctacctcctcagattcatttacttctgatatttacagattgttttctcctgcttatttcttcatgaaaattatatttctaagctataaatgacagtgacaagcattttgttgcatgcattaaatagagtttctgctataggtcatagccatgtctaagaggaaaggtagtgtggtttttgctttattggagtaattcacataatgtctattttggctaccagaagctagccagaaccagagtcaaggaaggctttgtcctcctagcccttttgtgacaggaatgaaagaggaagaggagctagagagggcttcaaaaattgcctcttgtgatggcagagcctgagataattaaggggactaattgatatctccaggctttgagtaaacactgcagtctgctggtggcccagcctttgtgatggtgattaccgctagtctgcctttgcactactctcctattgtgcccttaatcttctaatttttacctaggttttcttttcttttcttttctctttttttttttttttttgagacggagtctcgctctgtcgcccaggctggagtgcagtggcgccatctcggctcactgtaacctctgcttcctgggttcaagttattctcctgcctcagcctcccgaatagctgggattacaggcgcttgccaccatgcctggctaatttttgtatttttagtagagatggagtttcaccatgttggccaggctggtctcaaactcctgacctcagatgatccacctacctcagcctcccaaagtgttaggattataggcctgagccaccttactcagccaaatttttacctaggttttccgaaacacgatttggatgtcagaatttgtgctgttagtctttgtttcaacttgggatagaaaagcaatagctgatgacttgtaccaggcttagttttgaacaatgaacttgcatttctttaagtaaaaattgaaatcgtgatcctctgatgaaaggattgattttatgtcagaattgcttcagaattttaatattgttaacaaatgattcttaatcacttcagcaaaattcaatagtctgtaatgggactctcagaaatgcctatttctggccaggtgtggtggctcaggtaatcccagcactttgggaggccaaggcaggtggatcacctgaggtcagaagttcaagacgagactggccaacatggtgaaaccccatctctactaaaaatacaaaaattagctgagagtggtggcaggcacctgtaatcccagctgtttgggaggctgaggcaggagaattgcttgaacccaggaggcggaggttgcagcgagccgagatggcaccactgcactccagcctgggtaacagtgtgagactccatctcaaaaaaaatgaaatgcctatttctttggcctttactgttaacagttttctattcttggtccta

SEQ ID NO: 80715 - DNA, 1063 bp, Homo sapiens
gggtttcaccatgttgaccagcatgatctctgtctcctgatctcgtgatccacccacctcggcctcccaaagtgctgggattacaggcgtgagccactgtgcccggcccatttttcttttttatattattccttctgtttctataaaccaagaaaccacatcttgttacagttttatgaaattagaatctttagggtctggacaaaagcctgaggatgagcaaagcatcagtctgctcccttgactatgtatgtgttaggtactcaaatgttagatgagcaagtgtttaaataaatgacatcaattttattatctcagaagtcttttttatttcctgttgactctcaactgtatttttaaaagttccagttactggataaaaaaacttctagataaatgaaagattgctaaatatgacatgcatacatagtgttttatttgaaatacttcatgatgaaaaacagtacaaggttgttggagaaaaaggaatatgaaaatttgtgatgaatgaagaaccctgacattacctagaagtgtattactcatattctttgtgtagtgtgtaaaagaaaaagaaagttgtattttagaggatttattgagttaattttagaatatggccagttgaacacataaattacattctctctgtcgagaggccttactaatattctagtaaatagatgaaagttataaaccctcaaagaaagagcacaggaaggaaaggaaagcaagtattttttttttcaatctggaaagcacatgattgaaagacagttgcccaaactagcaaaacgccagaagaaaatttgtgccacagaatcctagcagggctcaagaattagagttactggctatctcagaaaatgagggtgcacgggggctgcaaagaggggaattggttgaaagtctaaataaaaggcagtttaggtgccctgggtgccttagaacctacctactatatgtatagccaagtgactgccattgcccaaccctcagagaagacaccagtttcaatcaaagttaaatagaacatggggacaaccaggcacagccatacaaa

SEQ ID NO: 80716 - DNA, 1077 bp, Homo sapiens
cccacacatatgtaggactgacttttcatatatgcagcttccacagagctgactgcaggacttgagaatatgcagatttgggtatacacagggagcactgaaccaatcgcctgtgtatactgagggacaactgtacaaacaatggaatattaatcaaccttaaaaaagaagggaattctgtcatatgctataatgtataaaccttgatgatgctataagtgaaataagccaattacaaaaacagaaatactgcatgattctacttaaatgacatatctaaaagaatcagcctcatagaaacaaagtagaatggtggttgccagggaccaaggggagggggaagcagagttgtttaataggtttagcgtttcagtcaagtgagatgaaaaagttctagagacccattttacaacaatgtgcatatagttaacaatattgtaatatgcacctaaaaattgataaagaaaatttatatgtctttttacaaaaaaaaaaaaaaaaaagaccagtgaaagtactactgagtgctgtgaaaatagatggataagcttttaatgttgggcaagatctaaacagtccaatatactgatgagcaaattgagatgtggaaaaggatcacagagctacctagtggcagaaccatgacctggaccctggtcttctgagtccctgaccaggacttcccttcctataagctaaattgatgtgtcctcattttcttaagttgacaaatgaaacaaagcaacaattttgtgactttaattttataagtttaatagtattactttggtaagatatactgaaaaagcacttaattaaaagatttataatttcttgatgtttcattgcattttaaaaggcattaaatattttattagcagtcttatttttaattcatagtgacctgttccttatgaaatatttaatgaatatgctgataaattgtgtgtatgtatttttgggagccaaggagattgttaattgaaaagtgatgtactaaccttaaataattgatatgatactgttgaatcagagaggctgctggtgagctcttcagaaggtgacaagaaagccctg

SEQ ID NO: 80717 - DNA, 1303 bp, Homo sapiens
agattttttcctacagagttgtttgagctcttatatattctggttgttaatcccttgtcagatagatagtttgtaaatattttctcccattctgtgggttgtctctttgcttggtggattgtttcctttgctgtgcagaagctttttaacttgatgtgatcccacttgtccatttttgctttggttgcctgtgcttgccatctaccaattttaagcttcatggaggacagcaaccatatgttttatgctcactccttttgacctatatttcctagtactgaaacaattagcagtgagtagcattcagcaaatatttataaaataatatttgtagaatagttgaaccatcagtatgtttcagactacagatatcatttggttatagtttaatgcctgggaaattgggctaacttctgtttgtatttctgtctagaatgtggcagatcagattgcatttcaagctgctggtggattaacagcccttgaacacatccttcaagcagtagtcccagccacaaatgtgaacacagttttaagaattcctcctaagtaagtatagtttcttaatctattttttacgtttcatttgtgagtcatttctgccctatggtttccatatggagaaccacaagaaaattgtatgtgtattcagggttgaataccaaaatcttacactccccattagggagaaaaacagaggtgctcaacgtcacttacgaaactcaaattgagcctaaaaagccttataaaggaaatctctttggtctgtgatgtgctctaatctgaaatcaagaagaattgatgaactcttgagcaattctaactgcttccaaaaattgagcaaaataaataatagtaacagaaagctaacttactgtgttacatgtgaaaaaagaggtgagtaagtacattagcaaaagtctgagctgtgaaattgcaagaagttcctaccatacaggaagagcagtcagaggcgaagagtgccatagtctagcatcccagccaaattgctgggaactgagttgcacgttggtctttaacggtaaattgctttcctgttctcttaagtccccctttagtccctggccacctggggtatagcagcaatgttgtttcagaagtattgtgttcctgggttgtaacgtctgcagtttctgggtattttgtggagactcttatttacagagtttaaataagaggttttaataaaagttcatttaggcagggcgcaatggctcacatctatgatcccagcactttgggaggtcaaggcaggaggatcacttgaggccagaagttcaag

SEQ ID NO: 80718 - DNA, 1050 bp, Homo sapiens
attctacctacatactgtgattaaccacccttccctaaaacagtgctaagaaaagttactcaaagctggtaaaatagcacacttccctcaagtatcggttttattaaaacatttcagggaacaaaaacattaaaaaaaaatttttataatcctaagtttttgtccatacctgtgcaaaagatactaaaaatatctcttgaagaaaggtagtatataaaatactttatggtaaaataatttttaaaggaaatttcaaccaggcatgtcaattattacaataggtaagaaatatcatgaaaatgatatttgagaaccagaagtaggaccattaattatttaatcttaattttaagtaaataaattataagctcttttggcccaacatgtgacattgagtgatgttatttctcagtaagcagatgtgcttattaaggtttctgcttatagcagcctgatagtattccatcatgctaactctctggctatattctactctaagctcaccttagtgattgattgcctcacgcagtgagtaaatacttactgtttttaaccacatttatgtaagtctgggttctcggaaataatgacactaaaaaaaaatgagagaaattgcccgtgtatggatcctgatgctagctgtcttcagttcagctcagttcttttaaattagtagactccatgacagataccctgtgtattaactaatgcaggtagaaaactcatttctccttaatataatacattattttctagttatgataaacatgggccatatggaaaaaattgagaagtcttgaaggtatttctttctagtgctaggtgtatatcccccagcactgcatccctgggaattcacttttctttgatactacaaagtcgtaaatggatacttggagaactgtactctagaataaattaaatcatttagcttattttctattccattcccaggaactatgaagaaacaggattgttgaaagtgatgatgtgggttggatttggatcatcattgggaaggtatttagggaagcagttaagagcagtgtt

SEQ ID NO: 80719 - DNA, 1044 bp, Homo sapiens
tagagctccaaaaggagaagagagaagtatttgaagtgataatcatttagaactttccaaaacttacaaatcaatttacagattcgagaagcccaatgatgcccaagcagggtaaataaaaagaaatccatgttcacaaacgtcacagtgaaactatagaaagtaaaattataaaccaatctcattcataaatgtggattcagaattcctaaacaaaattttagcaaactgaatcatgcaatatctaataaggataatatatcacaacaaagttggatttattcaagatatttaagtttgctttaacattggaaaattatgatctatcatattaacagaagaaaaggaaaaatatcatctcaaaagacacaacgaaagcgtttggtaagttcagcatcaattaatgataaagattcatagtaaaccaggaatagaatggaatttccttaatctgacaaattgaatctaccaaaaaaattatagcaaaataatatttactggtgaaatgttgaaaattttccctttgaaattgtgtacaacaaaaatatttactgtcaagacgtctgcttaaaatgggggttctaactagtggaaaaataaataaataaaagttgtaagatttgagagaaaaagtgaaatagtcattgttagcaaatgatatgttatatatagaaaatttaaaataatttacagataaatagcacaaataagttagattaacaagggtactagacaatgggcagtatataaaaatcaattatatttatatattatcaaaatattaaatatctaggagtaaatctataatgtttatggattggaaaactcactatagtatatttttcttttctacccagtttatttgtagattcagtgaaatctcatttaaaagtccaacactttgttctttggaaattctaaaacactatttagaatttctaaagaacaatatgtaggcgcagattctaaaatatggaatttcaaagatccaatgaaacagtatgcaaaaccctgttgaaaaagaacaatatgaccagcactttg

SEQ ID NO: 80720 - DNA, 1044 bp, Homo sapiens
tggtgcttccttgctgaagtttccccctcttccgcctagtgaacagtgatcttgtttccctcttcgggttcttaacggcactctaaatctctgattggcttggtattatagatgatattatagttttgtgaatatattttacctttcctactctacttgtgtgatatcttggtagggtttatgtccatgtagccttagcattggcacaattgatatgcaatgaagtgaagtcagtgatgtaaaatccttaagtaaaacagtttcttcaacgttttccataacaattgtagaaaccagtgtattacggagattacttttagtttcatcaaatgtcttaaactcactgtagtctatagcaatcctatattatatttaaatgatcatcctcattattattattttatttatttatcttgcaggagcatctttccttgaagaagtacattattgacattgtggttgaaagtacagctccagcagaagctttgaaagatggagaagagcggcaaaaaaataaaaaaaaagccaaaaagataaaagcccggatgaacttcaggtaccttaaatacccttaaaagcaaaagaaaaacttttagtgatgtatcttttaatgtaaatccaaggaagacaaaaaaagtttaaagttgtttgcttcatgaaagccttggaaataacactgatgagcctaatttatagccactttccttgattgagaaagaaaactgcatatcgatctaaagcccttgctttcacctgttaagagctcttcttataattggatgccaaagctctgccaaacttgtgcctcctccagcatacaatagtatgtttaagtatgtgtaaaccaagcctatttttctttccaactattgatttttaaatgaagtatcaaagaaaatcaatagcaatcaacaaatagaagtctactggctgtagtgtcaaatcccatgactaggcttaatcaatttggttgcctgtcacaacaagaaaaagttcaagaaatatcttaaaatggaaagtgagttgtcagacctgtagtttatc

SEQ ID NO: 80721 - DNA, 1024 bp, Homo sapiens
tgctgggattacaggcatgagccaccacactcacttctatttggaggttgtgggaataccttgtcacttagtatggttgtaaatatttttcatgggttttactttaatatctaattgctctttatgtttgtatatggagattcagagagttcaaaattctgctaccactgccaccatcttctcagaattttcttttataatctcaatctgttgcccagactggaatgcagtggtgcaatcacggctcactgttgcctcaacttcccagactcaggtgatcctcccacctcagcctcccatggagctgggaccgcaggtgcatgcccatgatgtcctgctaatattttgtgaagatggggtttttccatgttgcccaggttgatctcgaactcctgggctcgacgatccacccgcctctgcctcccaaagtgctgggattacagatatgagcccctgcaccaaacctttaataaggattttaatgactattacttcttcatagaaatataccataatttactaaaccactccctcagtgttgaaaaagcttctttttacatgctttccatcttcagaaaccatgtcaaaactttcttcctgtataacactgtaattattttaatggacagatagatgatttttactcttttatcatcaaaaggtgatctctctcttagaagaagcaaaagcataatgcaaaccattaaaaggtaatatgtaaagacttgaaatgtatttatagaaaactggacagaagaaacatcctaagtcacagaaaacaaaatgcagacaaatggtcaagcatactaataccaatatttcagttaactaatccagagatttagaaacaaaacaggaacaccacatactggcaaaccacttgcggggacataaattaattcccattttgattgttcaatttgagaatagttatcaaaagtcttaaaaatatgtataatctgtggcccaggtttttcatttctgtgatttgatcataaaggaataattgactatttgtttaaat

SEQ ID NO: 80722 - DNA, 1033 bp, Homo sapiens
aatataaatttcgcatgtttttatttcagtgagaaaaggttagaaggaaataataggattcacgcacttcggaagaaaaatgtgcaatattatctaatttttgtagccatagcagtcttatgtttagccattatggtttgagatttgattggtgtgttcattttgtgtactgtttcagtttgaaggaattaaattttcttaaagttctaacttaattcatgttgttattcttggttatagcctcttcttcctgaaaacaagtgtataatatagcatatgaattatgtgatataaaaaggttattttctactactctcatggaagtttcatttttttaatcagtagagggtatctatagtaaacatacttgttctacttaaagttattacttgtcatctatgatgtctttatattatatacaccttgtctgtgacctttcttctttgacatgtaagattttatttatattacctctgacctaataaaattgtacctttgaccttatgaacttaacatctcagataacttactcttgatctttgacacattttgttttaagcctgttaaacatagtaggtagctgctgagtaagaaggctttattgttttgtgtttttattgtaatttgactgggacatttttctactgtttcttgagacttaacaaaatggactgtgtttgaagtttatgtttgatttgtttcctcattcatcttagaattcaaatgattaaaaaagtgatttttaaaagtcaaaaatgggtagtagttttaaatacattctaaaatttaactttttacatgcattgctaaataaatcaatgaagtattatttttagtacttgatatctttgtggtcctgttttcacactatctaaagaagctgatagtatcttttctagaagttgcttgaagtagcaagcatgtagcaagcatgtagaatgaatttaaaaggttttttttccattttaaatcaatatatttctatgtttgtgagattcattagctttaaaagcatgtacattgtacaagctct

SEQ ID NO: 80723 - DNA, 1054 bp, Homo sapiens
accagcatccaggggcgtgaactgtcagatgaagaagtggtaaactttatttttgttcatttacaattgtttattgagtacccaatatgtgctgttttattataaagaattccgtgtttgtatttatttctatgattatttaaaactatatttagcacttaatagctactacaatatagtgtacaaatgtgtcattattttagtgtatatattaatttaacaagaaagatagaaaaaagaatttaatgctgttatttacataatttcagtataaggaaatgttatggtatattgatattttaataatgcaggaaaataatcactcaatgacatgccacattcttggaaaacagttaaccacataaatttcacttaagaggataattttggatcagtataccatttagaagcttttggaaattcattatttcttcacacataattattgtcaacatggaatttagatttgtataaatatgtatatgaatatttttcatttaactctttttgaaacttggatgatatagctaatctatgaatttattgtcctatttattatagtaaatttttaaaactactcaagaataagaaattcatatttgttaagcaactcaagctgtccaggaaaagttattgtgggttctttgagggcaggtacctttatgtaggtgcatgtgtatattgaacttttttttttttttaggtatggcattcattagtcaagagcataaatctcaagtatatagctgatgaatttttacatatgtataaactgatataaaaccacccagatcataatatagatcatttgttgtaccctttgggctcctcttatgccccctcctacttatgtccccaaaagttaactactgtgaatttttgtatcattatttagtgttgcctgttcttaaatttcatacaaatgttatcatacagtatgtattcttttctgcctgacttcatacattcatgcttaagcttgtgaaagtgatccctattgtttatgtgaagctgtagttattcttcttagctttatgtcagtgccctcctgtgt

SEQ ID NO: 80724 - DNA, 1079 bp, Homo sapiens
ttataggtttggtcatgatgggccttgcctgctgtatggataagcatatgctttacccgtaggttaacatttcccatggtgggttccaggaagtggttctcaaaaatgtgttattggcaaataatttgtaagttgatgcctactaaaagctaggtgcattgagtcatatatcacagtgacgtactggaggttctgtaaagttctacattaaaaacctgtttagttttagcttgctgttttccaaatttatttgaccatggaacctgttctgtaaaacacttgttaatatctcctggagcacactttaataaacattactgttcatgtgggtgatattaaagggctttgtgtaaagctttgtcttcagtgtgtaagttgtcatagaaacgacattctattatttttgaagttttaatggaaatattatttttccaatttctcaccataatttgaataatttttgaaattcttgcactttgacttcatctacagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctggtaggttgttatatcaatattgtaatgatatagtttactactaaagtttatgaaaccatggaaatatattcttgcagtcttttaaaactcacgctaaggcaggcgagatgtggcagctcacacctgtaatttcagcactttaggagactgaggtgggcggatcacttcaggccaagagtgcaaaaccagcctttccaacatggtgaaaccctgtctctactaaaaatacaaaaaattagctgggcatggtggtgcatgtctgtaatcccaggtactcgggaggctgaggcatgagaatcctttgaacccaggaggtggaggttgcagtgagccaagatcatgccactgcactccatcctgggtgacaaagcaagactctgtttcaaaaaataaaactcatgctaaggcatctgctgagtgacctggatttcttt

SEQ ID NO: 80725 - DNA, 2055 bp, Homo sapiens
agaaatgaaatgcaatatgtggtcatttgtgactgacttcttagcatattttagaggttcattcatgtcttagtttgtctcagtactttgttcttttttgtgatcaaatagtatagtccactgaatgaatgaatataccacattttatttattcatcagttgatggacatttaggttgtttccactgtgctattatgaatagcactgctttaagtatttgcataacagtttttgtgtgggcacattttttatttctcctggatatatatctaggagtggaattgttgggttatatgaactctatgtttaaccatttgagcaactgtcagactgctttccaaagtggttgcatcattttacattctcattaggtttatatttttttgcatttctataggtttttgccttatatattttgaagttctgttaggtctataaacatttaggactgttttgtcgtcttgatgaattgacccttttattattataaattggtcttctttattcctggtgatattttttgcactgaaatctgtgtctgatgttaatacttcagctttcttttaattagcatagaccttttacttgtaatctgtttttttccttctaggaaacatatagctcagtcttattttttatccagtttgataatctctgcctattacatgttaacatttacatgtaatataattattgacatagtttgtttaaatccaccattttactatttgttttctctgacttgtgttcttccttccatttttaattttttaataatttcattttatcacctttgatggcttattaaccacatgtttgttttgttatttcagtgtttgatttagggtttctagtatacatctttagcttctcatgaggatttattaattaatgaatctcatgtatatttttattatttgcagtgcattttttaaagttaggtgtatgtatgttcagaaagcatcatcaccagtacagcatatattctttccatgttcccattatagtatactatttcggttttatatttaatgagtatattcaatctataattgttttgaattttggcactcaaatgaaattcacactacctgttatttatataatttcacagtttctcatacgtagctgtctggtaaataaggcaagtcattgattattgttccattttatggaataccaagtaggttcttggtttttagaagcttctaaggcacacagctagtaagtggatgagcctgtatggaaccccagcttttatgattctagatcaatacaattttatgtatactgttgagttcatgttagaacataaaaaatgattactttccagtcaagtgatcatttttctttttgtttatgtgtttttaactttatagtccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgtgagcttttagactttttaacataactattcaaaatttatatttagaaacaaaattatctgggccagaaagacttggagtccatctagtcctatttagaattatttatttaaaaatcatgttcagtaatcataactattattctcagggtgatttagacttacacaataaacaatagcaaatcttttgttagcactttaccattactattttcatgtatgatacagttgacaagttagaagttgttattgttattttaccagtcaagaaattgagtctgggccggttgtggtgccacatgcctgtaatcccagcactttgggaggccaaggcggtaggattggtcaaggataggagttcgagaccagcctgggcaacatagcaaaaccccgtctctattaaaaaaaagttaaaaaattgagtctgacataaagtaagaactccacattactgagattataatttatagaaagtgaagatgaagctaaggtattttacttttgta

SEQ ID NO: 80726 - DNA, 1021 bp, Homo sapiens
taacagcaattattatttgaatcctgataacttggagataaaattatgtagctaaaaatggaatgttgacttactttagcgcaatctctagagaattaaaaaaagcgttttccaaaatattttatgctgaagaggtcttttaggggaaatatataggatgtttgtgaaaactggtctctttcacacttggacttgttgatatgtaagggatggtgcagatattagtccacagcagtgttggtgctctttaggccactttttcaaaccttagattatatttattatttaaataatttgtttattttttagagttacaaaactcagtgtttttagatctaaaaaagacttgtgacttccttttctctgtttaaccacccaccacatcccaaattagttttaagtgttttctttctgagaaaaatgtgagaaataatgactttgttaaatatatattttgacttatctaataatctaataagtaccatcttttccatacataggcttcattccagcgctccaatagtcatgacaaagtaaggagaatagttgcagaggagggtcgtacagcaagaaacctaatagcttggagtgttccactagaaagcaaagatgatgatggtatgtatttaaaaaattagtttcatttttgttgtaaataaggagggtgtatttagtcctaaagagatagactgaaaactgtttgcaattagacttctagggctgattagtatgttaaataagaaatacttttttgttgcttttatacacacatggttttataaaagccttattgttagttttgctttttcagataatagtgaaatttgaaattgggtttattgtgttattatgaccagcagattaggggttgttaaagtgataagagatttagtgatatgtttaggctttgtctccccacccaaatctcaccttgaattataatccccataatccccacgtgtcaagggagagaccaagtggaggtaattggatcatgggggtggtttcccccatgctgttc

SEQ ID NO: 80727 - DNA, 1053 bp, Homo sapiens
taatgtatggcatagtgaattttctgacctgatatacacacacacacgcacacacacacacacactcagtgtctctctctgtctcacaggatgttctgtgattgtgtaagggaattatctgaagtagagctgaaaagtaggccatctatttatacttgttcatttggcctggaagcaatagtgatacccttggttagaacaatgctaaatgatagatgccagtgtaagttagatagaactgaccaatacttaatgggagatgtgcttaagctaaaggacgaagttttctggtgttacattgattggaaagtatgagaatgagtagagaagtgacttttgcaaatctacaggacactgaatggggtttggacagtgatcatagacaaatgagtttcagtgaaagaccttaatgagtcaggtaagtagatgacacatggatattcagggtaaggtcagaggaatgaaggaatatgggtacggatgtttacattaaagacgtaaaaagtgacaagttctggagaggaaaatttgggttagactctcatcacagagaattagagtagaagaatatagtctttgtttttctggtagttggatattagttggcgagttgattcatttttgtaccgaaacctgtttcctgtcactcacagatttagcacctattgtcattccctctttcttaccataacacaatttgtctctgtactggatcatccccatcagtatgaaagtatgatatactatcactcatcttaaaaatccattctgtttatttatttctttgttctcctttatgacgaaactcaaagtatcttaatactcagtatccccatttttctcatcattctgttttgaaccgttttcagtcaggattttgaccctactataccactaaataggcaataagttaccaatttattagagtttattataaattattacttttatcacttcctggacaatgcaaggctgtcagtcttatggctgttgctttaaaggtaatgagttgatttttccctctcctctgtactcaagatttttctctttgtt

SEQ ID NO: 80728 - DNA, 1062 bp, Homo sapiens
actgaacaggattccagcttatcattctgtaatattaggaaaattgtactagttacatggtttctcaggtaagctgcatgactagtaatcttgtcttcatgctacccaaagtattaagggcgttagtagtgggaatttaagagaaaggttcttttctgaattattcagaaagctgaaaaacattggaaaaaagatacaagaatttcattttatgggcagatagtggtatgaatggattttgaagaacttgtataaagtagaaagttttatggagacagatacatagacatttagtaaacagtacttgtaaccttttcaagattatggggaaagttgttgaaattatttagatattttaaacctaagagaaagaagtttctttgggagcaagtctcagaagtacctagcctctttggtaactattgtaaacactttcttagattatgtactgtaagatttgaacataaaaactttcactgaaggctgatctttatacttttagttgaaacattaagtatttgaacaggcctctgtaaaatctccatacagcactaggtggcacactgtgactttggatgaaaatacacatattttgttgaagactcctgtgagaaaagaacctaggttaaaaaaaaatactgtttgaaatagacatctattttatgaagtatctcagaaccatgtattgcatttcaaaccctgatactgatattaaaatgcttaaaactattttatttacattactactgacatttttataagaactggactactaaaaatcattagaatttatgggtttttactaaaaggaatccattcagcatgtattacaaaaagcatctgtgctttaaaatgaaaaatgattttcaatcagatcttgtagtaagatgagtagttataatgtttttgcttatcaagtattggaattaagaataaaatcaaagtcttgagctagtggtttttctttgaatgtgtgtctgtgtatatgtactaaatacaaaagagctaacttggtaaaatttatagtggagctgaaatgtttatggaagtaaagaatgttag

SEQ ID NO: 80729 - DNA, 1057 bp, Homo sapiens
ttagtttatgaacattcttaaggaaagttacacaggattttctatactgagttcagactcattagtgagtcagttcagtgaaagcagcatttaaaaactgaaatagaatacagaaggaaatattagagtacatctgttactttacaaaatttttaattcagttaaacgtgtatgaactgggtaagatataaaacatgtatgtgtttatgggttgtagtaagaaagtttggaacccctctgggttaggatgtccatgtaattaatactgtttcttttccattttatttttattttttggagagcactgaggtcttgttcagcatggaatatttaaagcatgctatattataccccaacaggtaatataaaggagcagttttttttgttgttgtttaatgtaagtgtggggatgagatttgtatctttttatgaataattatggttttctggtaatgttataactaagcgtatatatattttttattgtaggagtcatactccatgggtttatgtgataaatgatcttggcatagaagagaatttaaagaatgatggtaagtgatatcttaaagactagccttagtttttttgcctttctcttttcttcctttcttttatcttttttaatgtaatagttgtttcattcaagataccctatggaacacattgtcataaagcacagtgataaagtgagcagctatgaatgtactattcaaccttagagcccaggaaccctgctgctcctcaggcttgcctctaacacttatggtacctaggttaggaatacaagtggaagccagcttttaaaatttcttaatattaaatagttacaaatcaatggatgctaacagcctgacctggcctcctacccagggtctagccaagtcttaaaggaacctactctccctgggctaggtagggtagaagttgggctagagtaggtcttgaatctggtatggggaccgatgtgaaattccccagagagccagggaaaacaggtttctgtctcccacactttacttttctaactcaagatttttcaggcaattccaaacat

SEQ ID NO: 80730 - DNA, 1028 bp, Homo sapiens
tttcttttttaatttgaagctttattgagctatacttcacataccataaaatccacccatttaaaatgtacacttcaatgattttaatgtattcacagagttgtggatccattaccacaatcaagtttagaacattttcagtatcccaatatgaaaccccataagcattagcagccgttttccattctggcctccctccctacttccccatcttatctccagctacagccaccctctcatctactttctgtctttatggatttgcctattcaggacatttcacataaatggaattatacagtacgaagccttttgtgtctggcttcttccatttaacgtaatgttttcaagattcatccattttgtagcacatatcagcccttcattcctttttatggatgaataatattccatcatatggatataccacattttatttattcatttatcagttcatgaacatcttgcactgtttctactttttggctattgctgctgtgaatattcctctagaagtttttgtgtggacttgtgttttcatttctcttgagtataaacctaggaatagaattgctgggttatatagtgacttatcttttactttttgaggaactgccagattgttaccaaaccagctgtaccggtttacatttccactgcagtgtgtcaggattccagtttctccacatcttctccaacagttgttttgtctttttgacggtagacatcttggtgggtacgaagttatgtctcattgtggctttgatatgtatttccctaatgactagtgatttcaacatgttttcataggcttgttagccattcgtatacattttttggagaaatgagaacataacccctttaacctgacatagtggtgctatttaacctgacgtgggttcttattcttcctcttggttgctctctgttggctttttattcatataatcaagtgaattgctccccagaaatcctttgtggtaatctgtgaaatatacatctcctacttacgtttattattacattgt

SEQ ID NO: 80731 - DNA, 1052 bp, Homo sapiens
tttgtgagcagcttcctgttgctggtggactgcatctcttattctagttgtgacaagttattttccatgaaaatagctattcattaatagtcattttaccgaacagatactaattccttatatgaattatagtttgtcttagtttatggattaatttcatcattaacttttcatcttcataaataatctggtagaaggatggatgggctaggagtaatacttattttatgaatggagaaacgggggctcaaaaggttattacttgccttagatcaccagctggtgagtggtaaatctggggttaagttttctgacctaaggttggtagtctgaccactgtcccactctggcctatactggtgctctttcccttctgttatttctgttaactatgacttttcctcaaagtttgttggttgcagatgatttatgccacttgaagaatgatatccactaaagaattaatatttttaatcaatcaaagagtcaagttttaatgtgatttggaaggttgtctgtgggagaagtaatctgatggctttgaaggcagactgttttgagtttgaatctcagccccaacccttgtttttggcaaattaatttttctgagcctttcttatctgtaaagtaggaataatatccacctcataattttgttgatagtaataaattaggtgtctgtaaagtattgagaactgttcctagcccatggtaagccctcaacaaatgctcttttccttctttctccacactcccttgagctgcattaaaaatatactctatgtgtctttggtccatttgggtctggtatagcaaaatacctcagactgagtggcttataaacaacagaaattcatttcttgcagttttggaggctgggaagtcctagatcaagatgtctgatgattcagtgtttggtgatagcctgctttctggttaatagatggcaccctctagctgtctccttacatggtgcaagggtgaaggggtctctctctggcctcttataagggaatttatcccattcattaaggttctgctttcataataca

SEQ ID NO: 80732 - DNA, 1062 bp, Homo sapiens
gccggcaaggccgaggagctgcactacccgctgggcgagcgccgcagcgactacgaccgcgaggcgctgctgggcgtccaggtgaggcggccaggccggtgctgggagggccgggcctcgcaccgcggctgccgcgggctttgtcccgggacaaaggggggcggccgggcgaggcctggcaggggcggcctgacaatgggggccgggcggcgcggcactcgctctctgggggtcctggggcctggaaagcctgaggagatagcacggcccaagagctggatcccttctacccctcagatcatggagggtgtgtagggggtaggggccttgaagtgcaggtgcgggtcaccccgaaaccctttggcaagggggtcttctagtagccctgtttttctccaccattttgccccactgatagtaatgcttggccctcctgtgtgtcgcttccccctaaaggaagatgtggatgaatatgttaaactcggccacgaagagcagcaaaaaagactgcaggcgatcataaagaaaatcgacttggactcagatggctttctcactgaaagtaaggactgccctacacgactaacaatggagacaaacacaaatatgttaagcagcggtgtctgctgaatgtatagattgctagtgtcccaagttggaagtcctgtgagaaggagaaaaggacatggagaataggctttatacttacaaatctttagacactgagaaccaagtaaaactcggtgctttctccagttatatataaacatcattgaccctgtactctatgtggaagtcacaccttgagacaccctctttctcacgtgacttttgttagtgtcaacaatatgatttattttagagaaatatgccccaaaactttaaggcagtaaatgatttatcgctcttttgatatatgcttcatttaaattttaggaatttgcttctttttttaagcaagtagaaaaagacctgttgcctgtgaattacgtttattataacattataccaaaatgttagagctggtaggggccttgggatcatcttgtccacatcactttg

SEQ ID NO: 80733 - DNA, 1184 bp, Homo sapiens
gttatagtatggaagctccggccaggcatggtggctcacgcctgtaatcccagcagtttgggaggccgaggcaggtggatcacgaggtcaggagttagagaccagcctggccaacatggtgaaaccccgtctctactaaaaatacaaaaaattagccgggtgtggtggcacatgcctgtagttccaactactcaggaggctgaggcaggagaatcgtttgaaccgggaggcagaggttgcagtgagctgagatcgcaccactgcacactccagcatgggtgaaagagcgagactccatctcaaaaaaaaataattaaaagcttcatgagctcttctaaacagcctttcccacttcctaccccatttctattaatacaactaggccaattctcagtatttgcaaacatcaaagattttgccttttcagagaaggtttggaaatccttactcttaagtatcagaattaacgtcacatgcgttgtgttctgggaaattctcataggtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaaggtgagttcatgtgcacaagctgtttcttttgatcatgtcagttcactttaccttcctgcatgaatgagcacattgagggcctgaggtcataagctggattgtcttgttctctaggaaatcacctgttccacttcagcagtcattttgatggtttcctttctggccagatttaggactcttattctaaattacctacatgatccttctatctgtttttctcggctgcatcatttaattgtcctcatttccagagttgctttttaaatgtgttttgaatgagtatctcaatattttaatatcattgaataatcagttttatctttattaagaaggccattatggcccattcccatttttaaacacatagttttatatactcacttaaaaaaactgcggtttccacatctgtggattcaaacaactgagaatcgtaagtatccaaaaaagtaagtattaaaaaaaaaaaaactgtgtctctattcaac

SEQ ID NO: 80734 - DNA, 2462 bp, Homo sapiens
gtgtttgaaattaagagtttgcttttatataagcagctgttttttcagaattgttgcttaaagacaccaaacaatgccatttttaaattggtcaccagttttacttattctgattgtcactttaaaattacacatggcattactttgtgaaaacatgtaagaaactttgtatagaaacatgatatacagtaaaacattacccacctcacatctgggaaaactagatatcggaacaaatagcagttaacaaaattactagtttgtgaaaacatccaatgattttaaaactgggttgtttagactcgtgtcacttttgaaaatgactatatatttgttcttatgtcaggacttttcagttaagtagttctgttttattgggctttctttagtaaactttaaattcacttcctttattctagggatataccaaacttcttattggatacatgtgatattcttgtgtatgtatatttgtgtttttttatattaagctgcaaatgaagatccagaatggatacttgttgagaaagacagattcgtgaatgattatgacaaagataacgatggcaggcttgatccccaagagctgttaccttgggtagtacctaataatcagggcattgcacaagaggaggtaagtgttacagaacaactgtttctctccaccccctccccccgaatttggtgctgttgataggaaaagaagttcaaaatcttaagccaaagaaagaagtaatggagttatttgggattgatgcattactatgttttgaatttacgaactgtttagattgtcagggagacgaggaagttaagattgtgtcatgtattaatttgagagtacagtgaatagaataatagtttgtatttacctacagggactcaaaacaggttataataatttttcattgccttgatatatcctggattggatttgagtggagagagacagaacccagcagaaatgaagaaaggagataatgggaaaagcagtagacggacctggttacaacgtgtaacatttttagatacttaaacaataatgagtacttgtacacctggatgattttgacaagtcaaatcacattaaattgtgaacatcttgctgaaaatacttattacacttgacacttttttgttttattttgaaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgtatatgtttgtttgcttttctttaactttcagataaatattgaatttagcataggttttgtggtattgtacattatcttgcctcatccattcctttatgtggatagttcccaaaactgtcaaattattcttgctgcattttcttattttttttttaaataagagaatcatgttataatataattgaatgtgcacctgacacattttaataattggtgttgtagcaaatgtggttttgctctttggggctataaataatcttgagtaacgcaggttggaattaccaatagagctggtcagttatcaacagtagagctcagtatcaattttactgaaattaaaatcatacttgataagcatgataatcaattttaacctaattcagcaggtcaacttatttaactttggtggaggtgggatagggaaaagtgaagggaggaattaatttttttctagttctgatgtacagagattgtttt

SEQ ID NO: 80735 - DNA, 1105 bp, Homo sapiens
tcaaattccactcaccataatgctatagttatacattaaatataattactatctatacatatgcaaaaatataaagttctatttcatacaataaaaccctttatagaaaccattttaaaattaagcagaacttctcaacattaatatgtgaggtctaagtccttctaaaggtttctttaaaggtttttaaacaaaatgctaaacctaaaaacattgtcctgtcagttcccaaattaaatctacttagaacaaaaacaaaaatttatagctcggtcacatactacttaaataatattgttcaggcatctctaaaatcctccatgttttcaagtatggaaatagaactcaaatattccacaatacagtactaaacagatggagtatttaggaaagactttgttgtcatatggcacaatattaatattttgttgcttcaatacattttgaaataaatatcagatttttgtttttttttcctaaaagaccaaaattataatctacattaagataattctgactgtggttaagacttaagagtgtaaaatacaacatcaatattttatcacaaaagtaaagctggtaacaaattataaaaggagccagtactctactgagacaggctcagagattaaagctcatcatgatagaaatagtcatcatggagctgtctgccataatctgtggcttcactggtgagaaacaagtccgggttttccagaatctcttcttcagagagctttttgtcaccattcaaatccatttcatcaattagatgaagcgccttcaaaataaaacaaaaaagtgtcaagtgtaataagtattttcagcaagatgttcacaatttaatgtgatttgacttgtcaaaatcatccaggtgtacaagtactcattattgtttaagtatctaaaaatgttacacgttgtaaccaggtccgtctactgcttttcccattatctcctttcttcatttctgctgggttctgtctctctccactcaaatccaatccaggatatatcaaggcaatgaaaaattattataacctgttttgagtccctgtaggtaaatacaaactattattctattcactgtactctcaaattaata

SEQ ID NO: 80736 - DNA, 1054 bp, Homo sapiens
ctgtactccagcaggtcccatcctggatgcctcctcccactgggagccccgcctcccccatgggacctgccctagcagatggcggggcctcatctgaatgcccgtcagggccacccacgctggtgctgctgctgctccccaactgtgctctgagctgcctgagggctggagtggagcctcatatatgcaagtccagagtattggcctctgggcatctctgggcgccccacctcactttccagaggggaaactgaggttcagagaaggcagctgagagggcgctggaggaggggtggagtcccacaggcttgggtcacaacttctgtgcccagatctctggaggtcacctgtcccccagccgagggagtagctgagtcccagtaaaggcagagcagaagggagaggccttcccaggggaagggaggagggtgggtgctgtgtctggtgggtggggcaccagcagggacaagagtgttggtaggattcgggcatcaagtgaaggacagaggcccagagaaggctatgtgcacaagtcctgggctctgaagcccgatggcctgggttcaaatgcagctgtaacctggggcaagtactggaccttttagtgcctctgtttcctcatctgttaagaaagggaacagtaacagcagccacctcggagggcagctgtgaggactgaacacatgaagcgccaagaagggctggcgaatgggggaacacagcgtttactttgacggcacatatctggaatgagagcgccgcgcccatgattgtgcagccagggggagtgtgtgtgtccccagggtgaggaggtgtgtgtggggagtaccgcccaggcctccgccctggtcggacggggcagccaggcccacatacctgcctcggtggccgagtccttgcactgcctggctttgttctgactctgaggaaacagaggggaagcagcgctaagcccctgccccaggagccagggcccaccccagcagacctgaagtgactgtcaagcttccccggccaccctggggggaacattcaggagccaactatgggcaga

SEQ ID NO: 80737 - DNA, 1072 bp, Homo sapiens
gcagaagctggaggaccgtggctgctctgctctaggcctggtgcttgcaggagccgaggcgcagtccttcctctgctccccacatctccagggtgtcctggttccccttactgagcccaacctgctgggtgggtcctccccagcagagagggcccccagccagggtccctgagctctgtggatggatgcagcccagcacacggctctcccgggcagccctggcccccttgcctgctgtgtttcctgcctgacgctcctgtccggggctgtgggggttgattttcttgttgtttttgcccaagtgactcgagccccctgctgcctcctcgcctccttgaggtagaagggcgagctctggacccactctcctagccccaaggcctggctgtgctgcattctcgctgtgaccttgggcaagtcactctcctctgagtttcctcatctatccaatgggaaaagtggggtctaccttagaggacaggtgtgagttaagtcccttgcacagggccttgcacacagaaggtgttcaggaaacaggaagctgtcagccagggccgtgacccctcaggatcaaagaccccgagccgcgcacaatggcctgtgaggaggccggtgggtgggggccgctggtcagagttcaggcccacagaggggcagagtgggcatcgggctgcggcctctgctctttcctgccccagctctacgaggaagtgcggctgacgctggaaggctgcagcatagacgccgacatcgacagtttcatccaggccaagagcacgggcacagagccccccggtgaggtccggcttgcggacagcgcagcctctaggtgcattgagcccctgggaaggcccggccctgagcctcaagtgccaggaccgggctggggtagctcacagctcccttcagggcagagaagccctagcaggggttgtggggagttgggtcccaggcctgctgcctcctctcaggcaaagctaagggcatgatggcactcagaggaagaggtggggatggggattgaggtgaggagctcccacggcccccactccccgcctgtttggttccactg

SEQ ID NO: 80738 - DNA, 1068 bp, Homo sapiens
acttttaaaaatgtttagctgaagatcctgttagccaggggtttctcagctccggctgcgtatcagaatcaccaggagaatgtttcaaatatttatgcgcaagctcagtttgcagggatttggtttcagtttgtctgaggtgggacccaaccatcagcatttgaaaatctgctcaggtgactccgttgagcagctgggttgagaaccactgcacgtgcaatatgtaaactctccaagtagatctcgaagtggagtgggtgccccctttctcctcccactggcccctaagagggctctactgagcacagtttgataatcccgtgagggtgctgagggcagcgagcccagttgctggtgcgaccttgtcctgggcttgtgttggctcaaaagccgggatggagaaataggcagacacccaggtagtcagaccaaggcaagcaggtgacccttatgctgaggtttcttggcctaggaaaggctgtgagagtggttggaattaggtgttggacaccagtggcgcgtgcttccagtttggccaaacgtgagttgctgctttttgtcatcattgcgaaggattcactgacataaccacagctgtcccagagggtgtgctgagcgagggggattatgccaagcgcaaagctgctgttgagtgtagccaagattcagaggttgtgggtcttttccttaaaagtggtatcccttgctggtaagtaatacctaatcattgtttaatttgaaccttaggagattttgcatgggggcatattgcacccatcttactgatgctgaaacaggcccagagaaattgtgacttgcctaagaccacccaagaaagcgtgagcctggattcaggccctgatgttgtgattcagagaccatgcttgtcctcctgctccttgctgtctttgagtggccctcggtcaggaagaggctgcagttatttatacacccaattacacgctaactccctctttatctggcaccgtctctgctgggaaggccatccatccatgcagttggttcccagcagctgaggtggtgcccagtgatgggagaacggagaaa

SEQ ID NO: 80739 - DNA, 1036 bp, Homo sapiens
gactctgtctcaaaaaaaaaaaaaaaaaaagtcacgtttaaacattttcatggatacatctggttgctctccagaaagcttatatcaatttctattcccaccagcagtgaatgaaatgtgcatttctttacacccttgttgacacttttggtgtgatcagccttcatcttttcttccattctgagagatgaaaatatgtgtttatttgactgttagctagggccaggatgcttttaaaggtgtttcagccatttgtatcttctgaattttgcttctgtcctctgcccggtttgattggttattgggtttttttctttcggatcttaacagagtttacttaggaaacttttctgtgaagcttaatgtctgtagctattgtgaatgcaatggttttcctaacttatttccgagttggtggttgttggtgtgtaacagcacctgctttttgggtgcatccttgcagttcttgaaaataacttgtgtgttgcacgtggctttctattgcagtgcctgtgagatctgtgaggtctcctgagggtgtaacacagtgacgtggcagaaacctcgtatctactgaatggtgctgctgcattgctatttgtggggaagttgagtcatacataaatcctgctcccctgagtttatccaatgaagaaagtaagacagatgtagaaattatagggtagaaaagagacttgctgatctttttttttttttccccgagacagagtcttgccctgtcatccaggctggagttcagtggcacgatcttagcttactgcaacctccgcctcctgggttcaagcagttctgcctcagcctcccacatagctgggattacaggcgcgcaccaccacgcctggctaatttttgtatttttagtagagacggggttttaccctgttggtcaggctagtctcgaactcctgacctcgtgatccgcccgcctccgcctcccaaagtgctgggactacaggcgtgagccaccgtgcccggcctacttgctgatctttgttatcccaccatctggcaggta

SEQ ID NO: 80740 - DNA, 1033 bp, Homo sapiens
tctagtgtcttacggaacatcctgtggaggtgagagctgacttgtaggtggaagcagctctttggaggtttgatttggaaggtgaactgagaagaaggtggtgatgcaagccggccgtgctgaagccaggatgaattggtgtgactgggcttcagttaggctggcatagcagttgagagagcttagcagtgggcagcagggcactgttgggggcggtggtgagcggtggattctggctgtttggaggcaggacagtggtggaattcgatcattgattggacgtgggacagagaagggagaagagaagactcatctaggatgagtcccaggtttctggctcagtcaactggggaaacaaagtcacagagctagggagtagttagagaacacatctgggggtgtgactcatggtcagttttgggctcgtcagttttgagatgcccaaatatcatgcagatctgtcccacctgaaaatggagaagacacgggaaaggagaggagtaaaaactaactccttttcacaaagtggaagttaccagaatgtgatttcagaggccccgggggatttatcatgtgactactgacccatcccacctcttgcccctgcctgttgcacagtgggcaagaatgtttgtgacctttcactaccaccacctcccccgagcatggtccccccagttttcaatatgaaccatcctgtgggtaccctgtcacaggctggccctgaggtgagcaatatttggactgtgatgttggttgttctccactctttctacaggacagaacagggcctctagagtgggaaatggctttgggaaatatgccaagcagtagccttgttcttcaacttgcccaagaggataattctccacacccttcctgtactcagtcctcagtttgcctggtgagagagcagcctcctcccgtgtgctctgccagctggacccagactggccatattaccagtgagaccaaaaagatggaggtggggaggtagctctgaggtctgggaaaccattccagctcctgccag

SEQ ID NO: 80741 - DNA, 1824 bp, Homo sapiens
ccacatgtgtctacatttaaattaatttaaataaaattaaaagtgcaactcagttgcagtaactatatttcaggtgctcagtagtcacatgaggccacatgacagtgcatatgtggtatgtctccatcgctgcagaaagttctttcggacagcactcgctagactagtagtggggatgccaaataagagagacttgattccctgctggctttacgaagagttcctgggagggaagctgaagcttaggacttagttccttaaaaaataatgtactcataagaaattccttctatcactgttgttactgcctttttgatgatttgaagtcattgaactttgaaacagctcttttaccaacaaagaaatacacacctgccatgagagggttttcagccttttttccccattgttgttttctttcaacagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaacatattatttttcattatttgggggatatttcagttccagagcagcagtatcatgttttctttgttggtgctgtctatagttcatcatggtttacgtgtgttttcgttatagctgttgccagattctaaagggcttgatattcaaaaaaccacagatgctttcagtccagtatatcctagaaatatagagctctactttgtgcaatgcactggggatacagtggcgatactgtccttgtcttcaaggagttcggagtcctagtataggagacatacataggagaagataattttcacactgcagtggttgtagtaatagaatgggagtccaaaggggagttccggagaggtcaggggtgacttcctggaggagatgcccaagcttggaggctggataggctttgttgaaagatggtacacaagagtgtgaaacaaaattgtgtgtgcagggagcttaaaatacaaggctggggaaagaagttggagaagcaggaaagc

SEQ ID NO: 80742 - DNA, 1221 bp, Homo sapiens
tttttaaaaaagaaaaatgtagataacttttatttgttaaataaaaccaatgtaattgctagtttaaatgtaagttgcttggattgcttgctctttgtatatttgaacagaagctagtgtatttaatgggaaaggccttttaaaatggcaaaaggatgattgtttactttgctgatattcagacagccctgaaatgattcattaaaaagcctacctctttatttgccatggtctttgcccttctaagcatttactctgtagctctgcatagcagtaatctgatgatcagcagggatttatttcatattttgattatttatgcaaacacattcatttagctaaaaataatgaaatatgaggaaggtctcttttcccaaatagaattctgaactgtgcattcttaatgattttatgttcagtaataaagccacatgtactagcatgcagcaaaaaagttttggaactgtatggtacttgtggtcatgaaatatgcaacatgtatatagaagactgataaaaataatcactttagctatgtccctcatctagttaagcggcttagcctgccagacatttctttattaaatatttttcaataggggctaataaatattttaactagtctcttaatttaaatatgactgccatatgtgttttatacttaagtcaccctgacttaagtaaaagctgataaagcttgattttttcacttcagcaaggctgcttaagtttagggattcagagctttcacagactcaaaacctagtggttttgaaaattttaaaaacttgggttttaaggggagaaaatttatctgaattaataattttccctaattgtttttaagagtacctgtaaacattctaagcttctggtattcaaaatctgatagattggtgccctgggtgtggaaaacctgaacaaaggcagaaataactgaaagatcagtgagcttttgtgcttatacactgatcctaatatagacatttagagctggagaggatggttggagagtctccagtcttggccctctttgtttagccacaaaattttgggtgagcaaggatagtgtggcatgaccatcacacagagtgtcaactctagagacccctgcctttgtttgtactctgcctccaattacaagtataagatttgcagaagattaaattcctaaattttgtcaggaaacctgacagttaattgacactttagctggataaa

SEQ ID NO: 80743 - DNA, 1481 bp, Homo sapiens
gttgcccaggctggagtgcagtggcgcgatcttggctcactgcaacctccacctcccgggttcaagtgattctcctgcctcagcctttgtatttttagtagagacggggtttcaccatgttggtcaggctggtcttgaactcttgacctcaggtgactcgcccatctcggcctcccaaagtgctgggattacaggcgtgagccactgcacccggcctggcaatgtacttttcatatggagattctggagccactagccatgtctggctgtttacattaaaatttaaaatgcagttttctagtcacactagccacaatttaagtgctcagtagagcttcatgtggctagtggctgctatattggatcatgcagactttccattatagaaagttgtatcggacatcactggtctagagtagcttattttaaagctctgtagtacatggaacttcaggtatttggtttttgtgagaaataatacttattctcttctcctttagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggtgagtctcttggccacgacttgagtctagcttgattaacctgtttttcaccatgtcttatcaccatctgggacttcttttctgccaccttgcttgtctttaatgtcatatattgttttactgtaaattattataaaatgcatgtctttgttttaattacatgtctgtaaattataccaatcatggaatcttttttccactctttcagtttctgtcattttcctttctgtaagtgggtagtggcctgtgaatctgcagctttaacttttaaagaacacttctaacgaggatgactgtgtttgttacaggggtgtgaggctctagtagtgaagaagctacaagaaatcatgatgcatgtgatctgggccgcactggcatttgcagctattcaggtaagcacagcttgccaaggagttctatcggagtgagttggttctctgttgtcagccctgaatggttttaatccccatcacagtgaatctttgtgtatgtaggtaatgtggaagtgactgaggtactggcctccagtttcccatgttttccatttcttgtctatacacctagacccggaatggtctaaagaaaccagaaatctggatggggagggaccacgtgttgagggaactcctcgtcttactgtctttcttgattagtgagtgacctgttcaaaacataaacgaactgttgtcttagtgtattcttggaagatattttattagaatgtcacaaaatttttaaaaattgtacttctttctttcagtttgggaatacaaagctttattcagtttttttgtatgctagttctccctctagttcttgtttttctgt

SEQ ID NO: 80744 - DNA, 1106 bp, Homo sapiens
ctgatttttttaaacctgccgattacttttgcacatttagccaactctaaacgttgaataaataaaatggaaataatgttggcatttgtcctaaaagtatcttacaggagcttcagagttactttgttttacctcctttaggaaaggaaaatgagtaacttatttgtaaaaggaaggcatccatttataatttaggacatctatcccaagcctcaacttttctcccttttgaatacattgttagcctgccattttgcacacaatcttctctttgaatgcttgaatgtatgtggtatatgtctgaatttttacctgtcacttttctccctcctgccttcatctatatctatatgaagatgaaggcaggaagggagaaaactttacaggaaattcatagatatctggcaacttgcaaacatttcatttaagtattttagtaggagccttgactaatgttacttttactagtatttttgagggactgaattctttgttctgattcaggtggaaaatgaggttgatcgcagcattcagaaagtgtataagacctacaatggaaccaaccctgatgctgctagccgggctattgattatgtacagagacaggtgagctttcttgaggcagatttgtttttgaggaccaatcacgattgggtcaacattaaactaactgctatttctgtgtaaattagccatgtttcttcacatacatggctatcctgatgtgaccaatatttttccccaaccttcacccttgaaaagtttatttcatcacctagccagatgagaaacatcttgaacttttttttatcatctgatttccccttccctgaccccagtctgtactctcccaaagtacttagccaaaggggtgatgacgcaagagagaggtatgtgtcacaggaaaggtgggagtccagattgactccaggggaggtgggaggtctatatatacctttagaaaacaagataagaaaaggcaacagaaaaactgtcaaaaaaaagttgttatggacagtctgatacacacaaaggtagaaagaatagtgtaatagatgtttgcaccccgaccttgcctcagtaatatcaacttttcgtcagtctta

SEQ ID NO: 80745 - DNA, 1369 bp, Homo sapiens
caaatccaagctctgtcatttctaccaaatttccccacttattgagggcaactgtagtgagcaaagatccccctaccaccatactgatccgtattggatgtggaattgagctacagtaagcctttagggatgtgtaggtgtgtgtcatcatcattgttattatttggttatggtttcttggtcctagctgaaccatcaattcgtgaaaagtaggtgaagtgtggataactttttaattttatctagtatagaaatgctcttaacaaggaatcatagaattttcagctttactgaaaaaagtctataacagttacggtaactctcattaaattataccatactaagcaataataggaaatttttaccagcagtgcttagagaccagtactgactttgttttctacagggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacggtaagatgtgttgtgagaacatgcaggagtatttagtctatgctactctccttgaacatgagactccttggctcttatagttggaacagagttaacatttaaacttctagcaattatctctgataactttttttaaatcaagagtgtatttaaagttattttttcatttgtatataattttaaaccatgttttcttacagtttgtcatcatcctgctcttggtttttgtcacagaagttgttgtagtggttttgggatatgtttacagagcaaaggtatgttgtctactgtaattcacataatgccttaaaaggtggtttaagtgtttcaagtaaaatagaacacattcattttatcagagtaaacattttcttttgccttacttgtttaatctgtatttcaaatatctaaagttaattggcaaatatttacatgtcaagactccttacctcatttaatatagcagagtgttatatatgtattgttcttgattataggtatttatagctgcaaatgaataattagctgagaagtttgttcagatttcctcagcacacagattgcctatatgaggggaggcataattttctgatttctgctttagaagaaccaaactcagaattgcgttttccattgtctctttaaaaaatgctttggtcctaaacatagaaaaaggtgttgtgagttgtgatcccaccttccacccctgtcctgaggaacaaggggtcctgccaacttagaacaccaaggcagctggtgccagcactcctt

SEQ ID NO: 80746 - DNA, 1025 bp, Homo sapiens
cttacataagaagtagttgtgtttagtgacgtaaactgttctatcagattaagtcagaggtgaaagcatggttgaattagagaatatacattatggcaagtagaatgctaaacgatttaagatgattttaagacacttgtaatggcataagggtgaagtttggggaagctttcagaaatccactgtgtggaattaccaacgattcttcccaggagagaaaagaggtatatgaaaaataatatgacagtacaggaaactctggatttaatgttaaaaagatatatgcataagatggattcctgcctattttttccctctgcttttaaaacctgctttcttacaaagtctagagtacagcattttttgctcagtcttttacttcttgacttttttcctttctctcaacactccagtcacttctactttactaattgattctttggcaaaaatcactccgaagggagcagttcacacaggcaagcaagaatttgtcaggcactgtgcttttaggtgaataaagtccagatggtgccttgtctttacattgttttgattcttgccagttctagatgggaatcatcatcaatggctactacataccactgcaagaaaatcacttctattctttgcttcagcttcgcccaaaatgtcctgtgggatgctttcgcctttgtatttctaaatctccatgtaggtatacttttggcaacagagctactttatctccccacttgtagcaaatctgtttcatttttaatattgccacattccaatggcaggttacaccgtggttgatgaaaaggaatttaatagttttacagattttaacttttttttttttaattttttgagactgagttttgctcttgttgcccaggctggagtgcagtggcgcaatctcggctcactgcaacctctgccttccaggttcaagcgattctcctgcctcagcgtttctgagtagctgggattacaggcatgtgccaccacgcccggctaattttgtatttttagtagagacgggg

SEQ ID NO: 80747 - DNA, 1274 bp, Homo sapiens
acagcttggatcatcttggatctctgtttttatggaatgatgaggctttaaatataagtgtattcatgctggacccatgaggatttattgaagaaggttagaagtgttttaggtaaatgactaaattttaaaggctttttttttttttttttttttttttttttgagacgaagtcttactctgtcgcccaggctggagtgcagtggtgcgatcttggctgactgcagcctctgtctcccgggttcaagcgatcttcctgcctcagcctcccgagtagctgggactacaggcgtgcgccaccatgcccagctaattttcgtatttttttaacagagacagggtttcaccatattggccaggctggtctcgaactcctgacctcttgatccatctgccttggtctcccaaagtgctaggattacaggcgtgagccaccgcgcccagcaaaggctattgtattaaataggcattagcctattctgtaaactgcacctttgtaccaaggtcagacaggatttttagtttggtaagtcatttaatctgaccaaagagggctcgtctaaaacaagtttaaatcagtacttcctaccattaagtttttattccggtaaattaattgattatttaatcaagtcctatgttatacaaattacctttactttttttttaaaccctattagaaaaactaattggctaatacttattttgctcatatttatcttaggcattacagggactggaacagaaagctttgtccatgcttatagaatttataatcttaaatatctatttaggttgttgtttttcatctgagaggtgatagtataaaactgagacacctgtagagtgggggaagtaccgcaaaaaagtcaaacgccttttaaataaatgcctttagaaatagctttggaacgtggcaccttcactaaccatcattcattcatatgaaatacttcacacatataaattgtagttgaaagccatatgtaacctttaaaacttatcctgcctttaaaaataaaacttatcagccaggtgcggtggctcatgcctgtaatcccagcactttgggacgccaagggtggcagatcaccctcctgactaacacggtgaaaccccgtctctactaaaaatacaaaaaattagccagatgtggtggtgggcacttgtagtcccagctactcgggaggctgaggcaggagcatggcgtgaacccgggaggcggagcttgtagtgagcggcgatcgagccactgcactccagcctgggcgaca

SEQ ID NO: 80748 - DNA, 1050 bp, Homo sapiens
tctggtcaggcagagattagtgtctccaaccttcctaggggagaatgggctaggtagaaagatagcactcagagggctctgaatcatctataagggtggcatagtcataggaggagagtgggtttggtccaccagaacctccctagggagccatctgcgtccaagggcggccagaggccaagaaaaggcgctgaggccttggctcctttaagaggcgtggcctcactgcagcctccgcagaggcgattggctgaagctaccggccgcgtggggcgggactcggttgccagggagcggcgcgggagccctgaggggactgcggcggctgcgcggaggagcgaggcacttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctgggtgagcggggccgggcagagcgaggggccggcggcggggccgggcgaggccgcggcggaggcgcccgtgggggccgggcttgggcctgggcgggcgcgcgggggccgcgcgcgggccctcaggcggctgaggcgaggggagggccgggtgtgaggccgcttcgcgaggtccctgccggaccaagccgggagcctgggcgcggaggacagcgaggggaggccttcagggactccacggcctccagccggcgcctccgcgctcggcccacgcgggctggctccgtgccaggcgccccagtctcccccccccggagtcgccggctggacggagagcgcttattgcagactgtagcaggacgtcgggctcgaaataggatcttcgccagaggctcaggttccgcgctctttgtcggggcctcgcagacgagtggccgtcccgaggcgggcagatccgcggggacgctgcggagccggggcgggggttccact

SEQ ID NO: 80749 - DNA, 1083 bp, Homo sapiens
cttggaccttggcagcttgtccctttctcatccatgcccagggcccctgctctccagtgggagtaggcgaggagtccaggctgggctgcttttttgcagatcccacagtatagcaagaagggcctggttcaaacccgctgcctccctgtgtgatcctgggcaagtcctttccctctccaggcctcaggaactgaccaggtctgcatcacccctgccagggctgccatggagtatccggaaagccacatgtgtaggacttcgggcacatggtagttgatggctgctgtgattaaggctgcctgggccttgctcctggttctctcgaggacacaggacacagaaaagtgtcttcacaggggcagccactaaccctagaaattggctcccaggctctgccacccaagaagcaagctcactgcttatagagcttctttcttcaataggaaccctttctctgcaaatccctagtttgctaggaaccccagaggcacattctttcccgtccacatgcccccactatctctggcaggactatattcacccttcaaggcctcagtctagcccacctcctccccaaccccatcagacttctccctaccccctgccctttgggtgcttcctatgagtatctggccccactctgcccttctgtgccactgggcacttttctgatgctggagagctcccagggcaggcttatgcctctgactcgcccagagcctgccagagcccaccagagcccacccctgggtagctccagctgaagactgtggatggctagagaagggaagaaattcaccctccccaccgcatgtgcgtgtgtgtgcgcgcacacacacaccccccccacccccccccccgacacatatggtccctctcccattttgtggccacagctggccttctctctagctctgccttgtgtggctctgggacctctgcccactctgtcctatccttcatcaggctgttccagatgcttatccagcccctgggacattctcaccccacccttcccactggaacatgccctgactttggggcaggggctggcactaggcaagctgtcactacacaccacag

SEQ ID NO: 80750 - DNA, 1890 bp, Homo sapiens
aaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcacctttttaaaaagaagtccattttgtatattagaagatgatgatgatgatgaagatgaagaaagccctggcagatacaaagttcctcagtatttaaggagaaggatctcttccatgtccccttgacatgactgtggctattgcccaaacctcagcttgagaacatcatataatactgagagcggaagatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccagaaggtacaaggtgctatacagccgttaaacaccccctccctgcaactgtttaaaattagaatagatttttgcatcaaccactgctagaagctttccccacctaggtgggctgcaagggcctgcattcccaacatcccattacatgtttcccactccagaaagtctctgggtttattccagctttttatcttgacgtgtcccattcacccccatggtttggtttggtttggttttgttttttaaatcaagaaagtttcagggaatcaaaagaggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacatattgtaaagttgtataaatctatcattgaaaggtcctctctgccagcagtggtgccaccctttggtttgctgtggtactttgctgtgtactccgtggcatcatgttactgtgtaaataaattcattttaatacacactaaaaaacagacaaatgcttgtccttttggcgactcttccacactgacatgctggggagggtttggttgcagacatggttatgtcttgtccccccagggtaggtgccctgtccataacacaggaaatgatggctttcagcctgtgtgtcttctgcactctgggtcctcatcccctgctgacatggattatatttctctttattccctgtctaatctgaggaaatcaggccccaaagagaaagcaaaggcattctgcttttcccagacctcagaaggctgcaggtttgctgtgtgagatcgccctctggtgagcagtcacctgcaggcttcctgggtttgtactgcatgttgagaggcttggttagctggctctggctgaccctctccgtggaaatcagagctattcaggtaatatgagcggggacagggcctggtactgcatcatctgcaagattcgcatgcctttga

SEQ ID NO: 80751 - DNA, 1121 bp, Homo sapiens
gtaacaggaagttattgccttcaatattgattggaaattgttttctattgaagtctatactgtagagttttccatttatattgagagtttgaacaattaagctcctattggaacttttccttaagccacatgagcatgaacaatctctgtgacacttgggtgctagagaaacacaacagtggctaaagtagccaagagcaagactgaatgtatagcagagtgccttgttagagtggtaacctagtcttggaagcaattcagtggatgtttcataaagaggactagaacttcaagaagcctcctgtgctggctgaggtgagcccttttggtatatgtacactactgggttgcctagaagccaattcatgaagaataacagcaggatgagaaaaagagtcactgtaacctgtggaacaacaacgtaagaatcaccaacccctaggctgagctagaactggaagccaggaatatggcaatgagtttcaagatttgccctcagaagatgaactgggtgaggtatgggttgaggtgagggcacaagcactcatcctacctaccctgctgctgttgaggagctagaagtaaaacatattggttaggattttaacagttggagtagcctcccattatcagattaagtgggggtcacttttgcttccaaactcagaataagtttgtaaacatgggaaagtctaagccaagagatctaaagctctagaaatattaatgacatttctgggagtaaaactactaaaaattatatcttaaaagtttctagtagtatgaagttcccaggccaggcgcagtggctcacgcctgtaatcccaacactttaggagggcgaggtgggcagatcacctgaggtcaggagtttgagaccagcctggccaacatggtgaaactccatctctactaaaaatacaaaaattagccgggcatgatggcaggcacctgtaatctaagctactcgggaggctgaggcaagagaatctcttgaacccaggaggcaaaggttgcagtgagccaagatcacgccatcgcactccagcctgggagattgagcaacttcgtctcaaaaaaaagtttccaggaaagatctttgggtcctactaagcgtctca

SEQ ID NO: 80752 - DNA, 2718 bp, Homo sapiens
tactacatcttcaccttcttcatgtcacccatgcacttcccctccctagtgctcactccaaattcaaggaaagaagaaaggcaaacctctatccctgtccgtgaacaagtgggtctattcagaaaggttatccactgccccagattgaatgagaagctgagtctgtcttaactttacagaaattcagctgcacaaacttgcagttgccttcccttgaaacaccttctatcctaatagtcccataaatgcaggtaaaaatgaaaatccatattcttgaagggacagcttctttggtatgaactcagccagtgagctgtgtccatttcctccataattctggatatcacctatctttttagcaccaagtatttattctcactagcagtagacagacttaaccagtctctaccacgacccagtagactctgacaacagactcttcctttaaggtgtcaacaactgacttactaggcaggactgccatccttagcatcagcccagttttggttaccagggactatatcttttgttccaggagagagtagaaagaaaaggagagatcccatccttgggtcatagacccattttcattgccattatctgtaagtatgtgcactgcatggaggacagccctaatagtctcccctctgctgccactgcctgattctccactctgtccccacttgccagtgaagtttggatttatcagccacttgtggcccattacagagctgacccaaggtggtgtcaccaatgcctcagcagggtggagtgcagttcagagcttataaatagctggcagggcatgaggagatgattttcttgcatgtgcaattctctaggggccatcaggaaacagagtttaaagtaccctttgattactgtcagaactgtcagcatttgcagttttccccgagcagtaattggccagctcccttctatcagtagccagtgttaactagtttaccaaatgctgtaaacaattgccctgaatgaaatagctgtcagtggagctctaagatctcctttagagggcacagtgaggtgggctgttgggatggccgtaggcaggggagaggaagaaggccactgatgagactgctgacctcctcagaaggttgacctcttctagagagactgcctcccagtgtttaagtggctcattgctccttctgactctgtaaaatggctctggaggacagctcacaggaattctgattgctgaggtgggtgattgagagctgttcaccatgtgtgcagcctgtgctccccttctatggatatgtgtgcaatttttgtatgtatttttttagctgtatattacagtgtttatgttgcaacttcacctgaagcgagtctacagaaaccctcccccttcttcccttggcacatatttgcgctaagagatgagcgttccttccactggggttgtgtgtgtgtgtgtgtgtgtgtgtgtgtgtgtgtgtgtgtgtgtatgtatacacatgttcacctgtgcttgttttattcaaaactgtgagtatgtgtttactttgaccttgaaatcccaagagtcactcgaacaatgtgtgtgtacacttgtgtgcccatgtgtgcgtgcacacgcatgctggaagtagaggccaggcctctagaaaagcaacctgtggcagggttgacagacatgttctctgtgcctagtgagtgagtgagccctgaggcccctcatctaccagtgcagagtttccttaaagccaagactgactgtgcagtattacttacatagcacattagtggccttggaaatttctaaacttttaacatttttaacagcttttcatgtgattcatgtataacaaagaggatcaggaaaggaaaataatgtattttattgtgctcttattacttttttaagtgattgtaatatgtgaggctctatttggagaatgtcccttatcccctggccagcaatataggactcacaggaaagaaggctggttagcccacaaagagtcttgcctcctctagccagagtgcagggctctgctcctaggaatggccatggagtgggcatgctgctgcaggccagcagtctgctcttggtgtcctgtggcatggccgcgccttgccttgaaggttggtgtttggttcatcttagcatagaacatgtgcacataactccttgcctgattatgcactgaagggcagcacacagaccactgaccatgtcagccagcacattcccttaacctcccccacctcccatcttgcaatgtcttgcatattgagatataccttctcaatgtcatgttcgtggtgccttgcccatgtaaatttcaatgttgactatttaatgaggttacatatttaatgctgaatgtttcctggtccctctatttgttatgtctctacttatctttttttttctttctctttttctgttatgatttggatccagtcttcactttaactctatggtataataagcatggacacctccactaccattatcttacagcactggtaaaccaagcacctcttcatatcagatgtttttagtactgtttttatattcagatttgttaagggcaaaagatgaatgcaaactagccagagaaaagcctcaggcttcccagagacaggtggctagattaatttttctctgggtgatggccaaagaatgtgagatagagagggaagggggtgttacaggttagagcagaatagagaaagaaacta

SEQ ID NO: 80753 - DNA, 1036 bp, Homo sapiens
gagctttccagagataatattttctgaaagatatatgtttgaacttgaactcaggctggggatgtctgttcaagaccagaagtttgcttaaaaaagaaatacttagtatatcctcaaactgaattagataggtagtagaagacttgaaggaacttgtgctgaggtatagatagatagatagatagatagatagatagatagatagatagatagatagattgattgatttccatggcactgatcactgatatcaggcttctttaactgtagtaaatatgataaactagagaataagagaaagagagagagagatgcttttctccgctgagactcccttgtctttgatctttttttttttttaatctatttgaatggaaatcagaatgtgctgcttctcagaactgggtcctatctgaatcttcctaagaatgtgtacatttttctttttaaataaaaatgactagaaattgcttttttaagttttgcttttctgtattattgtaataaacatgcagtgtaaacactacagagagtgcatgttcctgggagcctttgatatttgtaatgtggcagtgtgcctctgctgaggagggagagcagagaatgaccctcagttaacagggctgtggagcagactccagaccagactattatgatccatgaactagtattagagactcagtcttccacggtcagcctctctatagcatgagaataacccatttgggggtggttttacttactttttgctttgataaccccttaagagtagaaatagaatcgtcacagtatgtagaactcttggctaactttttttgatcaaaaaattcttccttgatccataaccacttagtaaagttctttatgaaaggttttattgcctcaatagtgggtattaaatgaggcctgttaagagaaagcataaaactcagaaaaccaccattgaaatgttggctttgttctgactaggtcagaccagtgactctctcaaccctaccagtgaaccatgagtgccagtgttgtgaccatcacaatg

SEQ ID NO: 80754 - DNA, 1005 bp, Homo sapiens
tcctgctgcacagtttataagtaaatgactcctggatattgatattgcagctccctctagtgtcactgtggctcaggctctcatagcattttttcttgcctttcagaaaatatagacagcacagaatctgccaaattcacagcattttaagtagattttcccaaacatagccaaggcaaatatgaggtgatttttcccctattagaaaagggaatgtttaatgaagatgtaggaccattccagttctagtttatttttattcctatttttaaattttgggggtcctaggaggagtcctgaagtaatcatttatagattaaagagtagctggcatgaacaagtagaatctttcttgagattcctcctgctactcttgagatgccagctactctttataaagaaggaatgtgaattcttttcaagaaagataatgagagccaagaagaagttactttaatccctggtagagaaaatactgggtaagggcagaaggaaaaaatttgacaggaagaaccctatccatttgttctgaaaaattggtttgttttctgaaataacttttgaactagaaatttgttatctgaagtcaggtcattttgaggttttttttttaactaaaggagttattaatatttgaaaaatggctacaatgtggtacctagaataatataatactcctacctaaattaacatcattgcaggctccataataaagatttatgagatacccatcaagcaaaatcctattatggaaatctccattggtctgtgtttgggttgtaactgttttcagggttatgaaccaagtaaaatcactctttttccctcctcttttacactctagtcttctcccttttgcctttgctcttaaagctagagtgactcattattcttcaacctgtctatgtattataaaatgaagagataaggaagtgctgcccactcaggttatctatctagggagaccattttcctttagagcatccaaaatcgtgaaacaattta

SEQ ID NO: 80755 - DNA, 1027 bp, Homo sapiens
tcttctaggatccaaaatcactttcttgggcatgtgaacatttttgcagcaattcaagctgtaaattatctggcctacccaacagttctcatagcagattcctacaacatggagtcctgagtactttgggcccacacagcgttttatatattaaacacttaatctattttgaatatagttgtaacagcattgagtgtgtgtgggtcttagctctgtagcagcaagtatagcaatactcctcctaggcagatcaaggaattgaggtcaatcactgatcagcctgtattcttagagtgggattataccaaatactggatatcaatttagaagttgcagggtttcattctatgctcactcccatttgcagttgtacttttgtgtgatatgacaaaatggcacagatggtgtaatgtgtatgattgttaatgtttctcatttttgtccctccacaattcattccctatagcatccatctcacttaaggttcactgaggcactatagaatgcatagagtgagatggaaatgagattccctgctgataaactggaagtaggctgaaggcatactgggcccataatggaaaaatcagagctaatgtagaatatttttgaagagtcttatattttgtaattattgctttctttggggcaaaggagagaaaattgaatcgaatgacagagagccatgttgttttgtagttttgtgcagtacaaaatcagcaagcccccagggcagcctggactcaacagacagccctcactgatcagatttcactcatttgtgtagtcaggtcattcatgagtgtttattattcaggtttatctgccgttgcccccaccccatcaccttgccaacttttatctgtttcataaaagctgttcatatattctacctgttccgagtaaataagccctatggcagcactggatcagatgctgccttttctcagaatcttttacagacatatggagcaagtactacgtgccttgctctgtgctaggccctaaagatacaagtatctgcttg

SEQ ID NO: 80756 - DNA, 1131 bp, Homo sapiens
agagaggtcagaaggactggaagcaaggaagccagtcattatgctattgcagtagtccaggtaaaatgagacctgatgtaaggcaaaggaaaagaaggggcagatggctaaagagctgaggaaggcagtagaccatgtctggtgagtatgggattagggcagtgatgctaaaatttcaaggtagaacaacctccaagagaatggtgatgccattagttgaaatatgaatcagaaaagccagaaagatgagatctcaatgggttatgcccatagggcagccaagttgaaagaaccccaggaaccaggtaaaaatatgggtttggtactcagaagagagctcaagcctagaaatgtggtcatagacttgatttagttgaaactgtgggactacatgagattgtaatggaagagtctgcaaagtgggaaaaggcccacacatctaagtgacccaaagcaggagcaattggaaaatctgtagcaaaaggcagggccctacaggccagagagtccaaggttgcagagggcttgtgcagaatgaagactcagaagaaggcaagaatttaatgtcttgtaagcctcaagaaaatgcaatgttggtaataattggggtgaatgccagacacagtgagttaaagagcgaataggaagaggaagctgtggaggcagtgagcacagcctactttttaaataaatgttttggtgaaagaagagccaaattgatttccaaacaatatttaattttcaactcccattttccatctcatccatatcttcttttatcctctcttccccatttgatgagccaccacccagattgcattgtctgtctctgtgggctatatattggctggccttctgccgttaacttaaatattcctgctcgcaaagtaaaacttaacataaacttaagcctgaacttaacttccctgttctctaaataaaaatctaccttgctttttccctttcaaagaatctgggtaagcactgaccaagtacataatcctcatatcctcatagtagactaaatcctcatatctaaatccatagtagactaatccctcatatcctcatagtagactaaagccaattttagaagggccttcaccattctacacagtgggaaactaaggc

SEQ ID NO: 80757 - DNA, 1033 bp, Homo sapiens
cccaagtattttctttatccacaatgctatcatctctactctgtcacaatccaagtatattcgagtgtctgtcatcccttaatattctggtgtggtgaatatatagcactctgaagggtgggactggagaatctggtttcctttttgaaaacaaaactcatcacccaaaccagtgccctgttcctagacaaggccaagacattatgcatatttgtcgttcccaccaaggcttggatacttcaatgtttaggtatttgttctttggttgttctcttttcccattttgaactaaagagttgacttattcttacattcccatggctacctcactcatttctgctcaagtttcagttataaaattagattgaaaactttacttactcttttctttttattgctttaaaaacaatacagggcaatctagagcagccatgatacctcccaagcagccacgacagcccaagggagctgtggacgatgccatcgcctttggagggaaaacagaccaagaagcacccaatgcttcccaacctacaccacccccactgccaaagaagatgatcataagagccaatacagagccaatctccaaggacctccaaaaatccatggaaagtagtctttgtgtcatggctaatcccacctatgatatcgaccccaactgggatgccagcagtgctggttcttccatcagctatgaactcaaaggactggacattgagtcttatgactccttggaaaggcctttgcgcaaggagagacctgtcccctcagcagcaaacagcatttccagcttaaccactctcagtattaaggatagattttccaacagcatggaatccctctccagccggcgtgggccctcttgcagacagggccgaggcatccagaagccgcagagacaagcactttatcgaggacttgagaatcgggaggaagtagtgggtaaaatccgaagccttcatacagatgccttgaagaaactggctgttaaatgcgaagaccttttcatggctgggcagaaagaccagct

SEQ ID NO: 80758 - DNA, 1044 bp, Homo sapiens
ttaatcagagattttcctttttttctttcttcctgaatgatttgtctgtttatgttgtttatatttagtgactgaatcaaccttctctgctacttttctcaattttttttattttttagtcatagtatattgttatatctaaccttaaactctgagaacctctcccttttcccctgtctctcttttatctttttttttttttttttttgagacagagtctcactctgtcacccaggctggagtgcagtggcatgatctctgctcactgcaacctctgccccctgagttcaagcaattgtcctgcctcagcctcccgagtagctgggattataggcacctgccaccacacccggctaatttttgtatttttagtagagacggggtttcaccatcttggccaggctggtgttgaactcctgaccttgtgatccacttggcctcccaaagtgctgggattacaggcatgagccactgcgcctggcctcttttatcattttaatcatacaaagagctattcttcctttaagcattaagacatgacatatcactgatgcattttttaaattcttactccttttagagactgctgtcactgtaaatgcagattaaaccttttagcatccatttgcaaatccatgtgattttacttttatcaactctatttgcgtagttctttagagttgacaattactttaattgatgatttaatataccagtgcacttatttaaaatgtgctcataaaaaccaatctttatctggaatataggctgtgctgccttagtttgcaaagggttaataaaactagctttcactttgcttggttccccaaaggtaatttggcacatttcccagaccaaaccagtaaggtaagggtcaaggtgcagtgagtgatattaaggaacagaatcaagccttttctcatggtttgcctaacttgtagctctccagaactcagtggaatctatggtttatctgagtgtcagagcatgattaacagactcgagaaggccctgtgaaattttcctttaatggggaattgtgtt

SEQ ID NO: 80759 - DNA, 1002 bp, Homo sapiens
tttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgttgtatagtttgaagtcaggtagcgtgatgcctccagctttgttcttttggcttaggattgacttggcaatgcgggctcttttttggtttcatatgaactttaaagtagttttttccaattctgtgaagaaagtcattggtagcttgatggggatggcattgaatctgtaaattaccttgggagatattaaacttttctttaaggcacattggagttttcacatttcataatgtcccagactaagtagaaaaagaggtattcagtagctttttttaactttttgaaaagtttaaagcatgaatatgcacattgaaaaatatataccatttgctttttcaataattgcctcatttacttggatacaccattggtatttacttgaagcaactttgataaggaaaacattaccatcaaatgtcaacatttgtgtttcaggcttgatggcagtgtgatcattaaattaccaccccacggctgggagctcactgctgaaagaaatgaaaatacagtttttctataaataaatgaatatttcaagtctaaactgtatataaggaatgaagaatgaaaaacgaaaaaatactgtactaaaggccagaccccaggctctgaaagatgaggaactttatagagcccttcattatgggattagattgttactaagttcatttatttaactgtttaggaaatataaattgagtgtcttaactgtgccatgtatttgccatcaggccctggaacaaatagggggaaacattatcc

SEQ ID NO: 80760 - DNA, 1049 bp, Homo sapiens
aatacaaaatgagctgggtgtggtggcaggtgcctgtaatcctagctacttgggaggctcaggcaagagaatcacttgaaccgggaggtggaggttgcactgagccaagatcacaccattgcactccagcctgggcaaaaagagtgaaactccatctcaaaaaaaaacatgtatttcaggtgcctgatttatttagaaaagaggcagcttaaacagcaaatggttggagttacataggagggaatggtagacagttcttacatggtgtcattcctgattaagtaccactgtagtgtatctatccacatcttagaaggcatagtcaagaaatgttcggcttctttctgtggaaagagactctctcctttggctgcatgccacggtatataggcttgagggcagcccaggccctgggcttggcagacctcttactatacagcttttattttcacaattaggttatacataggccagtcaggtcttccaaaatgtatccgttttttgaagttaacatccatgaatccaaatagcacagttcatttgcccattggttcttaaatttaaccatgttccagaatcatctagagagctgttaagacacagattgctgatccccacccctggagttttttattcagtaggtctggggtgggtcctgataatttgcacttctaataagttcctgggtgatactgatgctgctggtccttgggtcacacttagaactgctggtctcaccaccattataaagatacatgctatagtctgagtaaagcagtgattgagatattaaacttttcttttttttttgaaaaatgtaaaactttatttgttagcatttttctttttttttttcttttcttttttttttcttcttattattatactttaagttttagggtacatgtgcacaatgtgcaggttagttacatatgtatacatgtgccatgctggtgtgctgcacccattaactcgtcatttagcattaggtatatctcctaatgctatccctcccctctccccccaccccacaacagtccacagagtgt

SEQ ID NO: 80761 - DNA, 1084 bp, Homo sapiens
tccagccacagctccccagcaaagatccagagagccactcaagagcctgtggccaaaatagaaggcactcaggagtctcagatggtgggcagcagcagcaccagagagaaagcaagcacagtgctttctcagattgtggcttcaatccaacccccacagtctcctccagaaacacctcaatctggccctaaagcttgcagtgtggaagagctttatgccattcctccagatgctgatgttgctaagagcacacctaagagtacgccagtccggcccaaatctctctttacatctcagcctagtggtgaggctgaagcacctcagaccacagacagtcctaccaccaaagtacagaaagacccatccataaagccagtcaccccctctccctccaaattagtgactagcccccaaagtgagccaccagctccctttcccccgccacgctctacttcttctccttaccatgcaggtaaccttttgcagaggcatttcaccaactggaccaagccaaccagccctaccaggtcaacagaagctgaatcagttttgcactctgaaggcagcaggcgggcagctgatgcaaaacctaagcgctggatatcatttaaaagcttcttccgccgtcggaaaacagatgaggaggatgacaaagagaaagagcgagagaaagggaaactggtgggcctggatggcacagtcattcacatgctgcctcctcctccagttcagcgccatcactggttcacagaggcgaaaggagagtccagtgagaaaccagccattgtcttcatgtacaggtgcgaccctgctcaaggccagctcagtgtggatcagagcaaggctaggacagaccaggcagcagtcatggagaagggtagagcagagaatgcattactacaggactcagagaagaagaggagtcattcttctccatcacagattcctaaaaagattctcaggtatgtaaaatagactggaagaatatgggaattttttaacacattttcaggtgctaagttttttatatcttttaagattgcataagaaccatttctgtttgtaagtagcactctgtggccat

SEQ ID NO: 80762 - DNA, 1414 bp, Homo sapiens
gcctcccaacatgctgagattacaggcatgagccactgcacccagccccgaagcttcattttcaatgcattgagtttgaggagtctacgaaatgtctaaaacattcaagggtaggtggaagaagaggaatctataatgggctgggaagtgttagagaaattggtggataacagaaggagtggtatcaaaggcatttctgggagggaaggtcacagaatcattgcaacagagacatcaagctgaagattatgtatggatagataagagtgcataaaattatagttaaaaagctcactttccaaatgctgattggctaaagggaaattacaaagtacacaaattagtttagctctcagtcttttaatttaaggaaaagtttaggaatggagtcagttttttcaagtcactaataatggtaagtctcatagtgcctttttcattcagattttttgtcttcttttcccctccacagattgatcattcttagaagagctgctgtaacacataggggaagtgaaaactaacagatgaaagttttgtcatgcactgaaagaaaagcattgtctgtgaagttctatttttaaaaatgtctgcttgtaacacctttactgaacatgtttggaaacctggtgaatgcaagaattgctttaaacctaaaagtttgcaccagcttcccccagaccctgagaaggcacccatcacccatggcaatgtgaaaactaatgccaatcacagtaacaaccaccgcatcaggaacacgggcaatttccggcctcctgtggctaaaaaacccactatagctgtgaagcccactatgatagtggcagatgggcaaagtatatgtggtgagcttagcatccaagaacactgtgagaacaaacctgtcatcatagggtggaaccgaaacagagctgccttgagtcagaaaccacttaacaataataatgaagatgatgaaggaattagccatgttcctaagccttatggcaataatgatagtgcaaagaagatgtcagataacaataatggactaactgaagtgttaaaggagatagcaggcttggatactgcccctcagataagaggaaatgaaacaaactccagagaaacattcttgggaagaataaatgattgctataaacgatcattggaaagaaagcttccaccaagttgcatgataggtgggataaaggaaactcagggcaagcatgttattctgagtgggagcacagaagtgattagtaatgaagggggccggttctgttacccagagttttccagtggcgaggagagtgaagaggatgtacttttcagtaacatggaggaggagcacgagagttgggatgagagtgatgaagagctgttggccatggagattcgcatgagagggcaacctcgctttgccaacttcaga

SEQ ID NO: 80763 - DNA, 1029 bp, Homo sapiens
agatcatggaatcctggctacctcctaggggcagcttcagccattaaactctcccatagactatttcatctagaagatttgctttgagattataaggaatgtggaggtaaatgagcttttcttatcaaacattccatttgggtgctctgtatcagacctgttctggcaaataaatagaagacaccaggatagactgttttatttccttgtgtaagtgcctcaggagacacatttcttatttctcaagcataactttggagactggagtttcccatttggggagcgttggtgttgagcagggaaagctgctagttattgattgccactgaagtcatttcacaaaggctgtaaaacccaaggattgctctttggacagacctgcatctggtacagattccccctctatgagactgttgtaggttaaaatagttttgacagtgtctttaagtgcacctctttgtctccaaatataattagtgtttaaaatgaagccctcgtggttaaggttttgtggcttagacagcagctccatctggtgcttgctaaaggtgtttgcctggttcatgtctcggtttttttgttttttgttttttattattatactttaagttttagggtacatgtgcacaatgtgcaggtttgttacatatgtataagtgtctcggttttaaaccagatgaatacagatggacacaaacttgtaaacgaatgtcatatgcaacatgggttcctagtgcacacaacactgacataagcaaatggtgttcctggtgagtctcatttggctattctgttgataagtgatagctgttaatcagcttagccatcttttgactgaattaacttacttttactcaaagtggggaattatttttactattatctactagtctttgaaaaagcaaatatattgtactacttacaaagagaaaacttaatcccactcttatcagagtctgtttaacttggttaacaagatattatgccaagatgccttattcttttttgtattcagtgctgcatagtgct

SEQ ID NO: 80764 - DNA, 1789 bp, Homo sapiens
tcagcttactgcaacctctgcctcctgggttcaagcaattctcctgcctcagcctcctgagtagctgggattacaggtgctcaccactactccaagctaatttttttgtatttttagaagagacggggtttcaccatgttgccaggctggtcttaaactcctgaccttgtgattcacctgcctcggcctcccaaagtgctgggattggcttcctttccacttttgcaggagcagatttagctgaccaccaggccaatctccttgggctcttccttcagttgggcatcttggcagtggggagggtatgacctggtgcctgcaggctgcggcgcaatgagagcctttgtgaagctgggctgcctggacactgctgctcctctcaccacccaagctgctcctataaacacttacatgcaggttttgtttggacataagttttcagctcttttgggtaaatgccaagaagtatgattgctggattgtatggtaagagttatgtttagtttttcaagaaactgccatactgtcttccaaagggtctgtaccattttgcattcccgatagcaatggataagtttctgttgctccatatccttgctgtcatttggttttgtcactattgtagattttatacattctaataggtgtgtagtggtaccttactgttttaatttgcaattccctaataacgtgatgtggtgcatctttttatttgctatctgtatattgtctttatctgtttcttcaggtcttttgcacactttttaaattggttgttcattttcttattgttgagaattaagagttatttttgtattttgaataacagtccctttgcagatacgtgttgcaaatatttcgtatcactatgtggcttgtgttctcattttcttcacagtatcttttgcagagtagacgtttttaattttaatgaggttcagcttaccagtgctttctgtcaaggatcatgcctttggtgtcaaatctaaaaagtcatcactaaactcaccatcatctatattttctcctatgttatcatttaggagttttattgttttatgttttacattgaggccattgattcactgggagttaatttctgtgaaggatatagtatctgtattgagattttttttttttttttggatgtccagttgtttcagtaccatttgtgaaaaaggctatgctttctccactgaatttcctttgtcagatcaattgactgtatttgtatggatctgtttctggtctatctgttctgttccattgatctatttgtctgttcttttgccagtatcatactgtcttgattactgtagctttatagtatgtcttgaagttgggtaatgtcagtcctccaattttgctcttcatcaaaattgtgtttattctttgggttgtgctcttgattttaaaacacaagaataaaacttcatcattgtattctgctttgcctacctattcaagcaataatataaatgatttttaaattttcacagctactatttcccagatttttattgtctctatgttttattgactattgaacaataccagtttgaacggcgtgggtccacttacatgcagatttttttcaataaaagttatgctgtgagtgcctgcctctcttacgtccccttccacctcctcttctgcctgtgccactcttcagacaccaaaaccaacccctactcttcttcctcctcctcagcctactcaacattaagacaatgaggatgaagacccttacaatgatccactttcacttaatgcataaatacattttctt

SEQ ID NO: 80765 - DNA, 1600 bp, Homo sapiens
attttgtttttgttttttgagacagagacttgctctgtcgccctgagcacacaaggccagaatgcattggtgcagcctcggttcactgcatcctccacctcccaggttcaagccattctcctgcctcagcctcctgagtagctgggattacaggtacctgtcaccatacctggctgatttttgtatttttactagagatggggtttcaccatgttggccagtctgatctcaaactcctgacctcaggtgatctgcccacctctgcctcccaaagtgttgggattacaggcgtgagccactgcgcccagcctgaatttattttcttaatcaatgatttctcttcctattccttcagattcctatttaaattttatctttggtcatcaaaagttttctggtttaaaagacactttttcctgaaggatatggaggtaatctaaggacaaaatcagtgtagagtcttgactttttactggatttaaaatggactttttactggatttaaaatgctgggtttcaaatgaattacatatatattgcttcttccctttgggaactttgagatctaaaagaacttcaactttatgatctgcaagaacaaactaatgacttgtccatcaatatattaccaataactttagtgatagaagctttaatatacatctctggtatatatggaaactataagttgaatgtaggttgtgtaaaaataattgcattatattgccttagtgtaacataagaagtaaatataaggatagttaccatttttaatcacttatgctatagcacttagttatcctatttgatctctgtaacaactggtagttgctattgttaattcttatttgatagatgaggaaactaaagttcaaagacataagtaactggcccagggatacatagaaagggaaagtgtcagagctgagaccaaactcagtgtgttagtttcttattactgctgtaacaaattgtcataaacgtaattgtttaaaacaatacatttattatcttggaattcaggaggccggaaatatgaaataagtttcactgggctagaatcaaggttttggcaggtctgcattccttcagaaggctctaagggagaatccatataaggtaacaatttcacaagttctggggatttggacatctttgtggggtcattattctgcctaccacacccagtgaagaaaaaattttaaaaatattccattgtatcctctcagcatctcacagaaaggaagaccagttattatcatcccattgtgcaggtaaaggatcctgaggcagaaggaatttgtgactttgccagagttttctaactagttagcccaaagggatcttttaagtccagaaagttctctgctgtatcatacttccataacatttttatcagcattacacatctgatgctaatataggtatattgctttcatgtctctagataatcaaatttgaattcaacccaaattagacttgattcagtgcccttgccatctgttagcttgtttgatagtttctggtataaaagacatcttttcctgaaggataaagaaataagcccaggataaaatggatgcagtgtcttgacttcatt

SEQ ID NO: 80766 - DNA, 1087 bp, Homo sapiens
caacttttaagtaaatcaaacctcaatgcatagtacatttttgttaatcaactctctaaaaccaaataattttaccaagactgcatcattttttaccaagtttctcatgaagaattttaactgacagtcttttcattgaggagcacacttttactcttttatctactagctaattatgaccatcttttcttcctcccgtcttgccccactttgaaaaacaaagtatcttttgcttttgtcatacctaaattgctaacatctgtaaattctttttgtggaagagggaggaaatgttgatgtctgcatgcttctcaatatgtatttaaaaatttgcatatgagtcaaaataaaattatttaacaactattcaactaaagtatggcctattaataaatgaattttagcatataaaattactagggtataaaattatagtagaaccaatgaatttagagtctcaattagttaaaaagtgtgttttgaagataatgagtactttttaattgctacatattgttttcagttgagttttgttctttgcagtaatggtagccagaaagtcatttttgcttgtagtatctcaatcaaaagatattttattctttttccagtcttcacaggcccgaccctttggtgtatgagtactgatgggactgcagtatggacaaccccataattaggcttgcaattatggcagcgttacactctactaggaagtaaatttgagatataaggttgatttttaatttagcacctatataggtatatcctgactaaagagtacctgctatatggtaactgatactaaagtccttatgatcacagtatgtaattgtctgttgtttaccaaattaactatgctcatacatataaagggattattttacattgatttgcttgtataatagccctcactattaaataaacaatgtgtacactccctccaaataactttaaaaatcttatctttttgtgataattcagattattgaaaaatttcggggtcatcaatcattgctgaatcatctcatttccaatccttcctttctattctttctgccgctagcctagttaaaacctcattacc

SEQ ID NO: 80767 - DNA, 1044 bp, Homo sapiens
tcaactttattttgaaaaagaaaaaaaaagaattaattccattccatcctaactcacctgaatttttgaggccaagatatgccccagtagtgacattcttactgtactcttttactgagtatagtatagaggagaatcatcaggaacacagctggcaccttgaggagcacgacttaaaattggcgttgcatgctaaacctgggcaagccaacatttgtttggttagtaatcttttcaggcagagcctttgattcggcccaaaattcctgcagattatcacagaagtatttttatttgcagccaaaatccttcacaaaacttcttagtacattctgaaatacaagcatataggctataatggtttttaaattcctttttctctctcacattaactggttttcttatagtgtgcctaaaatgtttgcccagttaggtgcttcataaaagagattttttccaacagcacatgtgttccaggataacctattagctatattatataaatgggaactctagttgatgggatattcatctgtaagaaaatattctctcagtacccctgggcttagcaatactatcatttgtctcacttcaaagctaattgaaatcagccagcctatgtttcaaaatatctacacgtattaccaaccatctggctgctcacaaatgatgaagacatttaatataaaacctggttaatgcactaccctttcacctctagagaagaaatcttgcctaggacatccatagtcttactttagtgttggtctacaacagggcaatcatttaggtccccaaactcataataattttatataatccctcccaagtgactgaccacgtgatagatgttaaaatgatctttgctgggctcattcacgactgcaatgacagagtggaaagtttatgtataaccatcagacctagaatatctagagtacattgcatgtgggtaaagggcatatgctacagttttttagtaactcgaacttattttttctgattatgaaaacaataaatattaaatgaattctatcctcatag

SEQ ID NO: 80768 - DNA, 1009 bp, Homo sapiens
ccctgggctcaagtgattctcttgagtagcctcccaagtagctgaaactataggtgagcaccaccataccaggctaattttttttttttagttgacctggagccttgctatattgtccaggaaggtcttgaactcctgggatcaagttatcctcttgccttagcctcccatagtgctgggattacaggcatgagcaactgtgcccagcctcattttcttaagagaaaaatatatttactagaaaaattattaaatcataggacttttttcttatttattctctgcagcaaaacagcataaaacattttggagatggttgtatctaaagtgtttaaatctcatttctataaattgtaaacttctgaagattaagcccagaactcttctaaattgttgttttctgtatatttatttggttttattcttcttggtctaatcctaagtatgtgctatattaatatattagagcaatattgctcttacttctacttttcctgtctgtatgttgttcattttcatattatgggtagaaaaccatcagcccctgtttgatcttcctactatagtcaatgtgcctctgtgttacttatactactccaccccccttatttgtttagggatatcatgtattagaaaatgggatgatttaatggatgcctacaaaatatgtaataagaatggtaaatttgctgaaaaacaagtaattacaaaatgataaacttattctagattgccatttttgtttttccagtctagtaataaatacaagttctcttcctttgatatacatcagaagtacctgaactgtttcagatgtttgagccccctctcagacctgctggcttaggatctatgggaatgcaactcatgcatctgtattttaataaagattacagatgattgtgacaggcactaaaggttgaggacaactgccatatagtaaaatagaattgtagactctggagctagatagatctaagtccagagttcagacataccatgatctaag

SEQ ID NO: 80769 - DNA, 1038 bp, Homo sapiens
tcatgtcctttgtagggacatggatgaaattggaaatcatcattctcagtatactatcgcaaggacaaaaaaccaaacaccgcatgttctcactcataggtgggaattgaaaaatgagaacacatggacacaggaaggggaacatcacactctggggactgttgtggggtggggggaggtgggagggatagcattaggagatatagctaatgctaaatgacgagttaatgggtgcagcacaccagcatggcacatgtatacatatgtaagtaacctgcacattgtgcacatgtaccctgaaaattaaagtataataataataaaatttaaaaaaaattagccatagacaatatataaacaaatgaactggctatgttctgataaaattttatttatggaccatgacatttgaatttcatctagtttttatgtctcaaaatattctccttttgatttttttcaactctttaaaaatgtaaaaactatttttacctagcaaaccatatataagcaggtggcaggttgtatttgacctatgggtaaaggcttgacaacccttactttatgattaaaaatctcctcagtaagctatcagattcctagtagaccattgtatttccattctatatgatttttttttttttacctgaaactattcgctactattaagttaaatagcagagtaaataagatcacaccaattttagcctgtagggctttgaaagattatatagtgtcaaaggtttgaaatcatttatagtgtctgagtttcttcagccagttggggagttgaggctagtgtctaatttatcttactaccaagcctgcacattttatatttttcagtcatgcaaggctaattccttcctccctatttttgttttattatgcttatcttattaatgttcccaaattagtacatagttctttatcctgaatttagtcatttttggatgaagttgtctgggtactcatgaacagaaagtcccttcaccttatatttaacttcatgctatccccacctacaagatcttggat

SEQ ID NO: 80770 - DNA, 1027 bp, Homo sapiens
ttcagagttttaaaaaatagaagtataggtaataaaggagaattacagaatctgttggcctgcatttgtaagatcagtccactttgagttgcccagttatttgaatttatcggagaaaaatagtaccaagtaagtataaatattcaagtagttattgaatatttcattagcttatgtatgccacgtttatttttcttaattctcaatgtgagaaatttggatgattttcataaatattcaaaaattattctcctgtacaaaattgagagtattgttgaaagagataataatttgctcttgggtctttttatttcttttatgaaaacccatctccaaaaaaatttaaatgaaaagttgctaattgcaatgagggttttctaggaagttattaaatttgattcttaaattgtatgaacttcctcaatagctttgcttattcttatatataaacagaacattttaatataagatttggtagtataatacattgctagtctgcagctcttctataggagaaatgaagatctttgcaaaagatttggggactccagattttctatgtagggttaaaaaaatttttttgattatattgaatgaattcagtaacaatggcttactttcttttctccagcaatatgaataccatgtcttataaaaattaataacaataggcatcatttggctggcagaaatggcagttcacatacttttttacagcaaatatagacatggtctgatataataaaggaaatagactttttttttgagatagagtcttgctctgttgcccaggctggagtgcaatggcgaatctcggctcattgcagcctttgcttcctgggttcaagcgattctctgacctcagcctcctgggattacaggtgagtagctaggattaccggtgtcaccccacctggctaatttttgtattttcagtagagatggggtttcaccatgttggccaggctggtctcgaaactcctgacctcaagtgatccacctacctcggcctcccaaagtgctggga

SEQ ID NO: 80771 - DNA, 1050 bp, Homo sapiens
gatgtacataatttcagggcatatgtaataattcaatattcatataatcaaatctcctttaccattttaggtaagggtaattcatgagccaaagaagataaggcatccttacctctttattccctagtgactcattttcactgtctacgttgctctcttagtgcctttctttcccctcttctttttagtttttattgaaagaaaataaggggaatattttaaacagcagtgaatctttaaattaatacacttccttttccatctacaaagttaaatatttgaaatagctctttatattaaaataccacttacatcttttaattttagaaacatcagcacattgacgtatcatttcttgcttattccaggtacccaaaattttctttgtagaagaaatattcactgttgaagctttagctgatgaagctatatgagcagataaaacaggaagagaaacattctttctcccctcgtttataaacaaaaatctatgtagttgaaactgggtggatatagctataaaacataagctcattcttactgtttggacatgttttacttcttgttgaaatagatgttccgcaactataagataagaagtctgatccactgtttggaatttttcagttgatggtgcattatgtaatactgtgttggaatttactggcctacagtcttgaggtagtgttttgcattaagatgaatcagttttcagtatcaagtaattccatggtaacctacatggaaaagagtttctgcttaaatgaatcagagtatgatgaggctttattaataaggttgagatagttgaatatttgagaagtgagagttaatttaaaagacttgagaaaagaccatgttcttcaaagcatccgtagtccacaaatctagtaaaagtgaagatcacttctcactgtaatagtctataaggattttttttgttttaaaatgtctttttttctcttccttagtattggcaactgttttatgttgtatataccatgcttattttaatataacactcttataaatgaagacctacacagctta

SEQ ID NO: 80772 - DNA, 1032 bp, Homo sapiens
ggaaaacagacctcttcagctacagcagaagtcagtgcagttattcattctaaacaaattagccctttggctttcgtattactgaccttccttcctgaataattcagtctaaaagttttaagacagggcccaggaaggtgtaggtgctagggtttcttggacaatgactgattctagggctgggacagggaaagcataagacaagatgtgctggacacatctccctgtaccagaaagtaaagtagagctcgaagaatgaggggattatatctaaaggatgcagaagccaccttgaaggggcactcactggccaattcttgaacagtttgagcatcagactaaatagtcatactatcaaatcgtagctctttgaataaaataggaactcatgagaccacagtgatctaataaattagtggggagaagaaaaggaataatggaaagatcaccatttgccaattattgtaatcagtgatctttctaattccatgattcctagctgataggatgcagtgaggaacacagcagcatttctatgacacttctttcaaaaatgcataactgaaatctaatttggaagaaaagagaattccaagttgagagactttctacaacatacccagtgtgtaatgttcaaattcataaagattatgaaagtcaaggaaaaactttagaactattccagatttaaagagactagacacacttgacgattaaatacatctcataataccctattggatgcctttgctacaaaagacattagtggaataattggtgaaacttcacaggctagtaatgtatcattgttaatttgtcaattttgatgatcgtattatggttatttgggagaatatttttagaggaattataaacaagttattagggatgatgggacataatgtcagcaactttcaaattggggaaaaaaccattcttgaacttttctgtttgaaattatttttaaaattaatttttaaagctttcaataaaagccattgtgagttgagtggataagaggagacattcatt

SEQ ID NO: 80773 - DNA, 1019 bp, Homo sapiens
ttattctgttgaatatctgttagtatacctgaaaagctcaattgtgccgtgttaattcttaaatttttaaccttttatttattctgttttcaacatttgttaagcagctagtatattcctaacactaagtattatgaagcctgtaactaaataaaggacaaaagtatcctcagaattcccatagttaagtctaaaggaagatttaaacttgaattgttgaagaggtcttattgattccttcccactgagtcttcctcctcagagtttaccaggtaaataccccagcctatatactcaaaatttgagagcaggatcaaagagagcagggttctcttttccagtacttggactatttgccagatcctttccaaattgtatcccttttgttgagagggggaagtacatgcaaaagctaaaatgcataatccaatttactctatatgatccagcttacaagcacaaataaggaaagagtttatagtcttgttgaaatgccttgatagagaggaaattgtatacagtggaaacctagaggaggtagttagcataagacctcctgaagaggagtggtttttataaataaactgattgttaagagaaggcaaaagctggttagtaaggaagctaagggaaggcttttgtgatgattctaaaattttattaacccaaatgtttgtatctatcgattgattacgcttctctttcctttgttatctacgacagtagatctctgtagatcttttattctggtaatgttttcaaaaggactctatgttctttgtgaaaatgtcagcattagaagtttagaagtttcagttgtttatgcttacttaagacggtttaaccaaacattgtgtccagtcccctcattttacacatagagaagctaaggtccaaataagctgtgatacacttaatgtcagatacagtaagcatcagacctgggacttggcttggctattggtcatggtttctgtcctgaatctctagttgaaaaatgcatgaaggttacttatggt

SEQ ID NO: 80774 - DNA, 1018 bp, Homo sapiens
gtccagtggtattattagttactttggaaagcaggtaagtatcagaaatgtttggattttctttacatattctaaagccttgctttaagtgatagtcaaacatcataggctgctaagtatttttggatgtggtttgttgttgaatatgtttacttgaggcaaataatagtgggcccttttgggattattttaccttgctaaacttaatttctgaagattttaaatatggtacatgagataggttttcttctgtctgcctgcctatagcacgagctctttgtcaccagtatttttttatatatgtatatcccacatgtcaagctgtttcctaaatagaatagtatcaagaatatagaccctgattaattctgtgtttggtggaaaatgagagacaatcagtttcagaaacatcttaacatcttagggagttgttttttcaacattgctaggatattggatctaagagctaagaattatttttgtttctcttagattacaagtcaggcagtttctgtgatgagagaaatattccttgtatccagaaaatgctgtcatcagatggaaagtgcagaccgaaataaggagagggagtctcagaagagagctttttagctttgttagatttatgacagtagaaaatgtgtattctcattcttacgaatgttttaaaatgattttggcatttctgtttctttggagatattttatgtcctttcttttatttctcctaatttaaaatttctggctttacttacctatttgagagattatcaagaccaagtattatggtttgtcatcacaagatagtagttgaaagtgtttattgatgtttttgagcatctcctttatcaaagttaatagaccctaatgtgaaagttcattatgtcattctttaaaatccaaagatgaatctgtgtgttgggggaagggagtagcaggagggggaagttaattgttcaagatagatggctaaaatggcttagcaaatggggagacttaactgcttatagtctatgga

SEQ ID NO: 80775 - DNA, 1219 bp, Homo sapiens
aacacctactataatctagttaatttatgtctttggatatttctatatctttggaaaatattatatagtgtttagtacatatatatataggttattaattttcacaaatggccttggtctgtacatcccattttattctttttttttttcatttagccctatatttaaacaatctatttttgttgctatatgcaattctggttcattacttctgactgctatacagtattatatcatgtacacactcttatccatgtatactgtgtatttgtcttatttatacatttttctgatggcacttgggtgtattcaactccatgtgccattaataatgttgcagtgataatcttcattttattttatagaggtatataatcaagaatgtgattgatctgttgttggatgtccattattaagttcaccaggtattgccagattgctctgtaggatgactagatagtttttactgctttgagcagtgcatgaggattcacagactctatatttcatgtgggcaacaagcaacaagcaactgaagagctgcttttatagacatgattagcaaacggccaaattatttatgtgtgaataatataaaaccaaagtaggttaccattaacccctcactcagaagggactcctgagtggaaaagctgccttggttcctagtaaacgtctctataatgagagctttttggtgagagaatatgagggtgagccctcgttgcaagtaactctgcctaccagccatgtggacagtttagttctgcaagatgtaaatgattagattctttgtgcccattgtggttcttggaatgcaaacatgaatgaggctgattctctgcccctgaagctctgtggttgtagaacaagtaggtgcaggtcttgtgctcatctgtcttttggagagacccctttgcttcatctcagagaagttggcactcactgtttagtctttcatagcagtcttttaatggcactgttattcttgttatcttaccttcaaaaattaagacacagagatacctgggtctattaactctgaccatttggagtcctactagtccatcattatacctaacctggtaaaagatttcccagaaagagataggtgttcttattgtggcatttgtttcctgaagtgcaatgattggggtgggaaggatggcatgttgtcaagtctctttgaattggtaaaatggagattggaaaccattac

SEQ ID NO: 80776 - DNA, 1050 bp, Homo sapiens
gaagatttcataaaaacaggttcgaattaaaacaattcagcgaagtttctggatacaaatcaacacacaaatatcagttgtatttctaatcattaacaatgactaatccaaaaatggtttcgaaatgaagaaaacaattctatcaaaaagaataaaacacttatgaataaattaaccaaggaggtggaagacctgaacactgaaaagtacaaaacattactgaaagaaattaagacataagtaaatggaaacagcccatgttcatgggttggaagacactgttgttaagatgtcagtactacccaaagcaatttatagattcaattagatccctatcaaaatcccaatgacttctttgtaaaaatagaaaatgtatcctaaaatttgtgtagaatctcaaggaactgcaaatagccaaaacaatcttgaaaagaagaacagagttggaggtctctcacttcctgatgtcaaaacttactgcaaaaactatggttatcaaagtagtgtgatactggcataaagacagatatataaaccagtggaataaaacagacagccggccaggcgtggtggctcacgcctgtaatcccagtactttgggaggccagggcaggtggatcacgagatcaggagatcgagaccatcctggctaacatggtgaaaccccgtctctactaaaaatacaaaaaattagccgggcgtggtggctggcacctgtagtcccaactactcagaaggctgaggcaggagaatggcgtgaacccgggaggcggagcttgcagtgagcggagatggcgccactgcactttagcctgggcgacagagtgaaactcttatctcaaaaaaacaaaaaaacagacagccaagaactaaatccttgcttatatagtcaaatgattttcaacaagggtggcgagaccattcaatgaggaaaggacagtcttttcaacgaatcgtgctggtaaaactatatttccatatgaaaaaagaatgaagttggagtcctaccttattccacatacagaaaactaacccaacattgatcaaaga

SEQ ID NO: 80777 - DNA, 2118 bp, Homo sapiens
tgtgtattgatttattgttcttttgtgttctcacctacccaacaacagtgttgccagttagtagttgcaaaactcagagattacttttgtgcatgcattttcacatctttcgaagtggctttgaacagagacctatttgggggtatgctcttattatgtttgcacaaatgatctgaaaactatcatggtggctgagccctgacttcctacattgctgttctatgtcttcttcttaaacctagaaatcttcctataatgcttgatcctttttaaaggaagaatttggaatatggagcagatgtatattttcttcgtgacactcagaaacatgtattgtaaatgtgtctgttttttagataccatattgttcagttggctcctctccacttgaatccttttcttttaattagttttccagcctggctgtcccctcagctgcaaaacaatgcagtatttgtaacctaattatttgtgaaagtgaatcatctcaacttaagtctaagaatgattgacctacttatagaagggttagcttgaaaatcctacgtgaagaaaggacaatgtaaaggattgattaagtaattttgaagtacgtgaatattagagtcattaatgatagaaacatggattcagtatcatactcaagcatatattcagtgactccgtaacccacctatctggtttaaataatctatgaacaaacagaataaaagtaagtcttgctacattatattaagccaatatcaattgagctttgggaaataggcctaaaaatgtgtctttggcaatttaatttgctcctattatgaacatttttatgttaaactgattgactctcttaaatacaacatggaaacatttatgtctttgtagtgtgactttaaaaaataattattgactgaggccgggcgcggtggctcacgcctgtaatcccagcactttgggaggccgaggcgggcagatcgtaaggtcagaagatcgagaccatcctgggtaacatggtgaaaccccgtctctactaaaaatacaaaaaattagccaggcatggtgacaggtgcctgtagtcccagctactcgggaggctgaggcaggagaatggcgtgaacccaggaggtggaggttgcagtgagccgagatcacaccactgcactctagcctgggcgacagagtgagactccgcctcaaaaaaaaaaaaaaaattattgactgaataaaattgtgattgcttgctaaggcatttttttgtattagttaaattataagtaagaaaggctttaaatctctattttaagagacatagtccatacatggtaagtcatgcctataatcccagcactttgcgaggccaaggcaagaggattgcttgggcccaggagttcaagaccagcctgagcaacacagttagacccccactctacccccacctgcccgccccctcccccacaaaaacaaaaaagaaaaaaagatattcatcatcgggttttagtcacagttctataactaagaagctggctgactttggtgccttgggttttcccgtgagtcagattaactattttatcatggacatcaattggatcttatacatgaaagtgctctataaaatgtataccacatttaggaattaagcaagattttagccctttttctgcctgctttttcaactctgggctggtcacttaagcttgccaagcttttatttcttcataggtaaaataaaggagtttggcctgtatattcaacttgagtattgtttacattgtgtttagcttttacaacctattatttattattttttctttttaaaaaatcagctgttttttaaagacatttcccttgcttatagtgtaattaccaaataataagatgggattcctttaaatttaacctgttttatttaatattcctatcaatcttgtaagagtaggtggcatgagactcattttactgatgaggaaaattgagactcagggatgttgtacgctaattagtgtgagaggtgggattccagtacaggtgggtctctgatcccagtcttctttttttttttttttttcttagcatgtggcttaagtgaagacacattgccatatacctcatgtagagcaagtttttgat

SEQ ID NO: 80778 - DNA, 1069 bp, Homo sapiens
tagtccacacattgatccttcactaaatgtctttttttgttttttttaacaaagctgttatgaacacctgtttggcacatctatcttcaaattgctttgactttctgagaagttgatcctgacttttgtatgtctgtcttatagggaaaatattttttgtctgttaaataattatttcaaatcttcttgaaacattaaatttttaaaaatttcaggttaatactctatatcataaacaaccttaggtttctaggcagaaatattcagttattcatgagtatggtatgaagttgctaattctcaatttgtagttttatatatattaaaaaatgacatatttctaaagtatatatattttaaatttaaaatgtatgtatttttaaattttggcaaaatgtccaggctctctccatagcccccatttcctctcaacagctgtccctcatctccccttcaggcctagtggtgcgtgtatctgaatgaggacctgtcttggaagtggactcagggccatttgagcagagttctggggtttcaggtagatagaaagtgatttctggagatagatcgagtaaggcacttcgatttggccctctgcactgctcacttcctgggggagaggtatggctaggaggaccaaatcctactgccttgatctaaggatagtagtgattttaataattttttgagacagggtttgctctgtcacccaggctggaggctgcagtgcagtggtgatcataattcactgcaggctaaagcaatccttacacctcaatctcctgagtagctggaaccacaggcatgtatcaccatgcctggccaatttttaaatttttggagagatggggtctccttatgtcacccaggctggtcttgaactcctgggctcaagctatactcccgccttggcctcccaaattgctggtattataggcatgagccaccacacctggctgattttaataatcttataataggtctaccagacttcattacctttagactttattctttctggtctgtccttttcttgtatgcccggaaataattgtctaaaactcaaact

SEQ ID NO: 80779 - DNA, 1018 bp, Homo sapiens
aagtccaggagaatttcttaattcttgacattctatagatatctaaagaacagcttggacgtaaaaatttaggaggtaaatgatcaagttagggttctattgaaataattaaatttccatactcagattcaaccatattgaccatgtctttttctgtttgttttttacaattcaggtatctgcccaaactggaacttatgctgtagacatttctttgtggtttatctaaaaaccaaaggtgagataatttatgaattcatttgccttttaatatatattttataatgagaaagaattgtttttgaaaaaatttaaggcaatatcaaatatcttttcctctgagtgttttaataggaaagttataaaactacatatagagtatgcttacttttaagcatgtttataagacatttgaaataaatgaaacttgttctagtgataaaatacttttgagtgaattttttctatatctttaatactcaaagacgaaattcatactactgttctctgatatacttgagaatatattggcattataatctaatatttttgaagacaagtcttccattagttaaatcatagattaaaacaactgctattttaatgggccattattaagagctttctaccactctactctcttggacttgatgactttctgtagttccctgtttgggagcctctgtaataaggatataggttaatagttgccttctatagaaagcttcccttttacagaaagcttctatagatagcattccactctaaaggtaggatcatagccttttcccgtttcttacctgtcttggctcaagtcctcttcttgttaaaatttttccaaatacatcgttgtaagtctctccaccttgagtctgactgctctgtcagccatttttatcattgtcaacagattatttttttctttaaaaaaatgtcagcctgtccgtctactactctgagtccttcagtatctacattccttaaggattattttacaaactcatttacagagcaatag

SEQ ID NO: 80780 - DNA, 1049 bp, Homo sapiens
ttaaactttatttaaaaacattaaaaatacttgaattatattctctataaagtatcacattgaagatttttttgcacattatcaagataagcatttattttatcaaatgctgaaggcaaacacagagaatagacagacttgaccattttcttttctagtactttagtatctggatttttcttgacagtctgatcactgatcattgtctgcatagttttgacagcatgcccattgaccctgggccattgatagacctggtatgtcttcatttattattttgccaaagaattagaagcctgataagctaggcagtgtcctgtgctttggctatgaagaggcaggagtgatatttaaagtatttaccagtaagtacaaaatagggaccaaccagttaagatggctgtagcactggatcacgatcttgaagaaccccttcatcctttatgctgtgtcaggctttcttgttttacctgctgggttgtagtggtggtggggagactgggccatcagtaggcaccttaggactggtggagtttgaggcagtgacacgttaccagactatgttacggaagtatttccgtacttaagtatgacccttcaggctctgttggtgtgtaccagttcaatattagttctgccaagaggtgttcagtcattgcctgtagagagcttactgttctctaaccataagagacagttatgatatagtttgagaggtacttatgtaagtatataaacgtgcataggggaagattgcatgcatcttttttgggaaaaccagggaagacttccataatgagtagaaacttgccagacaggtttaaggaggagattctaaacaagcaaaggggaaaataacaatttcaaaggcataggggcataagagagcatagtggattcagagatcaacagttaggagcaggagaggatgaagtttttctctgacacttgctttttaaattggataaatacatattaagatcacatttatagttttgaaattgctccatttttgatagatgtattagttcattcttgcactgctataa

SEQ ID NO: 80781 - DNA, 1021 bp, Homo sapiens
tgctggaaaattttagaatggctttagagtgaaacagcatcattgaaaataaaacaattgtcttctatttgcaaaactttaaagaacatttgttttaaccacctctaaacatttttgttttgttttttatttttacttgaaaattctatagcagaaataatgacagacaaataggcttctgtcattactcaacttccttatgatggtgttatacttattgctgagtaatagtaattagtgtggttttgggtgtaggcattttacattttgaatctgagaagattttaggttcacctgagttgctgaatcaactcagtatttcaggaaagtatcttatacatgggttccaagtagtataaatattaaaaagttaattgcatatgctctgagaaattctgtaagcactctttcacctttatttcatagatgaacagtgaagacagtggtgaggggattttatcaagtttatttgtaaaaaggcctgggctggcagactttttccttagagccagatgatctgtcacaactactcaactgttgacatacagcaaaagcagccataagcaacttgtaaccaaatgggtgtgactattaaaataaaactttatttaggcaggcttagtctgagaatcctaaatggatctggtggagggccaagggaaggcagttggcacacatgttgatgaaaacagttgtttaaacttctggcaaatttgaatactaacttaaaaaggtgtcaataaggtttatataaaaatgaaagcagtggtttgaaataccacaacagtaaggaccactctcacaaggagttctgtttccaaaatggcataattttgctcttaatgtatgcttaatagagtaatgcataatgtattattaatttggaaactattacttgtccagctacatgtgcagattttcagttttctttgtacatttaaaaatgataaatggaaagtgcaataccattcaggggaggaactactcaatacttaagtagttatttgccaaatcacatttt

SEQ ID NO: 80782 - DNA, 1052 bp, Homo sapiens
atatagtgaaaccttgtgtctacaaaaaatttaaaaattagccaaagttggtgcatgtctgtagtcctagctgaggctgaggtgggaggatcgtttaagcccaggaagcataggttgcagtgagccaagatagcaccattgcactccagcctgggcgacagagcaagaccctatctccaaaaaaaaaaaaaaaaaaataagcaaaagaaggtagacaggcagaaagaaggtatgaagaaagttaagttaataaatgtggaacataaaagataggatggaaacaaatttattcaagtatctctggtaaacaattcatataaggcctgtttgatggagtatttttttttttttgtagtgtgaagttttaacttggagacccagaattcaaacttgaaactgtagaagagaggatgaagagaatattagcagttgaaaggaaaatgtagaaatagaaacattatgtatatttaacagaaaacaatgatcaacatgaaatgttgaagatatatgttctaagtgatagctatatgtagatatggttcagagaaggcaaattgcatgtattgtttgatacacggagagaagattcaggtaagcattctggagttaatatttcctgagttagttgacatagtattaaattatatttttctgtaaacgagatgccaatatgagtcgtcttttatttggagtgtttaagcaggggaaaaggaggcagacactgaatagcaactgcaactatctgagcaagtgttgtaatacactaaaagttctgatacagatttcattagctgcacgttagcatgtcatatctatcactctgaggctttaccttttacctatgaagcccacattggtaattaaacattttcatgtttaaacttctacaagaggctcaagttttgtaccttcagtttacgcgtgatccagttgcatatacttttcaagttgtttttatttttttgagacaggatcttgctctgttgcccaggctggagtgtagtgatgctatcatgacttactgcagcttttacctcttgggctcaagcgat

SEQ ID NO: 80783 - DNA, 1027 bp, Homo sapiens
cctttatttctttctcttatctggttgctctggctaggctaggctgtttttcatttatttgccttttggaatctggctacatccatactgctaaacctcaaaactaaagacttcaggtaaactgctgggtcttaattcagctattgttcctgaagttaaaagagctcgttcgtttccagattcagtgaggaatgtattataatctaagagtgatgagaaagacaaaaaacctataaaaatctattttcttctatgcagcataacagcaaatttaaatggtgtcttatatatctcttcccatacaaacgcagcttgtgaaatattatcagtgagtatgtaaatcacaccataagcagcatagaaataatttgtagatacaatggtttctaatttagggagttagacctctgaattccttaattattgacttagatttttagggagttagacctctgaattccttaattattgacttagatcttattcacatattttaaaattaaatatatataaataaaatttgaatctcataaatgcaacttgtagttgtcagttgtgtagcaaaaaatcttgtccctaggaatggatatgttttgtattcttttgtaaaaggcagtggcagggctttattaagatgcgaatgctgatcttctcttatcttctatgggccttcagcgtctggatttttatgggcttgctgtcttactaggagactgactcctgctatatgcaacgatttccctctaattttttctgtcctttttggctaaagatctcaagtggagtttgatattacatattataccacacatcttttaaaaattaatagcttttatgataggaatatagttcatttttgttgtagaaaagttggaaaatgtagaataagtaaaaaggagaaaatctgtcatgctaccatccagagataactagtgctaataatgtaacgcccttctcctcagcctttttgtgtatatatacatcttataatatctagttgacctcagccgggcgtggtggctcacgc

SEQ ID NO: 80784 - DNA, 1040 bp, Homo sapiens
tttatctcagttcaaattcatagatatttattttattcttagtgttagaattaaatgctatcattattttgttgctcaaattattccagttttggcccttgggatctcttttaggtctacttctgtgtctttttggcatatttctatcctttttttatgcgtatgtacatgcacacttctttattctctgacactaccacatgcttcaggttcatcttgtttttttttcctacctcagccctagaatcaattatttctctaaggaaccttggttcctttcattggaggatgatattttgaagccaagatctggatgctaagtgtgctcattgctgtggagtatcattgctcctagactttctcagtggaaagaactaggaaatgcatgtatgtatactaatccacgtatccatgtacaattatgtaaaaatctgtatttctgtatataaaaatataaatatactgattgtctgtgactctaactggatatgttttgatacagatagatttactgatggattggttgtagaatgtgaaaagaaaagagtaatggatcactccaaggtttttgacttgagcaactggaaggatagagttgtcattaatagaaatgaggaagacttgaggacggtgcagagcaggtttttggggagagtttaggagttctgttctagactggttaagtttttgagatgtctaatagacatgctaagtaatagagatattaagtcagcagttgaacatgggaatctagagttcagagaagaatggtccaggttacatttgggacttgtcagtatagattagatcacctgaggagtgagggtagctagagaagagaagaaatttaaggactggcccatggggcattccagtcagagagataaggaggagcagttccacataatgataagggctgaggtgtggttatagggtggatttcatatcattaataaacacttaatacctattatttgcaagataccaagttatgtttggggttaacatcactccctccataaatttataagacaaattac

SEQ ID NO: 80785 - DNA, 1242 bp, Homo sapiens
ttttataacttcagctagagcacttagctacattgtaatgcatgggggtgggtgttgaaaagtgaatgacaactgtaagtgtagctaattgagaggggtacaatgttttcaacaaaggactctgaaggagtctttaagcagggggagatacttgggatttagagaatcttggacattcttaatgtgagcctggaaagagccactggagaggagaaactgaagaagagtgtatatgtgtgtgtttggtgggcgtgggagactggctggtggatggagacaaggatttgaaggtaataaggaatgggatccagggcgtaggcagagaagttggtcttaagtagaaggtagtctcacttttccagtgagcagaaaggaaggagatggatggcaatgtaaataagtttgtaactgacagggcaggaaggaagagttgatgacatgtcttgtgtaatttttgatcatctgctaagagtgaagggaacgtggtagaataggagtttttaaacaatgtatgtgaggccaagtgctgtggcatgtgcctgtagtcccatctactcagtaggctggggcaggaggatcgcttgaacccagaagttgaaggccagcctgggcaacataatgagaccctatctcttaaaaaacacacacacaaacaaaaaagccaggtaaaattaatccacccctgtgaaaggaatggaaaaaaagatagtctgtagtttatacatactctttgtaaacggcttccaagggaatggctaacagtggatggggtggaggtaagggagagagaggtaaacagacacatgactaggaaactgaagaaggattgttagttacatgactaggaaactgaagaaggattgttagttagcattgaggacctgtttatttcagattgtagacctcacatttgtagcagtaccaattttcgtggttgatttttctccagcagtgagtgatcagactatctgaagaaactatttaatactctcaagaaccttatgagttatgtattgttactgttactctccttgtttgtaagatgaacagcttgggtttaaattctgcccaggctgttatctgctgctttgtagatatctgtttggtagagatatctgaaggacagttggttgagggaattaatgatattgagtattgtagctctactgaagaactatggagtcctcctggattatgagctggaagcctgtaaggaggtgatccagttgggagaaaatgagg

SEQ ID NO: 80786 - DNA, 1091 bp, Homo sapiens
ggctgcggagggcggggctaagacaaggggcggggctgccgagaccttgggcccgcgtgagggaaaatttgggttcgattaagccgcagaggaaaagaccaggggagtctgggcccatttgggcgtcggggcccgctaggtcagccgtcatcgaatacagaatatgttttcgaggacgctaatatgtagtcatgaccaatttcagttcttctactttctgcgggccttcgcaataaaaaaaaaaaaactacatctcccagaaacctccacgaaaataaggctcaccttgcgtaaccacgtagtccttcgccgcattggggcaaaataatcccttcatttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcaggtcagtaagcaaggcgagcttgggggtggccccagtcgagatgcccttcaccccttgaagatcacccctcttttggtggtggtggtactggtttgtctcagttggaggccggctgaatgggggcgcctcaacttccggttgggggaggggaggaaggccgtcctggggaggggggacaccctcacttcctgtgggggggtggtgatggtttgggggtgtccgacccacttccagtgctgatgagggcttgaaaaggtggtgcttggtgccattcgcggagacattatcttgcagcttggggattgtgttttatgtgaaaagttagattattccaagttgtgctgaacaccaacctgcagtcagaatttatgagtttgcttccacgtggaatatggagcatttcctccccagcaaaattgtctgtgttttcttcaaagaattcgaaagcccttgttaaaaatctctatgcacctttgc

SEQ ID NO: 80787 - DNA, 2423 bp, Homo sapiens
aatcacagcactttgggaggcctaggcgggcagatcacgaggtcaggagttcgagaccagcctggccagcatggtgaaaccccgtctctactaaaaatacaaaaattagctgggcgtggtggcgtgcgcctgtagtcccagctactcaggaggctgaggcaggagaattgcttgaacccgggaggcggaggttgcagtgagccaagatcgctccactgcactccagcctgggcgacagtgagactccgtctcaaaaatagataaataaataaatagctgtttgggttagggttcattagaaaatatgttttaaaccaaatattacagtaaaaaaaaatacatgttttaatcttctgtggtcacttttaaaaaagaatctaagaccctaaaatcaagtatgatttatattttgaaagaccacacgattgctgcagtagttgactgaaaaagcaagacaaaacattgtctttgtggttattaataggttaggaacatgtagactgcccgaagtaagaattaattgattaaagaagaagtgttcactatcttctatattaatgtaatatagaagaaaatataatatggtcaccctgacaaatgaaactgtagtgttaggaattattgaagtatggaaagattgtagaactaaatgaaaaaaatagagaatatcatgttaaaatactgattgagatagagtaatattgccttttggaaactgtctttattaaattggtctttatggtactccatggaagaaatacagtataatagaaataagaaaaattgttgcagctgaaagacttgagcagcttgaagaactatctgtttagaagaaagcaatatataaaatacctatctgaaagaaggtattttgtgataagtggcagttattcattggttccatcaaagaagaaatattagaaaagcttgtgaaaaatagagagagaaggtccatagaacctgtttttattctttttaaaaatgtttctttagagaggcttgctgtcctccaaaggtttttttttcttaatgccctttgtgcagttttctttgcatgtttaatagaaatatagtatcaaaatttaaagaattaatatttttgtacatgtactgttacttcaagttaatgaatttgagatttcattccattacttgccatatatgtaacaaagaaagtgtcaaatctttttttcaaatacttggattagataaccattttcttttccaaagacagtcattggatacactgctcacagcagtttgaaatattaaaaccgtaggtcacaattctggattccatctgactgaaattagattatccacagagatgttatacataatacagaagtgtcttttcattctttcatctactttactttgtaaaatcaggctaatgttttgcaactgttgctttccttgtttgtcgttttggtggtggtttgtttttgttgttgtttttgccgtagggttgaggattaaagaaagtatcttaagaacctgaatggtttttcaccttactgctttgctgtctctatttcatagccttcacaggtattcaaatgagaataccctttacgtgacttttcattatttaagcaaaagtttagagtgtctactatatgccagtcactgttctcaggactttgaatacagtaaatacggccaaatattcatattctactgtagtttactctctaatttacaaattaaaactagaattttgctcccttggtattcctaaataagatctatgttatgatcgttgttcagactgggtaaagaagcagccctaaacttgatctctcctggtcttaatctctaagccattctaaacccagatttgaatgtttcagcctaatttttctccagaccatagaagcccctgtgttaaatatgcagtccctttcattgatacatgtatcattttcctaccattctagcttcttttgtattgtgaaaacaaatgagagtgaacagtggggaaaatatgggatcagataggcccaaattcagcactggtctctgcattttactggctgagcttactagcttggtaaccatgagcaatttatttgacctccctaagcctcagttttcctaaatccaaatggggttgtttggtggaatcagaatgttgtatgtaaatctcctggtccaatgcctggtgccagaagcttcattaatgcaattatcttacccccaatcttgcttctgctactctggctattgtgatttgcccacatgtctgttttaagctttacattttccccacagtatgggatgcagtggtagactgactgagcttcagccttgtccccctatcagcatgctcacacagttgtcaagatttaattttttttccttgtgggaaggagaaatcactaatttccatgattagaagatatacaaaatagaaaagtttc

SEQ ID NO: 80788 - DNA, 1076 bp, Homo sapiens
tgtgtctttaccaaacaagaacattaactttttgtgctttgtgtacttaaaacaagcttggttttgttttttgtttttttcctccaaatagaaaattgactgtcactgaaaacaccttttcatatatcacaggccttctagagggagtaaggctttaccagcattccccatcccagcttatatggacccacctttttaccgtttcatagtacacccatgtcccaggaaataggggaagtactctacactaaggaaataattccaggttttattggattactttaactcttagttcaggcactggtccagaagttgtcttacttgggcaatcacctccttgtttactaataataaaagcagtgcttagattgcctctgtaggaagggcaacttgggaccaacaggcaccatgaaaaagccaacgaggtggactgtgacctcaaaaggcaacactctgcttgtaaaatgacaaattttgctttggaagaggaagtgttttttattttccctgcgttatcaccgtgctttacaaaaactgatacaaaatactattcttagatgttttggttttgtggagtttttttcttcacaacacattttccgtcctaatattgacagttctccatcaaggttccattgagggggcaaaaggcatatacagtgatccaattgtctagcaagaaatctgaactgtgccagtctcttttgatgatctagtacttctgtggtttttaagaagatatctgatttaagtttctaaatttttacttcaaaaaaacatgtaccatcacataaggaatttggagaaaaaaatcataaagatagaagtttaatttttgtttctaactctggcctctttttctccctttttatttttcgaaaacagagtctctacaaggaagataacggactgtaaaattctataaagcaaagctacacatcacttgacaccatacaccatcttggttacataatgaaggtgatcaacaaatgtttgttgaaatataaactctctaggcatttgcattagatggagcctggattatttcttttgtggccaaaaaaccccgctatatt

SEQ ID NO: 80789 - DNA, 1395 bp, Homo sapiens
tttaacatctgcaactttttacttgattagccactacccttctcaaaagtcttcctgccttggcctctgcaatcgtcttctctccagttatcttaatgcccttctcagtctcctttcctagtttttctaccttgctcatacaatgatattgcttcagctgagttctatcctgacttttccttcttctcactgtctttctggagaatatctagcactgcccattatttccatgggctaatgcttctcgagtctatctttatgcccttttgttccacttctgttctcctggggcatgtttccagttgtctgtggtacatttctacttaattatgctacaggtgtttcaaatttatcattttcttgtgtgtctgtccacacacacacacacacacacaccctgtttttactttgattaatattaagtacataatcatcaattggaaacctcagaattatctttgactcttcctttctttcactattaaagtcaatcagtcattaagttctctccattctacctcttttttctttttctttttctttttcttttttttttttttttttgagactgagtcttactctgtcacccaggttggagtgcagtggcatgatcttagttcactgcaacctccccttcccaggttcaagcggttctcctgcctcagccttctgagtagctaggattacaggcactgccatcatggccagctaatttttttatttttagtagagacggggtttcaccatgttggccaggctggctttgaactcctgacctcaagtgatccacctgccttggcctcccaaagtgctgggattacaggcgtgaggcaccacacctagccattctgcctcttaagtatctcttaactgtccttctgctcagaatcctgcctgcctttgtgtctcacttaatctattacagtaacctcttgatagtctccctttctccttttataccaagttctttctatctggaatcgtgttgtttaccttgatgaatacgtactcatcttttaggacctcctctataaattctttcttaacatccctccatacatataaaattcatcataccctctaccatacctctatggtacttttaacaagccattattttagtacttacgttgcattgtaattattccctataatactatgggttgtgcattctttcagaataatgactgaatattactctattatccatctttctaccgctcttgacttcccaactcctccctcgatcaaaaacaaaaacaaaaatactcactagcacatggtgttacctttccttctattccttcgtccacatgtaataagataagtccatctaagaccctaccattatctgtaccttcttgtgttcactcttcagaagggtgaaatctggtt

SEQ ID NO: 80790 - DNA, 1024 bp, Homo sapiens
tgcctctacaactcccattgctattcacttttttcattaatagtgttttccctttacattggagatacatgaaaggtagcatgtaaaagtcagattctactgcatattcagagctaaaacatgaagtctgtgttgagaggagatcatctttttggaagaagattatagttgtttttggtaggagatgtcttcatggaactgacctggtttaatcaagcactgaaaccagtttttttaaaacgccctgtaacgtctgtgaatacgttgtttacatttatacagattattgggggaattaattcaaggactggcatgtgcttttgctggcagggaaatttatctagaaccttagtaaataggtggagtttttgtgttgttgatacttctgcctattattcaggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgaggtaagctgaagtatctccttctgttcctatcctctgaaacttctgaagaagcagtcacaaggaaggtgtgttgatcaaggtgttcatatgaccttcttatattcttaggctgatacctgcaaaattttgttttctatttcttgttttatacggaaccatattaataattttaatgacatagacaggtagactcttttttccctgttccctaagaaatgtatacttacctcatattagatgttgaacaaatacttgttgaatgagtgaatgatttaatcattaataagtaactaatgagaagtgtacatgcccttgctcaaggctctgctcagcaagccctgctgcatggagccctatgtgcccaaaggattcatactacttaccaaatctttcaccctcccatagggggtaactttccttaactcacacaaaggcgtatgagcctgggcagtcatgcccttgttggactttcagtg

SEQ ID NO: 80791 - DNA, 2551 bp, Homo sapiens
ttcttttgcctggtgcacgtgacaccatcttactctaatctgacaatgtctgcctccctgccacaatgctgcatgtgctgctgtatttcccatttggatactctcctgtcaggaatcaggacctgacagttgtctgtgggacagtcatatgcatatgaaggtcaaagctgagtgatcatggcacctcttattctcatacattgagattagcacaaaaatagccctttagtgtaacattttgtagtgtgatacataaaagaggttgcaagtgaagcatctggagttcctcaaaaattgcattgctgtcatttgtatattacctacaacagatgtggagagctttgaatatccagggccaaattgcaactcttaatcctgttttgtttgttgttgtttgtttttgttgttgttgggttattttgggagatggttgttgtttggtttttggttttttattttgttttgttttgtagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacaggtaattgttcctattcctgactctttgtttggttttgattatatctcagaaataacttatataagaaaagcaaagaggatggacagttgattctgcagttttgtcacagtgcctaggagaccagaatagcagggtccatcatagcaattttctctagcctagtgatttttaaactatttgctagaggggtgtgagcagggaaggagtctaggactcccctcaaccaaagcaacaccactttttatacgctgagttcacataagattgttttaagtggttcagtattaagaaatctgtcaataaaatgtattccactgagttaaatgaaaagtcgtgaattaaatgagaaaaagtcacttgacacaattctgcagttcacataagatttttaagaaaaaatgttactgctttaatactttttttaactagagttctggcaaattaacctactattgaaaataaagcaagaacaacttgaattctttctcctctaagacagaaactaacctgatgggcaaactgaaatgaatccgttcattagagagatttgaaaggaattaaggacaagatagccatgagctggttgaagtaccactaaagctgagcagtggtcatggttgtgggagctgctttgggttaaaagttcccagcattcccagcatctgaaagatatctgtatttcttttacgtcttaaactcttttatgacttacactttttaaaaaggattccagacacactaaaaccaaatggagaaatactctcctgggaattaattgaattcagaaattttcaaagagatcagattcagttgcaacttttgaagctctgtgtttgtggtagcaagctagtagaaagcagtgaatatcatccattgttttggcgctactgtataaaaggatagtgggctgtacatactatgctattcttttcttttttttctttattttaaaattaatatgtgctcattattctcttttcagagaatacagaaatgtataaacaaaaatgtaaaaataacagtgcttatttcttgggataaccactattacgtaggacaaaggttttgtgtttgtttttgtttttttaactttttttggaaataatttcaaatacacaaaaagttacaaacataaaaataatacaaagaacatcccaacactctttacccagattcacctattgttaacacattttattccatttctccatttgcatatgcacttatatgctcagtctttcttatacttttgcatgctcagtctttctctctctctctctctctctctgtcacacacacacacacacacacacacacacttgcatgtgtacacccagacacacacaaaattttgttttaatcatgtgaggataaattatatacattgtagccctttacccccaggatatttcagtgtgtatgtcaaagaatattttcttatataaccatagtgtagtcatcaatttcataatttttcattaacagtgctttaatctgtcatctatatgttgactgaatgtcatttctttataacatttttcccttccaaaacaggttccagtctagggtcaggttttgtgtttagtagtcaagtttctttagcttaaactgggatatttccataatctttctttttcttttataacattgatatttttttaaaatacagttcccttctgcttcccccgctgcttttacctttaacagaacattgctcattgtgtatttttcagatgtttccttgtgattagattgaggttgcgcattcttggtgggattacttgcataggtggtggtgtgttctcaatatgtcacatatgcaggcacacaatgtccttttgtttctcactagtaatgttaatttt

SEQ ID NO: 80792 - DNA, 1061 bp, Homo sapiens
tgacatcatcccctcaaaatgggctggagacagcaaaacaaagtaatattctgttccttcccttgggaagactaagtgtgcctatgtggtgtgcacatctcatgaggatgactctagtggccatatagagttctatctatagagttagaagaataactctaatcatcttcatgaattttttataagaatgatctcaatagaacttgtcttcattaggttagaaaaggcaataaatattctaaaaactcataatgacctatttacttttataattgagaggttatattttattctattcatacaactcttgtttttctgattcttttttaaggcatattccctatattcttttcttcccatgttctaattgtcctgttttcttcaaataggtaatttaattttatttaaataggatctcattttcttgaaaataattctgtatttctttcctagcgctaccttgatgaagcagacagagataaggagcgttacatgaaggaactggaacagtatcagaaaacagaggcctacaaggtcttcagtaggaaaacccaggaccgtcagaaaggcaaatctcataggcaaggtatcaaaaccagaaccaaatgtatttgtagtttgttgtgggtgatggagtgtcataaagccaactgttaagagtggtaactataaaagatgtgtttctgttttttctccactatccagtattcacttacaagcattatcttgaaattttattaaaatcacattgctctcatttagaaatttcaactgggtttccgtgtctattatcaatgattttgacttgtcctccgagacccctgttagttgcctgcccttcttttcctgattcccagtttaggcatttctctgcctgtaagcaagcctatctacaaaattatatcagtaacttccctttaacacttctaagcctttcatgtgtcatttttgaagcaccatccacaactagcctatttttccttagccattgcatcttctctatacttgggcatctagcctgctaaaattatagatgttgtataagtagtctttggtttgtg

SEQ ID NO: 80793 - DNA, 1077 bp, Homo sapiens
gaatgaacactggtatttcttatatactctttcattttgaagatagtcatagcagaaagctgagcgagtctaaccttctgttacatgcagctgctcatatatactatacagcaattatatagcccatctgtttatttagagtatgtggactaatttcatttctttgagatctaaaagtctctcctctaaaattaaaagcatgtctgtggagcagaccacattagaatcactgtttctttgaaattgtgttttatggtacaactgaatagggaggattttcttactttcttcttatctcacttcaggaagtggagagacacctacagtggacaccattgactcatatatgaacagactgcacagtattattttagctaatccccaagacaatgaaaacttcatagctacagttcgagaagttgtgaacagactcgatcgttagggaatggtgagtgctcactgataaatatttatatgccagcacatcatcaaaaataagatgtcatcagactttatcaatactactaaaaccctgggattacattggatgaacaagttggagacttggttaagattcctgttgcatggttgttaaatgtagtaaataatattagaaaagagaatcactgtagtcccagctacttgggaggctgaggtgggaggattgcttgagcccagcagttcaagtccagagagatcctgtctctaaaaataaaagaaaacagactcaagacagttttttcttatgcttgcttcagaatggtttaatgggaaaagcatggtttttgtggcttgacctcatttctagctttgtcacttattagctgtattcttgggcattagtttcccaaaaggttttgaaaagtgagtgggaaacttagaagaaatcatccccaaaacagcactcagaacaaaataaatataacttaatttttaatcttccttttctctggaaaatactaatgataatttagaagtagtcagtgagacattgtatgtatgtgagcctacataagtaggaagcttttatattcaccactcaataacacagtgactgttgtctgttaaatgttgatg

SEQ ID NO: 80794 - DNA, 1535 bp, Homo sapiens
atataaagataaatgcctagtaaagacaaaggcagaagtctttatacttcttggtgatgcccttggatggtaactgtacaaggcaatgcattatattttagcctcagccatgctctgatggggaaaggattactatccttctagggagtagccagatggaatggactgtacttcttagagatggctggactccctgcagaataaagaagtggcattactgctgctgcttatgaagggaacagcttgtaaatctaggcctgggatattcaggagctcatcatccttcccattttcgtacagtgttttcaattagcactcttgtaggcttgaaaagtgagagctgggagaaacagtgtggaagattgtgaaagaaaacattaattgataacatcgtgtctcttcacatagatacagggcagctaattaagtattgacccaaaagtggttttccattttgagcattttgccagtaagactctcctaaagcttttttcatctcaagagtataaactatattatttgttttctgatgagtctttgaaaacttagaatattactattatccttgattttaacctacaaatattttgcccctgaaaaaatagctaaaagtgtgaactgttatattactacagattcttacagtctagccatgcaaacataactaacaatagatggttccccacacccccaaaactgtcaaaggaaacaattacaaagactgtgattaatactggtttggcctcattatacaaatatgtacagacagcgaggctgatgtccccagcactcatgatgcaattaattactctgacaagagtttggcaaagttttcatccactgtcaggagccagtgagtgaagggaagctaatggtctacaagtttcagaggagcatattagggacctttagaaatctaacattttatatatgaagaaactgaatcccagagaggagaaacatcttgcttgaaaatatctgcgtagatgagtacagaatccaagactagaaccacagatatctaaactctctcattcactgggtttctaaaacattgctctaaggaagaggtggatgggggaaggggaaagcactaaaaaatcctgaaatagagcattaagatacataggaagtaaacagataaaaattgtaatccaggaattataatgttatagaattttagctcattttaaaattattttgataaatatacagtggaagaattaccctacctgtctgtcacctttcttgtagctgagtagtacctagagacaagtggagctaggaggaggccatgagggtgattttaagttgaaaggtgactaccttatataaactattaaaatgcatatgttgcctgatttcaatgataatatttggctgtttgagtttagggaaaaaaaatcttatgtgactgtatttttattaatatgagaaatgttcttgattatatgcacataatacatctctatacatgcagatatccttagttaacacttgaagaaaattggttttgattgaccatacattcttca

SEQ ID NO: 80795 - DNA, 1044 bp, Homo sapiens
ctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttcctgtgttgcccaggctggagtgcggtggctattcacagatgctatcatagcacactacagcctacaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtc

SEQ ID NO: 80796 - DNA, 1038 bp, Homo sapiens
tgcagtcctctggaatttgccttttttctttatcacatttaagcttcatctatattgttgtgaataatagtagttgtagctcattttcactgatgtataatgttctgtcatgtgatcctaaaagtgtaattaacattctcctaccaatggacatttaggttatttccattttttgctcttacaaacaatgctgccaggaaccttctcatcccatctctgaggcaacatgcagtgtctctggggcacacagctaggagcagaattgctggcctgtagggcatgttcgcattcactcttactaggatatttgccaaagtgttttccaaattggttagaccagtttgcatcaccccagcaggagatgagtgtccccattgcaccccatcctgatcaacactcggtattgtcaggggccttgatttttactgattgaatgaatgtaagatggtatttcatgatggccttgatttgcatttctggaattcaaggtttctggtatatgaaatgtgggttgagatgggcagcagccagtgtgtactaggtgctcactaagcagtcatcccatcggcacccgttcccccagttgtggggatgctgtctttaccatccctgaagtctgggatggatatgagcaatcagggaggactccccaagcaagtaggatgaaggaggagcaagaagggcttaagtccctgcatgtttagtgcaaacaaaggacagcaaattccaggaaccccagaggctttgtgtttaccccaggatgggaaggagtggtcctagcttaagaggtggagggagcctgtgtttcattattttagcatcccctcctcctgcacagcccccctgtgcacctggcatgaagcctggcattgctgagcacttaataagagtttggtgacccagggaatgaaccccggatggaacaaatgtgtgcttgctcctcctccattctcacttgcttggggagtcctctctgactgctcttgctcatggatcgaatgaggggtggctgagcaaggtgactccggggcattgcag

SEQ ID NO: 80797 - DNA, 1024 bp, Homo sapiens
gtaatatgttctctatatgttacctattatctatgtatgtatctatctatctattcatccgtctatccatctatctctcggtatttaaagcatgcggttcaagccccttctgtagtcttttcctcccaagagctaacacggataactcgtttgatatgtccccttccacacttttttctatgtacttatcaacgtattttaaaaggaaaaacatgggctcatattagttatattgctccagcacttgatttttttacctaacaatgtcatatggatcatcccgggtccttccatagagttcttccccacccttttacatcccttgtatgatggtctacaaatcattcatcaattattaatcctgttggcagccatttaggttgtttctggcatttggctatttataaacttcactcagggaacctctgggtttgcacatctgtgtgtgcttgtgctgtagttcttttgggaatgtttctggaaatggacttcctgagtcagagggcacccacatttccacatttgatttgttctggacagccagatcaacctgcagaaggctgagctgatttatgctcctacaaactgtatgcaaaatgcccctttccctcacccttgccaatcataggaattattaatcacttaatccctgccaatttgacagataaaaatgattttactctatgtttcttagactgctaatgaggttgagcatatttgcatatgcttgttggccatttctgtttcttcacttgtaaattgcttgttgatgtcaagtcctctgctgctgtatccactcattcaggaagtatttactgagcacctactatgtgtcagacattgttttggttagggaccgaacagtgaacaaaactcacgaaatatacctgctccaaggaatgtaagctgtgatggaggagagacagacaaggaaaaatacagcatgcgtatgggagtgttaagtgctaaggcgaaaaaaaatcaagcagaggagggggatgggaagtgttgggcaacttggaca

SEQ ID NO: 80798 - DNA, 1040 bp, Homo sapiens
atgctttctttacagcagttctgattaataaaaacagttccactgctctctttaaacactctaaccttctgttgcatggggaaggaggccctttctcaacaatttatggttcttcatgcagattccaaaaggcgacctgctgccgggtggcctggtggcaggcactgcgctcacacacgtgggggcggatgcaggcagaggggcaggtgcgtggacctggcgggcggcgggactggccattggggcgggacaggccggggcactgcttggcagagtcggctgcagaataaaaacgccgtttactcctctaattgctgtttatttcctctggacagcatggagataattaacgagctcccaattaagaaaaattacatgtgggggactgaggtgtcagggccaggatcggtattggagtggaggggtggggtggggctggtggtaggagcaggggtccttggtgaagccaagggggtggtggtgtgtgtgctagaagaggtggatgcaagtcagcaggaggggtggtgaggcaggggcttcactgccagggagactgagtggaagggaacaagagctttgagcatagcttcactgtccccagcctcagttcctctctttgcctaagttagaggtcacaagtggtggctcagaggcagaatctgtctcatagttgtgtgtgtgtgtgtatgtgtgtgtatgcatgcacatgtgtataagtgccagtctgtgtgtgtgtgagtacatatgtgtgtatgaaagcgtgtgagtgtgcgtgtgtgtgtgaatgtgagtttgtgtatgtgtgagtgtgtgaatgtgagtgtgtgaatgagattgtatatatgtgcgtgaatgtgagtacacatatgtatgagagcatgtgtgtgtgtatgtgttctagccacagagtgtggcaaaaacctcagcccacagattgttggaagattgagaggtttcttatcaaaatctggcttctggagtctcttgaaaagtcagaggcccagcaagcatatgccggcaggagccgagtgctgcgtggt

SEQ ID NO: 80799 - DNA, 1185 bp, Homo sapiens
gtacctggaacaagaagatgctttctggtgtctcgttaccatagtggaagttttcatgcctcgagactattatacaaagactcttttaggatcccaggtagttctgaaaattctgtgttttagtcaccacttttagaattgcagctgaaatgtgacctgaattaaacctgcggtcagggtgaggggttgctttgtgtatgtgacttcagagactgattcctgaagacagcaggccacatctcagaggctgtccccagtcatggcctgctgtttgtgactgaggccgagttgggctcattcagccccctgcgaaccagcagagacagacccgtcctgcaggcctaacattgtgttcactgctctgcactgtcttccccggacacaggcctaccagtgggctgagtcataatccaggtgtgcttgggtgactggtgtgttagctcaggctctcaagaagcaatgtcaggctggaatgagacaaaccagagacttcggcggggggaagcccctgtggaggacaagggacagagaagttccagccccaggaagggaggaggatggggaggagagtcccagaccctgtgcagtgaccaccatgcagtcctgaggaagtctgggcagggccagtggggagccctcaagccaagggcagtgaccaaggcacctgcctccacagatgggctgcattcctgccgctgccgcacccatgccctgctgctgggaatgaacgtggtgatgcaccagaggggcagcagtggggcctgcagtcacctcctgcagtgggagtctgagtggcgcatttcatgccatccacacctggagtctgacgccaggggccagggcagagtgataagggctgggagagcccagtgtttctgcctttgcttgggacagtcctggccctggaccagatccttggcccttgaatcatccctaggctgggctggggctgctgccagcactggcttccccgtaagccggcccttcgcatgtggcccagactcaggcagcttctctcttagccacagctgtccccgtgtgtgcctgccctgtctcgtgtctcttctccaggtctgtgcccccgcctggcctgcctgctcacagcctctccttgcccttctcctgcaccacttggtgttgcaaggcctggccctgcaggccagcgggaggtgctggcaggagact

SEQ ID NO: 80800 - DNA, 1002 bp, Homo sapiens
aggatggtgttgggaaagctgttttaaaccattctgtattctttgttacttacattcacatctggaatttttgtgcataaaagggttatttggaacttcttgatgaactcaaagaatcagctgcatttgcaaaaatctttttttttttttttttttgagacggagtctggctctctcgcccaggccggagtgcagtggagctatctcggctcactgcaagctctgcctcccgggttcacgccattctcctgcctcagcctcccaggtagcttggactacaggcgcccgccaccgcgcctggctaatttttttgtatctttagtagagacagggtttcaccgtgtcagccaggatggtctcaatctcctgacctcgtgatctgcccgcctcggcctcccaaagtgctgggattacaggcgtgagccattgcgcccagccgcaaaaatcttataatgaaaacttttttttaatgaggctggctgatcattgggaaacaatttcatctttgaacaaaaaccaaatgaaagtggggaaaagtagctttgcttctcaaattttaggaaatgcaccccctccttttttttttttaatgagacaaggtcttgttctgttgcacaggctggagtgcagtagtgcgattatcattcactgtagcctccacctcctgggctcaagtgatcctcctgcctcagcctactgggtagctaggactacaggtgtgcgtcgctactcctggctgatttttggttttttgtttttttagagatggagtcttgctatgttgcccaggctggtcttaaactcctagcctcaagtgatcttcctgtcttggcctcccagagtgctagtataataggcgtgagccattaagccaggtccttattattctttattggagaactagaaataattttggccatgagagaaaaagtggcttaaagcagatggtctctgtggagactgtagtagcagctgtctgtgcctgggctctcatcttgtcct

SEQ ID NO: 80801 - DNA, 1029 bp, Homo sapiens
ctcgacctcctggtgggctcaagcagttctcctacatcagcctcccaaatagctggtactacaaatgcacacgactgagcatgtttaccttctttgtagaacatcattgtatgaatctaccatggtgtctttattccttcccctcatggaggacatttaggttctttccatttttccttgttacagtgatgcaaggaccatcatggtccatattcccatgtgcccacgtgagagagtttctctagggtgcagactggaagtggaattcctagtgtatagaaaatacatacctttaactctgcttgctagatctgatttccaaagtgcttgagtaagtttacgctcagcagcagtgtgtgaaaggcctttgtagtagttttcttttactggtacaacaaattatcataaacatagtggcttaaaacaacacaaatttgtcacttaatagttctgtaggtcagtagcccaacatgggtctcattggattaaaatccaagtttaattaagggctgcatttttttctgaaggttctgggataatttaagttgttggtggaatatagttccttgcagtcattcgtaggactaggtcgctatttccttgctggctgtcagctgtggttggcgtcttctagagccccctgcattctttggcctgtggccccttttcccatcttcggggcagcagcagcaggtccagcccctctcacacctcccgtctctcctgcctgacatttctctgactgactcttccactttgaagggctcatgaggatatttgggcccacccagatatcccaaataatctccttgttttaagttctgtagtcttaactgcattaacgttccattaacaacattcctattgccatgtaatgtaaaacagccacaggttccaataactgggacgtgaacatccttatccctaatagcttataaatacattctttgtttttttttaatcttttaaaatgatatttttaagcataaagttatacatatgtagtgtatatatatgataaagaaacat

SEQ ID NO: 80802 - DNA, 1109 bp, Homo sapiens
tagagggattgtacagtatccactatgtcagtgcatagctacttcagggacttagaatgctcactcttcgctcagacatggcttatctgtatttaccatgtcatgaggcccacttgcaccaaagctgtgctctcaccagcagatgggtcaggaggggtcagcagtggtggagagtgtagggccacctgccatgcccctttgagctgacacattatataggcacttatctggaatgtccaaacttgttagcccttactagagctcttgttctaacagaattcggttataggaatgtgccctaagttatttaagcagtttcctagccatggacatctgcttgtttctacttttctgtcatttcaaatagcattgttctgatattcttgtacatacgtctctgtgcccttgtgagaatatatttgaggaattaatttgtagaggaggaaatactgagtcagctttattgagatggctgttgccagtcagaggaaacccccccacacaacctcctccctgccccgccacctttgtttcccttaacagggcctgtagtctggagggagggaaggagctggaagcagtggtagcctgcttccctcctgtgcacaaagtcctggcaagtgcaaacctctgccttggcagtgtcgtccacctgctgaagaggttgtggttttgcctgaaacctggctgtgcaggcggtttgtggaggggttaacttggaagaaatttgatggaacatttcccaacaattctgtcaacttgtaaattctagcttgttatcagaatccaaacgaatgtcgaacgagttattactgttttagttagacattttaaactgtgcagacctccaccggaaagaggttttcttaacgatgatacagattgctggtgtttgttttaaaaagctcaggctgaccactgcccctgacaaggtgctgttttgctgcttcgtggtgcctcactttctatttcagatcagagcagctgagtgtttataggtgggcacctggcacgctgcctgggagaacacagtaggcctctcaaagatctgtcaaatgagactgcggtctttaaacagcaaatactgtcatagaacagcctctaacacc

SEQ ID NO: 80803 - DNA, 1036 bp, Homo sapiens
attccattttccaaggagccaggagatccagtatttgccttcttagtctctgttgctgggctgaaacagaagatttcaaaaccttcctggggaaaaaaatacattttttttttccattggtgctgggccagatcccttgagattgtttccaggctcatgattttgaaacactcaggaaaaaatttggaacctagagttatttatcagattcggggttagagtctgttttccatttgaattttgttttgtattaccaggctgcttacaatattcttgtgctttttattgcttatggaagaaattactttagacatttcttagagatccaaatatcttccttgagtttaagaaacaaaaattccttcattatgagcagccatcgcattcttttcagaaatggatacccaaaattatccatgtaatttaaattgctttctagaaggtatgcagacttgacctattctgtatatatattttccttcctgtggctccttcgtgattgttggttatgttgttcttttggctaataaacatggtaggacctgaccctttgggaaggaacccagagttcataaccctaagtgggtgattgagatggtgtgcgtcacatagagcgtgttggaggaatgatcgtttggttgtataagggatgttggctggccttacagatgagatgtttgaactgggtcttgagtgagtgggaatttgttagggaggtgttagtgcagtaggagcagagattgtgaaggcttttgtgggccttttgtgtgggagaaaggttatagttctgtggagtgtggggcagtgtgggccagatttcttgacacttggaagccatgagagagttttaagcatgcgacatatatgacttcattggcttggtgtcagaagagagtttggagaggagagactgagacagcaagtccagttaggaagctgttgcagaggcccaggggtagatgaatctggagacccagaggcccaggggtagatgaatctggagacccagaggcccaggggtagatgactctgagac

SEQ ID NO: 80804 - DNA, 1056 bp, Homo sapiens
agtgtgaaatgcagttttaagcggacactccgctgggttttgagagatgcacactcccatgtacctacactgccataaagaaatagaccattgcttcatccggcagggcgaggacttggagcccaggtggcacgaaggcaactgacccgcggggtgctggtcgcaggaccctgcctccgggggctgagggggcaacggccggcgggcgggcgggggcgagactacaagtcccagggtgctttgcgcgcccgcgggccgtgcggagcgaaggggcggtgcggagggggtagggggcgcagcggccgcggcgcggaggcgcagggcgcgggcgcctacggttggcgcgcggtagcgatgccgggggccggagcccgggcggaggagggcggcggcggcggcgagggcgcggcgcagggggcggccgcggagcccggggcgggtccggcgcgggagccagcgcggctgtgtggctatctgcagaagctgtcgggcaagggccccctgcgtggctaccgcagccgctggttcgtgttcgacgcgcgccgctgctacctttactatttcaagagtccgcaggacgcgctgcccctcggccacttggacatcgcggacgcctgcttcagctaccagggccccgacgaggcggcggagccgggcacggagccgcccgcgcacttccaggtgcacagcgcgggagccgtcacggtgctcaaggtgggaccgctcgccccaaagccgcccgcgcgcttccgccggcgtcccctgcctccgccactggcttgcgccatccaccctccttcctccaaggcctcctcgcccctgcccacgtcggcctgcctttccctgcttctccacatcccgccctcgttcctatctcctccccactatctgggcttaggccagtctcgctggggctaccaagccccgtctcctttctcagacaccttgacccattatctccctctgcgcctaacctcgggccagtctctggtgtctcccgacccccaccatcccgtggatgtcctgtgcagccttcccaggcatccgtgagcgtag

SEQ ID NO: 80805 - DNA, 1025 bp, Homo sapiens
catgcccaggtaatttttgtatttttgtagagacaggttttccccaagttggccaggctggtctcgaactcctgacctcaggtgatccacccgtctcagcctcccaaagtgctgggattacaggtgtgagccaccacacccggcctaggactcgtactttaccttggcattcaaggccttgggtcaccagcactcccacccaactttcccttcccgtgctcctcccacctccattgtggtccactggtccctcagtggccccaaacccactcactgctgcatttcccttcagaatggcccatctccaagtccatcactcatttgacaaatatttagtgagcaccaactatgtgccagacagtgtcctaggtgccaaggactctggtgagcaagactaactcttgggagtttatattctaatctgggagatgggcagcctactgctgcgctgtgtagcacaatatggtttgatgtgctatatgatgggtgaatatatcacaagacaatggagtgtgggggcatgatcagtgctacaaagaacgaagcagggtcatgggatagagagaacggcaggtggggaaggcaacattttctgtcatgtaggtgggcctttctgaggaggtgatatttaagaagagaatggaatgcagttagagtgtaaaccatgcagatatcttgtaggaagagcattgcaggcagatggtagagccagtgcagaggccctgaggtgggagcaaggttggtatgttcaaggatgatctagaaggccaaagaagccaatgaaaaggcctcactgaagcctccagtgaagaagcagagggtagcagggcatctggtgaggctcttgtgggccccagtgaagtgtttaggttttattctaaatatgaggagaagctgttggcatgctgtgatctgatataaagaaaaatccttcggccaagcgctgtggctcacgcttgtaatcctagcactttgggaggccgaggtaggcggatcacctgaagtcaagagttcaagtccagcct

SEQ ID NO: 80806 - DNA, 1066 bp, Homo sapiens
ggcctcaagtctcctgttgctatgaaagggtggtcccctagaaatctataaacaatttaacgtttttctgtaagtttgatactacttttctcccattttttcggtttaaagagaggtccagagatgcactgttatttaaggaaaagatctctgtactggaatttaggagtctcagatttaaatcctagcaatgccactgattggctgtgtgaccctaagcaaattactaaacatctctaagccttaatatgcccatctgtgaatatctatacttacatcacagaattgtttgagtattaaataaaataatgtatgtgaaagcacttggtatgtacagaaggaaaacaaaaatctgaagctttcttatcaatatgtttatctgtctccaacagacagtggttttcatgggcatcattaactggtttttttgttcaataactagattctactttgtcaccctcttcagacccagatttgcttgtgatgataactcttatgtcacatttgctcctaaaagtaaagcaacttctgtgtcactgtgaaaactgaactcagtcctttaatctctgaacttacatttaacacccaattcatctttggtaggtacatttgccttcacagtgaggcactaaagcaacacttgataatgattgtgctggtaaatctgttttgcctttagtgtgatctgcatgaaaaaaccctcatagtaggtattcagaaagtgttgggttgtggagtcagaagatgaggttctctgacatgcactccctgtgtgacctttggcagagtcatttgacttctgggccagcttctcactttagggattggagcagaaggtggctcagaggctgaccccaggatggtggaggtgctgagctggatgccggtttcaatcaggacagttcctctgttgagtttccatttcaggttgtggccaggcatggtggctcatgcctgtaattctagcactttgggaggccaaagtgggcggatcacttgaggtcgggagttcaagaccagcctggccaacatggcgaaaccccatctctactaaaaatacaaaaat

SEQ ID NO: 80807 - DNA, 1041 bp, Homo sapiens
ttaggcaaatgcttttctttgggaccagcatctccgcttatgaaataagcaagttgccaggtgtcgtggtgcacacctgtaatcccacctactcaggaggctgaggcaagagggtcacttgagcccaggagttggagactgcagtgagttatgattgtgcctttgaatagtcactgcactccatcctgggcaacctagggagaccccatctcaaaaagcctaaaacaacaacaagaaataagtgagttgtgctctggatttcatgaggaacatcctggctctaaaattaatggtaattttcttagaatatatgttacccctaaattgaccgaatggtcaagaatgttggcacaaaatgatccactcatctgagaagaatctgtatgttgagctgaaaaagtagttttattctaccttcaacatcttttatttgacaacttatattcgttaaattgactttgaaaatatacagtactcaatctaaagtaaaaatctgagtatttaggctttcaaatctgagatagcttgccacattgagctaatacatgagatttgtattcctgggaagctactgaatatatctgtgccaagttgcagcattaccatccatcaggacttcctcgctcttgtttactgtatgtggtttaattctgtgtgtgatatttctctgttgatattaatataggtctctcggctgctgggggcattccacaacccaaaacaggtgaccagaggttttactggtggtgtgagtataattatgtcttttattttttccttttagaagtttctcaagaaagatgctctaacatatttattatatagcattttatctccattcatttagaatttgggaaaattggccatatttataatgtatgttgaaattactggctgacatgcacaaatctgttaggttacttgcgcatttgaaagaattatcttacagctggctatgtaagtttgtcacattaatatcttgagggagccttgttaaaaatagaaagtacccttgagcctgttattttatttcacaatctc

SEQ ID NO: 80808 - DNA, 1047 bp, Homo sapiens
ctttgcaggtatgatgacatatactattctttttggttgcagatcaactttgccaagcttatgtagattactcttagatttaagcagacagttttatagaggaactaagaaaaaaatggaagctctcttgataaaaagtctgattttccctgagtaccaaaacagacctcagtaatattttggaaatgtgtctgaaaatgttttgcaagactgaagaagttgcatgagaagctttccaggatcacaatggaaaggaaaggaaaacacttgccttcatgagaaaccgtctaaattttagtgagagaacattgttaattttttgttgttgttgtctttggtttaaaagatttgaattaattggtctctttgcagcttgtctgaaaagaaatatcaattaggaaatctacttggtagtttaatttattttcgttttatgtaaagagtatcatttggttctttttaaaacctctgaactcaggtaaagagtaggattgcagagtctctcctctgttgattcctgcctcccctttgatgacccccggggaggtatgtttgttttcttaacagcatttgaatcttcctgagacatctcataaagtggatttctctgtcaaaatattcttttttaagccttcaaaaacaaaaattcttactgtcttctttgatgatttcttatgttcaggttcagacagtaactttaattccaggagatggtattggcccagaaatttcagctgcagttatgaagatttttgatgctgccaaagtaagtgggcttaaaaaatacatttaatgatgactcactgaaaagttttcttagccagttggattctgtgaacttttaggatgcattgtacccatttctatgaaatttagtcaggtctgttgttaatctccaccgattgtcactttaacagtgtgtgtctcagtgtttgctactgccattatttctttctttcttttttttttttttttaaatttagagatgaggtctcgctctattcccaggctggtcttgaactctggggctcaagcgatcctcccacc

SEQ ID NO: 80809 - DNA, 1075 bp, Homo sapiens
tacaggtgcacaccaccacacctggctaatttttgtatttttagtagggacggggtttcgccatgttggccaggctggtctggaactcctgacctcaagtgatctgcccaccttggcctcccaaagtgctgggattacaggcatgagccactgagcccagctgtggacatggttttctgttttattcagtgatatatccatcatcataatcatgaatattgatgcataggttgtcctaacttggctgatgggggtcccttcaccatgtcttctgtgtcctttagacacggccctttgttctttgagccttgccttgctttctgacacagtaagatgctcgaggctcatctgtattttcctaacctttgccctggaatcagccatttatccaaggaatgctacttccttttagtggagaatgataattaaaaactaaaatctgggtgctaggtgagatgttttatttttaaaaacattctttgaaatgcttttcttccgctagtgacttgtgtgcaggattgatcggaggtctcggtgtgacaccaagtggcaacattggagccaatggggttgcaatttttgagtcggtaaggaccctgacacctgaaacagaactcaggtcagaacagcgtgtgaactcaggaggagttatctgtataagtatgctttaactccagtttttcaaattgtcaaaacaaaatgatgctttttttttttctcgagacggagtctcgctctgtcacccacgctggagtacagtggtgcgatcttggctcactgcaacctctgcctcccaggttcaagtgattctcctgcctcagcctctcaagtagctgggattacaggtgtgagccaccacacctggctaatttttgtattttagtagagatggggtttcaccatgttggccaggctgttcttgaactcctgatctcagatgatccatccgccttggcctcccaaagttgctgggattacaggtgtgagccattgcacccagcctatgtttgtttttatatacacccatatataaacatatatatatgtttggtttatctcttcatttccctccagg

SEQ ID NO: 80810 - DNA, 1058 bp, Homo sapiens
ctggtgtgatcatagctcactgcaggcttgaactgctaggcttaagcaatcctcctgcctcagcctcccaagtagctggcactgtagtcaggcaccaccatgcctggctaattgctaatttttttgtagaaatggggtctcactatgttgcccaggctggtcttgaactcctggcctcaagtgatcttcttgccttggcctatcaacgtgttgcgattacaggtgtgagctatcacgcccaacccagactttatttcttcagtccatatcagatgaattgcacgcagtagctttcagtgcatattttgtattgctgaggaaagatggttaagactccagcttccccagaagaggactgttagtttttgtctctcccttgatgatgctacttttcccgatgtgtaggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaaggtaacaggaatcttgatttacttgtgctgggtaaaatgcattgcttccatgtgttttatctgagtgaaagggacagtgacagataatagttctcaggcgggcccaagcatttgatgttgaacaaggattcttaacgtgggtcccagattgaacagggtatgtgtgcacatgtgtgcattttctgaggtgaggatctagatatttcatccaaaaaaagttaagcagcactgatgtatagacatcagtgtacagtggaaaggtcagtggtttgggaggcagcatcaggtgcacgcccaattatcctattgttagctgtgtgaccttggccaagttcattgattttttttgagacagagtcttgctctgtcacccaggctggggtgcagtgtcataatcttggctcactgcaacctgcacctcccgggttcaagcagttctcctgcctcagcctccctagtagctgggattacaggcgtgtgccaccacacccagctaatttt

SEQ ID NO: 80811 - DNA, 1615 bp, Homo sapiens
gtagttgcagctataggctgaggcaggaggatcaccttagcctctgagttcaagaccagcctgggccacatagtgagaccccgtctcttaaaaaaaaaaaaaagagttaatgatttaaatatttctttcgtatttgtgtcccagcctccaaaaatagatcagatacaaaaattagttgggtatggtggcatgcacttgtaattccagctattcaggacgctgaggcaggagaatcgcttgaacccaggaggcagaggttgtggtgagctgggatcgtgccactgcactccagcctgggcaacagagtgagactccatctaaaaaaaaaataataataaaaacaaaaatagatcaaaatatgtctcaggtctattcctgagacatatttcccaaggatttttatgaaacttcttatttagattcgcttttatttaaatatccatgaccaactaatctgggttagggtctattgtgtgaacaaagggaaaattttggtaaagctccctgcctccctttgcatcaagagcaccttattctttgcagagtgctgttgtatacactatgagattggatcccgatcctcctgggctgggtagatggtggtggagtggttcctcactttgaaatgaggaactaaatgaaagagcagccgagtaacttgcccaggtggcatctcactgagggctttaaaatctccttggtttagtttagtttgcggatacatcttttatttttgctttttccttttctcagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagca

SEQ ID NO: 80812 - DNA, 1019 bp, Homo sapiens
caggagttaccgtccctgctttacagacaatgacgtcactgaccgagctcttctaattctcagatcactgctccttccacaataacacgaggctcaacacagtagcagctactcattctagaaccgtctctttgaaacagagctcacatgattcacacccttgccgacagcagtaagacctcctccaggaccagggcttacgtcttgttgggtaaggcttggtcctcatctgatctctggcttttcagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtaggtttttccttttcaccattgcaagggctgtgtgggaaggcagaggccatggcagtgcctaggaggtgcctgttaggaagcagccacggcaaagagaaggtcatggcaggaatctgggtgacacccatctacttcctgttagaggacattgatggctccatgcatgggcttgtggttatgtggagtctgttgaatgtataagatatgtgctagaacttcctttttttttttttttttttttttttgagatggagtctcgctgtgtcacccaggctagagagcaatggcacgaccttggctcactgcaacctgcacctcgcgggttcaagtgattctcctgcctcagcctcccgagtagctgggattacaggcatgggccaccatgcccggctaattttgtatttttagtagagacatggtttctccatgttggtcaggctggtctcgaactcccgacctcaggtgatccgcccgcctcggcctcccaaagtgctgggattacaggcgtgagccactgcgcc

SEQ ID NO: 80813 - DNA, 1684 bp, Homo sapiens
taaggatagcagatttggtccagcttattggcagagttaataatatactttccacttcagtgattatactgtagaaattaacatctcaattttgtttgaaactttcccatttcagacaacatgccaatttggctggcacgctgagcggccatgcctcctgggtgctgaacgttgcattctgtcctgatgacactcactttgtttccaggtacttaatgattcttagcagtttctaaaatgctggggagatgagagcagtcttcttgtatagattgccttaacatttaaagatgtttgacccttttttattcagttagcctttcttttctgcagttcttaaaatttttatttagtgatgttagttgaccttagctggaacaaaagtcaacaagtaatccttttaaacagtaaaactcttagttttttcattataaattgaggcttctaccaaagtgactctaaggtagacttgtgttccaatggtaacttaaaatatgtaaatgtttgtaaaatgttgtttatagatcccagtgttggtcaggcctgggatggccaagacagttggaaagcaggagatggacaacttgaaggcattgcacagtgctttagaggcctcctgcgagccttggttttgaagctttaacaggcctccctcccatctggaaataggtagctgtgtctgagactcctggagaacaattaatatgagggccaggcagatcacaatttcaggaaaatggctaccctgtgaggagagaaagccacccaatgatgctgatacctggccatttcctgtaccgaggcatggggttggggggtctgaagttagaagaatgtaagtcatcaaaggatttttggtcgaagtccttccaacttcaaaccgatactaatgttcactttttaaaatagttcgtctgacaaaagtgtaaaagtttgggatgttggaacgaggacttgtgttcacaccttctttgatcaccaggatcaggtatggcattattatttcatctttagatagtcggggttgtttgaccattgtaccaaagagattttcttttcctgaccttgttgcttgagctgtggataccagtagatgcctgggcctgagctgctctatctgctcagtcatccatgtagccagagttcctgtgcagagtctggggtgcagaggctgggatgtgctgtcagcctagcaactcacgaggcatatccccacataggctggaaaacatggtgttagccccacagcctttaaatgccgtctttggaaattgctgcagctggtgtctggggccctctcctgggggctgctgcgccatggcaggctcaccaaggaccttcctcttcaggagattccattgcttaaacacaatcatcgcttgtcatttttgggactgtccaaagaagagatgtgatttttttttttttaatatagtagaagctggaaattcatacaagttttttggctttagtgttattgataacttttcagtctttaaaaggaaactgttctcacaagcaactttatctttgccaaggtgaatatgtgaaatagcaaaggtgttctagtgcaatactgctgagtctttcatgtgtgctcgtatcccctgggaacctggtgaaaatgcagatgctgcttcactaggtctggcagagggcctgggattctgcatttctaacaggc

SEQ ID NO: 80814 - DNA, 1050 bp, Homo sapiens
aatctgaaccaccacacaggaagagaaaaagagaagagagacaatccccagtcgtggagaagtaaggaagtaggaggaagcgaagaccatgagtgtaccagtctttgtgtggacatatgttttcattaggagtagaattgctgagtatcatggtaagtgtttgttttcacttaagaaactgtcaaactggttttcaaagtggctgtgccgttttacattcccaccagtgtatgaaggctctggtttctccacatccttgctaacacttgatattgtcctattttaattaaaaatttaagaaacccttaaactaaatttaaacttgataaagaattagcatctttacaacataattttctgaatcaggacactgctactccgatttaaaaagatgtatcctttggtaaaactttagtttttaaaattaaggccaagtcttttcacactgtatttttgtccttcttttttctgttcagtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatgtaaggaaacattgctctctgttctccttctgattctttcagtttacccttccagcctgttgcagtccttgccacagattctgtcttggtctggtcaggcagctgctgtctcactggtgtggtttgccaagtagccagttagacctgtagatagcaggaggtttgcttgtgtttggtagggacagcttaacaacacggagtctgaaagtgctaatttctccatatgttctctgaacagagtcctgatgggaaatacctagccagtggagccatagatggaatcatcaatatttttgatattgcaactggaaaacttctgcataccctggaaggtatatatcatcatcttattttgacaaactgggttatcaaatcacaaaggaagaattattctttcattgaaatgccattaaatggcaaatggg

SEQ ID NO: 80815 - DNA, 1032 bp, Homo sapiens
tcataggctgactaatgtggagcagcagaggacatttcaggattcttttgaacttcacatttacttataaatggctgcacaacattccccagcagaacctgctctgccagaatgggtggtaactgctagagggtgcagatagcctggcatttctctggcacacccctttttgggttgatgatagaagagctgcttaggtgttccatgaacacagttcccttgattggtgccctggatggattcgcctcccgccagttatgctcagtagccactctaggctgttcctgtattggaaagaatgatggtcccagagtttttaaagaggctgggttgtctggaaactgagtgcattttccctcagaagcaatatttcttgtctgtaattcttaccactggagctcttttaagaatatgcctgcccagtccatattttggatccactgaatcatagtgttcagagtacgtggggtgggatatgtatttggaaaaagctacccagacgcaccctgactcccctgatggttgtctttacatgtacccttaccctgcttacattacttacagaggacttgggtccccaaactatcctgcaaagtctattaagactccaatatataagcatggtcttaagaaaagaggaagagacagaactgtttctaccttttcatcttgggcgcctaagctttccctgggctcataatgctggtgttattccatgctggttgtagccctgggcacaaggcagctgaagaaatcagtgctggattggttccaagtaaaaggatggcgtatgtatctagctcactttctctgataaacagtaccttttactggatattctccaagtgtggcaaagttttaaaggttactgttatgaaagaaaaagaagaggccaggtgtggtggctcacacctgtaatcccaacactttgtggggctgaggcgggtggattacttgaggtcaggaattcaagatcagcctgaccaatatggtgaaaccctgtctctactaaaaaatacaaaaaattagctg

SEQ ID NO: 80816 - DNA, 1098 bp, Homo sapiens
tgcacagctgttttaagtttaatgcctttatattcatattttgggaaggtatcgctggagaattgttgccaggcaggggtaaagcctccatgtgcacttgtcacgtttttacatccacactgggtctgcacatacaacagcatggcctaccaaatatgcagcttacagacttagacttaaggtagactttaattaatagagattggatttgaatcctagcacctctcattccttgtctataaaatgaggatattaatagtacccacttcataggattgttgtaatgtaataattggcccattaaccataataaagatacttgtggggaaaggcaacttaatatatggaggctatagtaggtattttcttttagatctatactgtttagaattgaactgcctgcttgtttcgaaagatcttttcggagtatctgttaccgggtttaggccttttcttggtaggagggggtcttccccactggttttacttgtttttagccaagtgatagccattgtagactcctatataccagatagcatgctaaaagaaaggacactggatttagagtccgaagtactaccttgtcgcctggtaaacatgagatttagggcaagtagcttcttcagaacctccaattttcatatgtggccccaaaatttcaataaaagctgtataggaaagcactttgtaaaatagtaaagcaaatacaaataaatgttacctcacaattgttgaacagtatctcggcttcattaagtcgtatgcaagaagactttataaatgaagcactttccattctagcccatgatgatgccatttggtcagttgcttgggggacaaacaagaaggaaaactctgagacagtggtcacaggctccctagatgacctggtgaaggtctggaaatggtgagtgcctctcccctaacatacagccttggaaaattgggggctgaggttttgcttctgaactctccagttgcagtccgggaaatacttttttctaggcaagaaagcaatagcaatatggtggtataaaacagcagcttatttttcccacttgttttcctgttactctgtattaaagccctaaagttaaa

SEQ ID NO: 80817 - DNA, 1031 bp, Homo sapiens
tttattagagacgtggtttcaccatgtcagccaggatgttctcaatctcttgacacgtgtctccctccagcttctgcccttatttacctgcctgttggctcttaaaggcatttttggttgagacttttgcatgtaaaataagaactttgccatctttggattcccccatgtttgtttgtttgtttttaataaataatatttaatattaaaaggagctgtggtttttttctctctaaagagcaggaaaggacagagactggtcgctctctgcagtcacacttgaggtgaagaaaccatgggatagaattagctgttagttgagtccctaggttcagaggaagaaagaagaccataccacctggtagggagtgcgaaggaggttccagggactgatccatagaagggtgtcagaacaacttcataataaagagttgccttattttcttggtcaaggggaacttcctgtgtgccttctatcctgatgacaccccctcactgaaatcctggtgttgtttccacagagctgtctggccttttgtccttgatccttggttaaggaaatgaccaaccaggtaagacctgtgttgaagggaaaaacatcaattggtctctttgccaagttcaagtccagtaggttttctggatgtgtagtcaagaaactagcatctcattcttgcctggctcctaaagagctgggtgaccctgggtacctagtcaccacagtgttaggtgggactagtgaaatgcaaatactgagaggaggattggttcatccaagtctttaccacaatttagtgagtaatagaagaagcttaaaagatgttgtacaaaaaaaaaaaaaaaaagatcagaataggagatagaacaggagaaacatatctttgtaataagattagggacaaagttaatagacggttaggcaggctgtgtgttcttattgcagctgcaaaatttaagctacaaactggactttgagcttccttggtgatcagaacagaaaaagaaaacataatttattggtctcttgttga

SEQ ID NO: 80818 - DNA, 1012 bp, Homo sapiens
ttgtgtattacttaaaataggaccggattcattgtacatcctcaaatgtgcactcattgatagaatcacacccttgtcttttggagcccgggtttttggaagctggcttaccgcaagccttcctcctttttttgtttctatccattgccaaatgtgaggcccagaatgacagggaagaggacaagcctgtgcttcagcaggcagaaggctgtgctgaagcagaggttgaataccattcccattagccaaactggcttgagcactttcctgtctttcctaccctgggcagaaagaaccctgttcatgggtcacaaatgaataaaacactaccaacctgtctgtaatcccagcactttggaaggccaagacaagaggatcgtttgaggccaggagtttgataccagcctgggcaacataatgagaacttgtctttacaaaaccaaaacaaaacactaccaatttgagatcttcataggcaaggattagttataaattgtttgtttgtttgatttcctgttattggaaaaccttcggcagctttttaggctggcagatttaaagaaagtaacctgaacctggatgccttaactgtgtggtcccttaaactgccaatgggtagaattgcgagggccgtgaacttggctgagaggaaaaattgcatctttatgtttcctaacctccaactgaaatttagcattttcttccactgtgaatgtaggcaacaaatcacattattagcagtgtgactttgttatgaatataaattatagatattttcatatcatgatattgtgtaagctcattgcaacttcgaaattatggtagttattaaatttgcttctagatcacatatataatgtgtcagtaaagaagcacatatgtttttgtattttgataaaattttagcatacagtctatcctcattatttgtggattctgtatttatgaattcacctacttactaaaatttgtctgtagccctcaaattaatacttacaatgcttttgtggtc

SEQ ID NO: 80819 - DNA, 1053 bp, Homo sapiens
aaaaaaagtcagttgacaacctattaaactgatatctgtcacgttaatgggtcatgactagcagtttgaaagacaaagctcgatttcactgaatttatttcagcaacagaagttattagctttagtccaatctcaaaagtacaaaatgaaattgcaacacaaacctctaaacctgcagttgccggaagctaaacgtctgcgcttccggaagcaaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtggtgagttggagcgcagggccgttggggattggggtcattagggccgttgacagtccaggccagagggcgagtgagcgaggttgggcccgaggctgcctgtaagcaggtccgttcagggatgctccaggccctggggcctgagggtggcttccatggctccatttgccctggctgttcctcggtgtacggggcctgaggggagtgggggaggcccgtgggtggcctccttttgcgtcctgagaatgttctgggcagtatcgagattagggctggtttctctgcggaggagatcatttatccgtagctgggagggctgtattaaccgaagttttccagtagtgggccacgctgtcttaggtagcgtgctggacagatacagacatcactggacgggtacagacagaggctgggttcgctttacgccaagtaccgtgcaatactgtgggctgttgacttgcctgagtagtttcatagaggcatctgtagtgttccttggaaacactgagtcagtgatgaattctgcctaggaaatttagggaaaagtttcccaaagagagaagatggcaagagagggctaaggtctaaagtctcttagctctgaccttcat

SEQ ID NO: 80820 - DNA, 1044 bp, Homo sapiens
ggcgcccaggccctcggggctcgggttgtgctcccctcggggcctgcctgctgggccgccctttgagcctaggccgcggaagctggggctcccgatccccaccctcctgcgcgacacccgcagggcgggccaccccaccgctggccttgacccgcacccctctctctccggtggccgctgcctgctgccagcggcttcctggcccccgtcagcaacaccaggggcagggagaggcccaccgtcttctcctgcccgccccccattggcgagcgatgaaggcgggggcctgcgtctccgtgttcgggtctcacgcagctagatgttgattccacggtccagcctaaggcccctcagtctctctgtgcctctggaagccgaatgaggggcagtcaaggttgaacattggtcagtcagttctccgaccatttattgcaccgctgtctcctcccccgtccacctccctctacaaaaaaaaaaaaagagaaaaaaatactattcattctgaaaatgggctgtgcttatgttttctccttttggatgaaagccttaacaatgttgagggtcctggccacccaccgctatgagtctgcacaaaagatctgaaggttcttttcaacctcagggctgcctccccgccactgccccctagaatgttgggagctgaggcacgtttaaatgagacctctggatctttgacttagtagttcagcttcagttcgtgcaaaaccagaagacttgtctctttcgggtagaatatgctaatttcctagagattctgttacttttattttcagtactaagccctggtaaggacttaactgagaagtttttttgttttggtttattgaatgctctgtaaaaatccgtcttttagtttttttttttaatcagtccctctaatgttaattgtggaattcacaaattcctgtctctgcagttttcaagacatgtctttccaaaacgtccccgtggattatttaaatcattcttattgtccctttccaggtattcttatcacatttcaggagtgaattatcttactag

SEQ ID NO: 80821 - DNA, 1089 bp, Homo sapiens
aaataatcctcccacctctgcctccccaagttttgggattacacatgtaagctactgcgcctggcctaatgtgatttttagaagaacctgactgactgatgataattctacaccaattaaatgtatattttattttctcttttcttttctttttttttttgagacagagtcttgctctgttgcccaggctagagcacagtgttgtgatcatagctcatacagccttgaactcctgggctaaagcagtcctgcctctgcctcccaagtaacaaggcctacaggtgtatgccaacacatttatataaaaacatatttttatattttttgtagagttggggtcttgctgtgttgcccagactagtctcagactcctgaccttaagtgatgcatctgcctcagcctcacaaagtattgggattgcaggcctgagccactatgcctggcctgttttactttgtcaaatgaacagtgcccacatctattctttttgccatctgttgaataggaatcaccaacaggacccattgatttgaatttttctgaagtattgggcatggtttgccccaacctacacacctgcagttttggcagacattctcattgaccttatcagggtcaaacctttctctgtggtctcagaagagtgaatgtgggcgacctatagggcattgaatggaagttttgactttactaacagttgagtaactttctcaattgggccaatagagagacctctttagaagactcattattctttgtgaacttttccatgacaatgacatgaaaagataaattgaatgccacatctgttgcagtcagttttggaaggagctttaatcttgttttttcttgcattatttaattaagacgattgttcttgtgatttttctgtagattttgaggaatttaaatattcttgactgctatgtgcaatattttttgtgtattgtgaaatacagctattttggagtatcttaaagaatccccattttagaattaggctgtcatttaaaaataaacagtttgccaaaatgagagcaatatcctttaccttgcatgtttagctgcagtgatttgtgttgatacgtt

SEQ ID NO: 80822 - DNA, 3062 bp, Homo sapiens
tggctgtctggcactcccaatgtgctgactagaaacatgtcaaaatctaggtagtctcaaaatgtagattttgagtaactctttaaaaaaaaaaattataaagatggagttttactgtcaacctggctggagtgctctgacatgatgatagctcactggagccttgaactcctgagctcaggagatcctcccacctcaccctctcaagtagctgatttgggtgactctcttaagtagatctctgaatttgaaactattgctatttttaaggagtggagaaatcagtggtgtctccatgtatgatggaggacagttaacatcagagaattagaatgaacagcataatggaaacatgaatgactatgttgaatgaaggggaagatggtggagagactggcctggctggagtgaaaggtagttttgagagagtacctgttactgggcaacagggcctctggtggtgtaaagcccccaggcaccctttatctcaggtcatcttattcaccctttcttttgtccttcctgtctgcttgcctttttaaccacagtactgcttagtcctccagtagagccgggacttagtgtccaaatcctaccttgcagcctttggaagaaaatcctgtatttaattttttaggagagtttttatcatttagaagaatcacaaaaagacaagaacattgcagatggtacagaaagtctcatttttatgtgtatacaaaaatatatgtaaatatgctacttttaataaaaataaagtatatgttgttttgtaaccctttttttcacttaatatatcatgaacatctttccatgtcattgaatacaggtatcccttgctatctgaatctacttggtttctgagtcagggagcttgagttcaggtagaaagggatacctgtacttctctgtggcttctaatagctgcacaatattgcctgtatgaatgcattgtggtttagttaacagacctttgaatattgaggctgatagtaacttttctctatttataaataaactttgtatgtgctaatacttacatttttgtgcaaacttatcattatatagaattgttggattgaaagtatgttatttcctccaccccatcacacgcttttatttttatactttcactatttactgttggttccagtctttatttttttttttttttttttgagacagagtcttgctgtgttgcccaggctggagtgcagtggcacagtctcagttcattgcgtcctccaactcctgggttcaagtgattcttctgcctcagcctctggagtagctgggattacaggcccatgccttcacaccctgctgatttttgtatttttagtagagacagggtttcgccatgctggccaggctggtctcggaactcctggcctcaggtgatccacctgccttggcctcccaaagtgttgagattacaggcatgaaccactgcacccggtctggttccagtctttaccttggactaaaaagaacaaaaactcactcaagtaaaaaataggttgcagtttccagacatccaaagacaaaggaagaaagcatagtcaagtttcagggaaccagaatttctaagccagaggcagtgttctgtttgtcacttaaaggctgcctggtttccttattttctgtttctttttgaatatccagtcttccatctctacagcctacttcacttactcatttttgtataatgcccaatatggccactgctgaccattcttgtatgttatgactggattactaaccggttaagagtgtacctctaggtgactcttttacttgttttgttttgtttgttttgttttttccctcagggtcttgctctgttgcccaggctggagtgtagtggttcgatcatggctcactgcagcctggacctcccgggctcaagtgatcctctttcctcagtctcccaagtagttgggactacaagcacatgccatcatgcctggctaaattttaaatgttttgtagagacagggtctccctacattgcctaggctggtcttgaatcctggcttcaagtgatccttctgcctcagcctcccaaagtgctggggttacaggtgtgatccattgtatccagctcacctgttgttttaacctattttgactgcacttgtcaggagtctattgccggtctggtgatcttgctggtagagacacaaatctgttcatcttgtcttttatgtggactcttgaaaagactgggttgggtaagcaatgtaacagtttgcttgtaatttgtacacatagtacataactttccaaggattacctttacctaacatcatcctactagtccatgtatagccatgtgctcaccaaccctccacatttcaactttgtttttattgccaatttctattctagattaggcccttttggttccaaggaacagacactagctcgagtgaagaaggatttattgtaatgatacagcgctccccaggccaatgaaatgtggctgtctctcaagaaaatggtggtggcccagaattaaggaagttgtttattattttctcttaggagcttcagatttctgccctgttccactcttctgcttcctccacttcactatagacaagcctcctctgcctgctcactttgtacatggcctcaaatggcaacctcagtccctagcttagctcttaacacctttccagttcagtctctctgtgtcctgattacacatttctgagaggtgaatctaattgccccagtgtctcctttctcacaagacttttggtcatcagcctaccaggggattggcttttgcgtcgctgctgtagccaaggaggccacaggccaccgagaactgtagcagtttggacaggcaccatgaaggacatctgttgtatagtgttagcaaagaatgccagtttacatgcttaccagtgaatgagaagaatatgtgtttctgcaccttcatcaatagtagatattatttttcttgttggctcaatttctgtcagtgaatgaagagaagaaaaaaaactttcttctacattaaattggggggtttattgtgaagatttgaagga

SEQ ID NO: 80823 - DNA, 1775 bp, Homo sapiens
caggaaggcacatgtcctatatagagaggtaggtgcttactaagttccagcagaagtacaaggttggtattgtaaagttttctgattgaaagacctgtagttttttaaatgttggcagttaaatttaaaatgttaaaactctgcagaacaagcaaaacatgtctgcaagccagcagacatgaaacagagtttgtgacctctgtactgagagatacactgtgttttctaatctttgcagcagctatttagccttgaatagtagaatctgcagtcttgggagccttggtttgcctttcatcggatgcttcccgtatacaaatagcagacctcagcatttttttttcagagccgaaccacctattggatcttccactaagtaactgatcaaaaggatatttattgttatcagcttattttagaagtgtgatgacacgaattactatactaaaccagtttaaattaccatcatcccagttcctccatggcgtttttaattacctgtccttaaagggttagctttatggattcatagaattctagaaattcctgattagaagaggcagacgtaatccagtgcattttttttacttgttgcatgagtctctaaacaatatgatttaatttattgagctaatatttattgagtacttgtatatttctagcaaatgaaagatggctaagatagcatctgtgctaaagaaaagacacggtttagtaatggggacatacatggaaagtatatgtgaagtacagtactatgttgtagcaatttgggtccagtcaggagatagaaaccacataataggttaaacagaggaagcttaatatacataattattaactatggtaagagtaattgtaatacaggataattgtatataatactgtagggctaagggagaatacccaaggaaggacaaacttggaagaggttcagaactcactggaataggtgtgggttggcccacagataacagagaagtatattggttttggccaggttggagctggtctggagttgctgggtaggcagtaggccaccctctggagtgcaggcagggatctgatgatcaggaactagtggtgtgggcatgcgttgggaaaacagatgctggtagggggcaagagcccttcagagctcatgggccatgtcggggcttgtagaaggagtgacagctcaatatatgaccctcgaggcagcttacagatgtagtccacgtgctgtcagagcagcaggccttctttacgggggtgcctcagtccaggtactggcacaggcaggatgccttcagagtgtacagctatgtaggaactccagctcctaagttgagagggctgtggtgatattaacaaatttgtgtgtgtgtgtgtgtgtgtgtgtgtgtgtgtgtgtgtgtgtgtgtgtattttaatatacaatgtaatggtgtccacctttggaagttctgcataacttgatgaactcttatttctcaaagaccaataatgtaatgagcagactgtagaagcttatttcattcaaatcttgctctgttgcccaggctggagtgcagtggctcaatctcggctcactgcaacctccatctcttaggttcaagcgattctcctgcctcaacctcccgagtagctgggattacaggcgcccaccaccacacctggctaattttttgtatttttagtagtgatgggatttcaccatgttggccaggctggtctcgaactcctgacctcagatgatccacccacctcggcctcccaaagtgctgggattacag

SEQ ID NO: 80824 - DNA, 1006 bp, Homo sapiens
caacagggtttcaccatgttggtcaggctggtctcaaactcctgaccttaggtgatccactcgcctcaacctcccaaagtgctaggattacaggagtgagccaccacacctggtggattttggatttttggattagggatactcaacctgtagtacaatttggtgccactgctttgagtcctgctaaggcatcagcagtttaggaccacatttcgaaaatcacagtatagggttgggggaccacctagggaacctaagtgagagatgatgtactggtggttgggactagatttaatggtgatattgatagaagacaaaaagatgtaggagagaggcattgaggaaaatgcctcgatgttttggcataaacatctggaaggatggtggtgctatttactgtgctagggaatggaagatgaggtgatgataaggggaaggggcagaggggaaatcactgagttcaagtttaggtactagtgaagttgggaacataccagtattaaagtaaacatgttcacctcctgaatcgggcatgtggttttggagcttagaagacagacttggactacagaaaatattttggaattattagtgtagatgtagtgataattgaagccataggagcagttgtactccctggaggaagcagtatagagtaagaaaaaaagtgagtctcaatatgaactctgaggaactcctacatttagatatcagataaaggagtagaggttaacaaggaagataggcctacctagaagtgttaagaactataaaggaggcttggcatggtgacccacacctgtaatctcagcactttgggaggctgaggcgggaggatctcttgagcccaggagttcgagaccagcctgggcaacatagtgagacccccatttcaattttaaaaaaatgaaaaagaactataaaggatctaaaattttaccttccttggaagttaacaaattagcctgacgtagtttcatgtatgttggcaggaggcacccaactc

SEQ ID NO: 80825 - DNA, 1061 bp, Homo sapiens
aaaattttaaatttattacagacatttatacagtttaatcattttctttttgccataccaggggatgtctgcattattgaattgaattctgatattctgtgcttttttttagtttttctgtgaattccttgaatatgaagtatttgtcatagttgcagtatgatattcctaaattaatgcagctcttgtatgaaggtttttatctctgcttttttcaaggctttgaggttatgtacaggaaagtcagttacaaaacacctgatgttaacacgaatggtgttacactctagtttgtcagactaaaaatgaattgtttaaattgagaaaacagtgcatttttgtctttgtctaactttttgctatggcattttaaaaataatatataggtatgactgtttgcttattaatagtaatattttcttgaatcagatgttctgccttactcaatacgggtcttgttggaagctgctgtacgaaattgtgatggctttttaatgaagaaggaagatgttatgaacattttagactggaaaaccaaacaaagcaatgttgaagtgccctttttccctgcccgtgttcttcttcaagattttacgtgagtaatgggtttattttttgtgaatgaactcttagagtgtgtttcctttttaaaatacagactcttgggtaggtgtggttgttcatacctctaatcccagtactttgggaggccaaggcaggaagatcacttgagcctgggagtttgcagtcagtctgggcaacatagtgagacgctgtctgtacaaaaaaatttttttaattagccgaatgtaatggtgcatgcctgtagtcccagctactctggaggctgaggtgggaggattacttaagcccaggaggttgaggctgcagtgagctgtgatcacaccactgcactccagcctgggtgacaatgcaagaccctgtctctaaaaataaaaaataaaataaaaaatcagacttcctaatggatggctctgtgtttttttgttttgttttgtttttgtttgtttttttaaggttagtttataaacttaaaaatt

SEQ ID NO: 80826 - DNA, 2548 bp, Homo sapiens
catcctcttcacccacccactcaaatctggtttgtgtgccacagctctttgtaccctatgtatgctgctattatggtacttacgatacatagccgcataagaaataaatgatatttcttacaccatttattcagaaactgcttttcttaactacctgcttatgatttccacataaccaataggtttctcaaacttaacatgttgaaaacttgatcttattttgagatacagtcacactctgtcacctaggctggagtgtagtgatgtgatcatagttcactgcagcatcgacctcctgggctcaagctgttattgtatgcagctattatagtacttacgatactattctttaatcattatcttccctaaaatttttttgagagccagaactatgtcttatttggccttgtaccattggtgtctagcacactgaaggcatttgataaatgcttgttgtatagttggctggatagatgggtggatgaatgtaaaatggcaaaagctactgtggatagctttggggcaacacgaaggcactagggggaaggggctggaactagggaaaggggaaggtgcatcaaaaaaatacatggcaagagtttcacaggcattttccctgaagttcgcttatgcctcaaaaattatctcttattatttttggcatatttgcccaagtacttcagttctcagataatgtttaatgttaattcttattaaacaggatactcctaacttataaagtacattatgaaaaatgaatgtaaactagacagggatactttttaaaatatgaaaatgaaaaagtttatcatttattaagcatgtataaaaaacaatttggactataatttgaccattctttattttttagtggaataccagcaatggtggattttgctgctatgagggaggcagtgaaaactcttggaggtgatcctgagaaagtccatcctgcttgtccgacagatcttacagttgaccattctttacaaattgacttcagtaaatggtacttcaatgcagatatttatagacagccatgcaagttaattggctggaaatgtgtcatgtagaggaaaaggaatagagataatttatggcagagaaaagtatgctaaatttagtattggctagtatataaaagctaaaactggtgaaaagtttatggagtggtggggtttttttcatgttcttgtatttctgctgccgtttttgatagaaatgaataagcctaggacctgctttttggagtgaacctctgtattcagtctttgtttccttttttgttttttaacctacttgtctttcagaaagaatcgaaagatgtgagtcatgaatgtttttaattatttggtgattaaaaacattgaactcactaaagctctattttccttcctctgaaataagtttcttgtatttataaggcccctttgaccaagaccaaactagagaagacatatttctgttgccataaagtaactttttaaaaacgttccctggagtagtagaataagactgcaatttattatagcccatgagagaggttttgccctcgagataaactgtagctctaaatttcttttaagttgttagggggaaaaaatctatttcagtacttgctaaaagttatttaaattagtagagtatttgaaagtgattttactggacgcttagaattctgttttcatttctgtaaatttaaatgacctgtttctttttttatatatatataatctgagatttgcctttgaaacctgagttaaatgatacattagcctttaaacatcattcagttacttccagatagcgttgctaatgtgcgtttttttttaagagctaaatttgtgtcccttttaaatggctttattttgttttctttttggaatgacagtgcaatacagaatgcaccaaatcctggaggtggtgacctgcagaaagcaggaaagctctctccagttaaagtgcagcctaagaagcttccctgcagaggccagactacctgccgaggatcttgtgattctggagaactaggccgaaactcaggaacattttcttcgcagattgagaatacacccatcctgtgtccttttcatttgcaaccagtgcctgagtatgagattgtttttcttaaagtttattaataccaggttattttccagttaagaaaatcaaatttattctcttcccacccaattactattatgttaccttcacacttaagtactgaattgaatttttatatgtatttcctgttatactaaaagaagtaaatttagtgaaaatggtgatctctaagtaccattctctcttaccattactaagaaagcaaacttttcttaagatttatctgtaaatagaattcatctttttgacgactgtaagcagaaaaatgggatctcattttaaactaaaatttttattttagtatatttgtaccattcatatactcgttagtcattcatatttcttatgttaattccctgtatatatttttaacatttttttcctactagggggtttcttatcttttcctattgcattaagagct

SEQ ID NO: 80827 - DNA, 1055 bp, Homo sapiens
tgccatcaaattttgaaagttttatgaagtcactttcttgttcctgttgcctagttgtcctggttgttaggagcatgttgacttttgagattaacacctcttatacagaaattaatttcctgaaaaggaagatttattgattcaaaatcattgatttctttagtttttgtttctttttataactggcacatcgtaagtgcttagtgctatatttttatttctaaaaatccaatctgctgtaacatttccccataattttgactccgaattacaaagtattaagatagattatattgtagttcctggctatgtgataatagttactcatttgtatcttttaatgtgtcagtgaagtattaattattgacttaagaagttgagtagaaagatgagagcataacctttggcacttcaaattaccccctagtttgaagtcaggttatgagccaataaatgtttgtatggcactttgtagccataagtgctattgaaaggtaaaataattggagtggctcagaaagctgttttccctgaggccctgagaaaaatctcactaagatatgcttggcttcaaaagatgactcaactatgaattattaaagtaatctttgtttaaaaaaaaaaaaagttgtccgagtgtggtggctcacacctgtaatcccagcactttgggaggctgaggcgggtggatcagtcacctgagatcgggagtttgagaccagcctgactaacatggagaaaccccatctctactaaaaatacaaaattagccgggtgtggtggtgcatacctgtaatcccagctactcagggggctgaggtaggagaatcgcttgaacccggtagggcggaggttgtagtgagccgagatcatgtcattgcactccagcctgggcaacaagagcgaaactccgtctcaaaaaaaaaaggttgacaattaaacaactgtaattatctggactaattatctggtccctggaggacacgtataatttaagttatattgatattctagtcaacacccagtcaccagctggcaggtaaaagaagcagctt

SEQ ID NO: 80828 - DNA, 1116 bp, Homo sapiens
cttttggtatgagatgaatgaaagatttttgccaaaagctctttttaaactgtaaaatgatgttgagatgttgttcgtcaatgctgcatagaaataatcagcacccatctcctagtttaattggcacaagagccaggtggggaggaaagtacatgcttgtcgttgaagctactactttcctcttttcttgcagcggataacccaacaaagtgtgtttttattatcacttgagtacagttttggacattggtgtaatgtggctttcttacactcagtaaaatacaactcacttttgtagctttccggtgtgttattttaaagcagaactttgttgaaaaagaaaataattctgagaaacctagtaaatagttcttccaaggattttaagaatatatttgtgtatatatatgcctaagaacgatgacttagaaagaaacaaggcaagtcttttttgtaatacatacgtttaatgccagctcttcttccttttagacctgaaacagtgttaaaaaatcaagaagtagaattcggcagaaatcgagagaggcttcagttttttaaggtataaatgattcagggaaatttttgtattgtaatatataaactaatgataggtacaatttttatatctttgtttctttttcttttcctttttttttttttttttttttttaagacagaatctcgccctgttacccaggctggagtccagtggcgtgatctcagcttactgcagcctccacctcctgggttcaagcagttctcctgcctcagcctcccgagtagctgggattacaggcgcacaccagcacgcctggctaatttttgtatttttagtagagataggttttcaccatgttggccaggctggtcttgaacccctggcctcaggcaatctgcctgcctcggccccccccaaagtgctgggactacaggcatgagccaccgtgcctgccgtatttattattttatttatttatttatttatttttgaggaagagtcttgctattgcccagacaggagtacagtggtgtgatcttggctcactgcaacctctgcctcttgggttcaagcgattcttgtgcctcagcctcctgagtagctgggattacaga

SEQ ID NO: 80829 - DNA, 1333 bp, Homo sapiens
gcctcaagccatctgcctgccttggcctcccaaagtgctgcgatcacagacatgagccactctgcccagccactttagtagtttctaaaggttttatagtagtagaacgcttttgttcctcaaatgaaatcttaattggaaaccctattgtgtagagaaagatgaaaacagtggctctagtttaggagagagagcttggagggagggccttgtacattgagcctttcttccttctcattcctgagaatctttggaacgcagttgaatactgccatttgtctggactttttgaacatttttatttgacctaaattaattttgtcttaataaaaaatacatttaggttcagtatctgtatatttgtttttaactatgtgatatgaactttgtatttaccatattgaacattagttaaaatatttttaatgttaatattacaccttgattgtgagcacaaatttatatactaacatttgtatttcttaaatttaaacaaaatatagtggagttcaagagtttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggtaagtaaatgactaaatatatttcatttcttttggggtaaggatgtcaagaacattgtaaaagaacataaattattgagtttgtatagcctctttgaggctctgtgtttttcatctgtaataacagcagcaacaacaaaatcctaattgagagtttgtgatcagtgttgtaaaagaggatttatgagaagaaatttacacagtgtctagcacagcactactatttgtgaagtaattgaataattgaatgatgatgatgatacgtctacaaagtttgcttctttgtgtaaggtacttttgtggcttctcctggtcttctttataagtccagatttcttgccattttatacaaggcatgtccctttagccactcacccacacccatcttagagagactagtcatttctttacttacgtgggctgtctcttttcttttttttttctttttcttttttttttggagacagcatcttgctctgtcacccaggttggagtgcagtggcacaatcttggctcactgcagcctccacctcctgggttcaagcaattcttgtgcctcaacctcccaagtagctgggactacaggcacgtgccaccacgcccagctaatttttgtatttttagtagagatacggttttgctatgc

SEQ ID NO: 80830 - DNA, 1977 bp, Homo sapiens
cagctagctatgctcttttatatgccatgactttgcataggctatttcttctggaagaatgctttctgccgaccgtgactttgttgaaatgtggctactattaactcatccaagactggcctcagttatcttctgaaagtcttaactcccttgctgagttcagtgtacctcactttgtaagcttactctttcacagggtgttataaatgttgatttttttgtgctttttcattagactgaacttgttgaggttggcagggactggattctgtttatatctgtatcttgaatacagtgcagtgcctaacataatgaatacttaaactaatgttttaacttgaatatacttaaaactaatattttaccttgaatataaaggtaaaataatagtttttcgaccgtgcgagtggaatcatttcttttgggaagccttgggttcagtgtccacattaatagcaatatagcaactctgcaaagtactgtgtaagataagctcatgaaacacctagagattcagatgttacagagataaatgatctttaaatatactgtgctaatatacctgtctttattacgttaggggttggaggcattgaaacagaagcagttatgcttggtctgccagtttctcttactttaccagaggtggttggatgtgagttaactgggtcatcaaacccttttgttacatccatagatgttgttcttggtattacaaaggtaagttaaagttgtggtagctctatgacttactgaacattatttttataaaaattgaagagctctatgagagcagggatttgggttcattactgcatcctcaggtctcttgacgttagccacatcatcatagttatcatagtaataacaacaaacagagcatttagtttgtactaataaatacaaagaaatttgttgtgttcacttatgttagctcatttagtccttataacaagcctgtgagatggatactattactattctcattgtaactctgagaaaactaaggtacagtagggtttagtgacttaccaaagggtcgaaggcctgagtagtaaggggtagagcaaagattccaggcagtcagattcttgagtccattgtcttaaccattatgccttattagtgccttgttgccttaataaacacttgctgactacattattttttttctcttttttacttgaatttaaaaaaaatgtttagcaaaagttgattgtgtcgtctttaattaaattatttgcccattagaaactgttgctctactaagtaatgctttcaaaaacatggactgtagaaatgtgatatatcatttttctgttgccgttttaacatttctctggattattatgtaaaaatcttctctctgaatttttaaaatactggcttcagaacttcaatacatacactgagcttgttaagcatattaatacacaggctcacggatttcctagtgaacaataatttgtaactcttcttcctaaatgtctggcctttgctaactttattttaatgattaaatcctattttgttaaatgaatgtacctggaaaatgttccacatataattccaatttgagtcccaatctcagcatttttggttagattattggtacgaaggctttccggatactccagtgtaaggaaatgataatgcctccctctcagcatttggtattgatccttcttccctaattagaaaagaatttggcatcttagagaaattattgattcaacgtatgataccaaaagatcaagtagtaaattgggaattgcaggattattcctagaggaaaaggagtatcccattatgtttttacagaaatcaattctttactttagacatcctgaaaactaacgctgctttttagccttctctagctgttttttcctgacaatattactgtgtgttttttgacattttagtttaatgttaaaaaattaatctattatatatgtttacatttattgaatatat

SEQ ID NO: 80831 - DNA, 1039 bp, Homo sapiens
cagcctgggcaacagagtgagaccctgtttctaaaagaaagaaagaaaaagggctgccacctaaacagacacactattgagttgaggtaccctgatttcaaagacatgaaaatgttaattatagccaccttgagctttcaggcccctttctaccctgattaacagtgacattggaccagtcttctctttacttcttatcttaaaatacccccaaaaccagaatgagttgattcataaggacaatgaaggatctcattccttcaccatcactagtattggttaaaaattttattttatagttttcagacaatcgttgctaatcttatctttgcaattttgtatgtgtttctgtgtattccttatatagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggtaagaagataaaagatcactagaataaacatgttacatttccaatgtgtttgataatattttataaattactaccttatccatgttatttactattcacaaaattacattatgttgaaacaacaactttcaagcaaacatcagatgtctttaaagagtgttgtgtcctcaaaccctagttccctgtgacacattgaaagcaatttaaaggaattattcaaaccattgatcctgacttgactgtttccccataatgatggatacctccacctctacttaggggtcataggttgcaatttaatggaagtcagccttaaacatattcacagcagtccccttctacaaccaagagtagaggagctatcagacaaaggggtttggggaccagtcttctatctagagaagaagaagaagcgcaaaattttgcaaaaaacaacataggaccacagtttctaaatctttttgtaacctgattaactagaaattttggccactcttcc

SEQ ID NO: 80832 - DNA, 2291 bp, Homo sapiens
aaattgatgaatggttatatagaatcctggagggaatgatccccccaagtgcaaaacttctgcatttgagttagtagaacattcaaagtagaaatggttagaagtgcctcgttccttgcatattaatcttgagttaaggttttagtgatcctgtgtaacaaattatcctaaaatttagtggcttgcacaagcagtaattactagctcatggtttcagtggggtcggtaattcagacagggcacagtggggacagctcatctctgtttcatgtcttgagcctcaactgcaagatttgaaaggaagggcctgcaatcctgaaggcttgttgtgcttgcatgtctaacagcaaattatgagctgtcagctgaggacttaggtaagtctatcaggcaaaacaccctcatgtggtttctccgtgtagtctgggcttgctcacgtggtagattctcaagggttaggagaaagagaaatgtaaatgaatatgtaaatagtatttgtttcttgttcatcactggaattcagtatccttacccccaaagatttcaaaattccttactgaggccaggctcagtggcttacagctatgatcctagcacttcgggaggctgaggcgggaggatcacatgagtccaggagtttaagactagcttgggcaacatagcaagacccccatctgtacaagaaaattaaaaattagccaggtgtggcagtacagacttatagtcctagcaacttgagaggctaaggcgggagaatcacttgaacccaggagttcaaaactgcagtgggctatgatggcaccactgtactccagcctaggtgacacagtgagaccctgtttctaaaaataataaatttattggcggggtgtggtggctcatacccataattccagccctttgggaggccaaggcaggaggatctcttgaggctgagagttcgaaaccaacctattcaaaaaaaacaagaccctcccgccaccccatctgtacaaaacatttgtaaaaaaaaaaaaaaaaaattaaccaggcacggtggggtgctacttgggaggctgacatgggaggattgcttgagctcgggaggtcaaggttgcagtgagctgtgattgcagcactgcgctccagcctgggcaacaaagtgaaaccctgtctgaaaaaaataataactaaataaatttctcactgcattttgttgttttgttcatcttcgttttaggttttagcaaagccaaactcgaatcaatggaaacataccttaaagctgtgaaattgtttcgaaatgaccagaattcttcaggagaacctgaatactcccaggtatatgcagaataacccacctcgtagcaaagagtgtaaattgtggtgtaatcccagcgctttgaaaggttggggtgggttgattgtttgagttcaagagtttgagaccagcctgggcaatatggtaaaaccctgtcactgcaaaaaaactacaaacattagctgggcatggcttgcgcctgtggtcccaagtacctgggaggctgaggtgggaggatcacttgagcctgtggggcgaaagaaagttgcagtgagctgagattgtgccactgcactctagactaggtaacagagtgagacttgtgtcaaaaaggaaaaaaataataataataaattctagagtacctgaccacctgggtttgaatcccagctctaagacgtgttagctgtataaccttgggcaatttatttagcctttctgcctcagttttctcatctgttagatatgacaatatctacctctaaggattcttagatattaaaaacaaattcatagaatagttccaggcacatagtaaatgctcaataaggggtagctaatctttttgttttgctttttgagacccagtccggctctttcaccagactagagtgcagtggcacaatcatggttcactgtagcctcaacctctgtgctcaagctcccaccttgctgggattacagacatgagccaccaccatgcttaacccctgttttgttttaatattactatttttttaatattattattttttggaccctgggcagggtctcattttattttactgcccaggctggtctcatacttctggtttcaggggattctctagtcttggcctcccagagtgctgggattacaggcatgagccactggacctggctgagggggtagctatcattattattattatttaagtaatgttattgtagcccagtgcttttgttttattcattaattttacatagagttttattatagtgaattttgtaa

SEQ ID NO: 80833 - DNA, 1336 bp, Homo sapiens
aaaaacaaaaaacaaacctgaccatgtaaagaaataaaactaaaatcattaggatgttgatttcaagagaaacttcttaaatggatatttatgggcaaagactaggatcgcctgaatccattaaatgaaagtataagtaagccaggtgtggttattcttgcgtgtaatcccagcactttgggaggctgaggcgggaggattgcttgagctcaggaccagcctgggcaacatagtgagacctcacctctgctaaaattcacttagccaggcgtggtggcgcatgcctgtagtcccagctacttgtggggctaaggcgggaggatcacttgagcccaggaggttgaggctgcatttagtcctgactgtgccactgcgctccagcctgggcaacagagtgagaccctttcacaataaaaataataataataataaataaatacagtgtaagtagttggatcagtcagaataaacagggatataaaataatgttgaaagccatgatgaaaagtttcaagatggttatattcacataaaatgcatgaaggaaacgatagaaatgccagaagaaataaataggaatctagttggaagtgggatttttaacaaaaaatacgtttcttaaccaaggaatagaaccctgagttgcagcaggctggccagtgaaaccctctggaacaggaaaaagaacgctttctctgctgtgtcccttcagcaccctctagtgaccagtcttcacattcttcacatcatgtgtgctgacaaaggagaaatgtttactaaccgtttacctctgtgatcacagagcgggcaggagggtagatttggagctcagaggcaataagttgatagctggcataggcatctattttatcattggacatctgttaagacagtgtttatctttgtgggaaaaaacacttgggaaaccaggttttttttttttttgagacggagtctcgctgtgttacccaggctggagtgcagtggcgcgatcttggctcactgcaagctccgcctcctgggttcacgccattcccctgcctcagcctcccgagtagctgggactacaggcgcccaccaccacgcccggctaattttttagtagagacgaggtttcactgtgttagccatgatggtcttgatctcctgacctcgtgacctgcccacctcggcctcccagagtgctgggattacaggtgtgagccaccgcgcccggccccagattttgtatatgcagtacaattggtgttgtggtagtttaattgcatactgatctactagtcttgattttagcaaattttcatgtttcgtacatttaaatgtgcttgttttaaaa

SEQ ID NO: 80834 - DNA, 1378 bp, Homo sapiens
attcctgggtaatttttgtatttttagtagagacagggtttcaccatgttggccagactggtcttcaactcctgacctcaagtgatctgcccacctcagcctcccaacagtgctgggattatagccatgagccaccgcacctggcctacagtcataaaatttggtaaatgtgaccgagtagcaagtggtctctggcttttgagggtttgtattttctgtctgagaatcacagttttagtcttgtcactttctctattctgagatctctagtacttggctttcctttcagagcctttctttttatgatttcttgactttttgttcagaaagtgttaaacttgtacaaaaacaaaatagtccactgaattgccatgtacctgtcaattagcttcaataattagcaactcatagccaatcttgtttcagctatgctacactcacacacataggatccctttggaggaaatcttcggggtcattttaacagaaaaaaatttctgccatctcttgagaattactataaacagggatgattaagaacaacaaagccaaatgagatctggattctgggtggtaggctggactcgcttagtagataaaagttttgcttgtgaacatcaccagactcctgtcgtgcccatgcagatttatgcttcagctgaattacaactactgaatgttatgggcctttagcatcactcacaaaaaggatttttaatgttaaatcatcaaatgtccggtatctgctatgttttctgccagtcttttattctgtacatacccagaatatttagtttatatttttgtggaaatttgtataggttggatttaaaggcttccaaattgcagctgaaaaacaaaaggatattgtctccattcattatgaaggaagtgaatataagctgtctcatggatcagtggtcattgctgcagttatcagttgtaccaataattgcaatccatctgtcatgcttgctgcaggtgggttgtggtttatggccatactttttctttttccttaattattgttggcttttctgttattgtaactttgtttcttagatgatgcatgagtgtctacatttgatattgagagactttctagtattttagttaggtcttaaggagcctgagtttgatttatgttgtttttattacaccgaaggtaaatttactgtttactataacttacctgtcaattaattttaggttgtatctgcttctcttgttaatttagaactatagttaattagcaggtatttcttgattatctagaagttaaccataacagtgtggtagatttcattaaaagttataaaagtagtaaaagatcattgtcttggcaaggattgtaaatgaaattaatttgtatgcccat

SEQ ID NO: 80835 - DNA, 1131 bp, Homo sapiens
agaataaagtggacaaaataatgacagtaagtttatgaattcatactttaatctgttaaataaattacttctcactttttactttaatatgggtgagagagggaaagaaacattgccataataaatcattgtttgttggctgtgcaggtcttttggctaaaaaggctgttgaagctggtctgcgtgttaaaccttatataagaacaagtttatctccaggcagtgggatggttacacattacctcagttcaagtggagtattaccatatctaagtaagcttgggtaagtaacagctatcgcacttcatattgatattggtgttcagtaggtactgaagctgcttgtttgtgcctttcatatacaaagagaagatagaaaaaatatgctttagttttacttgctaccttgccattaccatacaatttttgatgccttatcactcaggaaacacttattgggcatatcaaatgagcaaagcaccaggttggatacacagaagtaggagatgtggtcttagcttcaagatacttagttgggaagacaagacaaacaagtacaaccaaataacagttacagtgtaagaaacgataccaagtatgcacaatttctgtgagttgtgtaggtcagttcaaaaaagaaagaaatcttatagtttgcatttattaactgaaaattgtcttaattttagttttatgaggttattgggtctataatacataagtttaaattgtccctgaactttggagaaagtaacttatgttttttgggctgggcgcggtggctcacgcctgtaatcccagcacttggggaggccgaggcaggcaaatcatgaggccaggagtttgagaccagcctggccaatatggtgaaaccccgtctccacaaaaaataccaaaattagccaggcgtggtgacgcacacccatagtcccagctactcaggaggctgaggcagaagaattgctttaacctgggaagcggaggttgcagtgaacccagatcgtgccgctgcactccagcctgggcgacagagcgagactccatctcaaaaagaaaaaaaaaaaagtaacctatgttttttatgtaatccaaaacaattgatgctagttgtgtggggattttttggttttg

SEQ ID NO: 80836 - DNA, 1036 bp, Homo sapiens
tgtgttcgtgccaattatcttgcctctccacccttagtggtagcttatgccatagcaggcacagtgaatatagatttccagacagaacctttaggtatcttttcctttatgtatatgtatacctacacatacttttcccaatggaagtcgttatatttttgaaatgtttcttagaccatctattctttgaattatttcaggaagacgtatgataatgtatagttattaatttctgtgtttatgtgaagaaaataaaatgtacaggtaattagttcttccagccgcttaagcctgaagcaccctgttgaatcatttacttgatttccatgatatgtctttgaaaaggtatgaacattttcagagttatttttttactgagtatcatgttcaaaaattttaaccaggtactgaccccaccggcaagaacatttacctgcatgatatttggcctagtcgagaagaagttcatcgagtagaggaagaacatgttatactatccatgtttaaagcattaaaagataaaatagaagtaagagtcttatgtgtttcttaaatagtttaatcaatttgcagtgttcttttatttcatatatcttctgaatagaataaaaattaaaattacattattttgaatacagtttttaatgtgtaatagtaagtttgtatctggaatctgtagttaaaaagaaaatggcggctgggcacagtggctcacgcctgtaatcccgacactttgggaggctgaagcaggttgatcacgtgaggtccggagctcaagaccagcctgaccaacatggagaaaccgcatctctactaaaaatacaaaacaattagccaggcttggtggcgcatgcctgtaatcccagctactcaggaggctgaggcaggagaatcacttgaacctgggaggcggaggttgcggtgatccgagatcgcgccactgcactccagcctgggcaacaagagtgcaactctgtctcaaaaaaaaaaaaaaaagaaagaaaatgtcttagaggatcagaattcattagtgttg

SEQ ID NO: 80837 - DNA, 4689 bp, Homo sapiens
agaaagggatccgaataatttagagagctccataaaaattcagaaaaataatctgtaagaaggttctgtaaatactttgataaaatattgattcagtatgagatattagactaaaagtatttagagaaaggccaaagtagatttttgccccctttaaatgctcaataaataactttcagaagtgattagagggaataaaatgcacatttattacagggtgtgaaagctgttttggccgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacaggtatctctaaatttttcaaatatatgattatgcactcaaatgtttatgaattattgaataagaatcaattgctgtaaattatatactaatgtcacttaatgaatgttaagttgccatttaagatgactctctcttccatacttagatctagctatgttaatagttcatgttctctgaggaaaagtggaaagaactgggtgcttataccagaaaaaaagaacacatgaaggggaatcttgacttccacttaacaagtgtcagctttcttttcatggtggtcatttttttgctgtcctgatctaattttaaccgaggcatacataccactccaaagagagcaaagttgagcgttcaaagttagagcaaaacagactttacaactaagaaaaaaggggaaagagtaggagttactgattacatgcaatcaatatttggtgtaaaatgaatgtgagtagtgagtataacttccccaattaataagtcaaaatctaaatgcagctatttttctacttaactatgaagcccatggtcaggtatctcaggtgtttttcaagcagcagcaaagtttcaggcaatcagaatataagaaattagaaccaagataaatcagacagaatctgtggcaagtatagtcattaaatatgaagacaaatggtcttaaccatcaagtagcacctggaagatttacttgctcacatgagatgtttttgctcctttcaagacaagcactggaaaagtattcagcgtgattgcttcgtttgaagatgatgtggaaataacattatacaaacatggaggattattaaactttgtggcacgaaaattctcatagtatctacttaccatagatacctttcataactggtaactgcaaagccttttgtgctggacccaggaatccttaccatggagcagcagatagtcccagtatactcacttatctcatccatggatgtaaatgatgatgaatcaacatagtaactgaaatgaaatcttcttgattttaaataatatacgaatggtgctattaatattgctaaaatcaacgtgtgaagtgtgttgtggaagagacctgtaagtatggggggggggcgatattttatcagaccattttgtaaataaaggcagaatttgtgttgaagattcttatatgaataaccttcctggatttgtttagttttgcaccaataaaactgtgtactactgtttgttggtttaagagtagcagattgaaatataagaagccagattagactctaaaattgtggccattggaatctcatttataaatggaccttttaagtatattaattcctcttcagaattgagctggacacatttggcattcttagtttgtcatataaccaggtttatccttagtctaactgcaagggatggaacctgccccaggtcacaatcattctgtccaatccagccaaggttccctccacatatgaagatggaccatggcaggatacaactgattgtgtggcaccatgtattagcagtgggaatatgtatcacatatgatgcagcctttcatatttcagcagtttgccactgtgactgtctggcaagcccccagatggcgttatattaattggattagattattttgctcaccttatgtaatactgtaacttcctataacctaatattttcggtatcattaaccaaaatttcacactcatagttgctaaagagaatgttattcaatcattaaactctgaactgatttcttctatacatttaaattatccaccctcaataatacgggtgctcaaccctatgcattttttaagtgttgctatttcttaattaaattgatttcctgtcattttgaatcatttatcacctgcgatgcatgattctattaattttgttatgttactgttttaaccaaagctgaccgtaaggataaaacacttaagttgttgctgagtactatatatcctcaatatgcatgtctgcccatcacatcaaatgttctgtcaacaagatgtttggtaattttttttaaaaaggttggaaaattaattatagaaggttctatactgtttttttaattaagaaactaagtctagcaggctaaaggttaattgtagtgattttttttcacatagatatctttctatgacctagttagttactgcaattcagaattagttcacattgcataaagaattacttgttgtaagcaaaatgctgaaactaccaaaccagtggatgaagaccactaagaactttgcacataatcatacaatcttttgaaaatattttgcaaatatgtgtttagacaataagatggactagagttcgacaaaatgatttctttatttaaattttgtataagtattttcttcgacactttcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgttggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaaaaaaggaagtgtaatgtcagacacacaagaaaagcaaatcagtgttgtaagcttaaagtacaatttcaaaggtcactaccaacagcagggttttttttatactttgaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtactagtatccctctagccagattgcttagtttttcgttggtaatcaaacaacagttgtactaaaggaaagtaaagctaggacctaaatcagaatcatagttgcctgcatatatggtaacaaggtcgtgtgcatttgctttcacagtgatgagtgagaggatgagaagaaattatttgacatttttctgtggttgaatagaagacacctttcttttgtctttaggtttaggaggagatactaagatactggatgtttatcctatcttagtttggttggagtaataagagagaagaagagggtggactttggcttttcagtgttttttcccctaaagagtgatattgctgacgtttctatcaattttacacataatatgtggctatgaaaccatatatctcacttaagtaacaaagtaatcactttgtctatcactaagtaatagacaaaaatcattgtctattatttaaagccaacaaaacagtgtaacagttttaagttcaataatgttaagtattgtatagaaatatattggaggcaaagttcagttgatgacaattgtgtatatgttactgatgctgtaaattatttttaataaagaaaattgtattatcacatttgattcttgttctgttttgtagtagttgaaaataaaacaacatgatgtaaaaaatatgctgccatccggctgggcacggtggctcacgcctgtaatcccagcactttgggaggccgaggcaggcggatcacgaggtcaggaga

SEQ ID NO: 80838 - DNA, 1033 bp, Homo sapiens
ggactaaaatatgtcctatttctcccagcacagccttttattacatcagtctatttggatggccagagctaacaaccttgctttacatggctatggaaaacagcgctctcctaagaggagcttaacaagtcaaagattgtatgggaacatctggaatagaaaggagattggccttcaccagttgcctctaaggttccttacaactttaagaacttatcattcatttcaaattcagaattgttctgacatcgttaacgctttgggagttgaaaatgactccaggatttcatcttggagttaatgcttcagtccatattgcattttgaatacttaccttataccagtttacatatctccagaaagaatgttaaaattccttgtaaagttttaagcctaaatacagtgtgacaggatatgttggttcccagaagtttcaagtgcaaagattgttttgaaactccatttaggctttgtcacagtaccttcagtgaacaaaatctgaacggcttaacttgcttctgaaagcaaatgcctggttagaaagtaaacaggaaacatgattgtcaagaaggcattaacttgcagtaacaggtgatggaaaccgatcagtggcacaagctatgcaagttaagaggctggagcaatcactttgggtaggaggatcagggaaggccatggcaggggctagggggtggttagcgtttgagggttacctctcccttattttctcttctctttttttttctttctttcttttctttctttctctctctctctttcttctttcttttctttctttctttctttcttctttctcttgctctctcttctctcttttctttcttttctttacttttctttctttttgatggaattttggtctttcgcccaggttggagtgaagtgacgcagtctcatctcactgcaacctccacccctctgggttccagtgattctcctgccgcagcctcctgagtagctggaattataggcgccggccaccatgcccggctaattttttttttatttttat

SEQ ID NO: 80839 - DNA, 1029 bp, Homo sapiens
ctgtgccatccttactttgcaccattcctattgcaattacctcaaccagttcgctgccctcggtctctcaccagccagagtgatcatttaaaatgccaatcagttcctgtgggccttgggaatcattcagaggagccccattggctgagagataaaattctgtttttacctgggcacgcgggctctccaggatttgattccagcttacctttccagtcttgattccctatattccagtatttggaaatgtgggccttggactgaggctttaccaaataacgctgaacacctagtattgccttttgcacgaatggtactgatggtgcccaagataactgcctccacccccaagttcaggacccagatcactctctggagaaggcctcagcctcttgccttggctttcaaggctctgcgtgatttggatactcgcttagctcttatttatatatattttaaaagcatcagcagtttatctcatgcccactaaactatcctgcctccgtaccctttgttcatactttctgctctgtgtggaatgcccttctttcttcccctgttctttctcttagacccaagggttctcagccttatttctgcctctcccatctctgatttactttcattttctgtatcgatttctcaaaaaatactttcttgattctttcatcatcccttttcccaccctacccccggttcctctttccacattataatctatgactgcctctctcacctaactgccagtattagcttttcaggacaggaactggttttacacattttggtattccagcatctagcataatgcctgacacttagctgaataaagggagtaaataaaacagatttgtaaagtcagcaaatgctttttaatttgtgaatcttattttaatgatgatctgattttctttttacaggaactatataaagttcagaaaacatggtgagttaatacacatgccaataaacggttgcctgataaacagtattgcttgtactcagtttacagacttgagtgggaaaatt

SEQ ID NO: 80840 - DNA, 2630 bp, Homo sapiens
ggtaggaatcactcatgtgtttttcctttgcagtctcgaagatatgactccaggaccactatattttctccagaaggtaaaatagaaattgtttaatctgcctcaagtttaaaaataaatgtgttagacttttagaaaaaaaaattacaaactttttttggtagttgcaaagttcatcctttttgtactttgaagcaattatcatcaccaggttgattataccatagaagagtgaaagtggaaatttgtttctagcttgcttcattgctgatttcttttgggccagtggtgcaggagcacagaggagagtcttggcttctcactgcttttgttttgtaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgagtaagtgagattttaggaaagagtttaaaaaaaatctcactttctcacataagtgggatctatgtaatttgggagggctcttccgtgcgatgtggtagaattgaaattgtgcctttattttgcttgaaacctctttgaggcctggtaccatgtgttactccttttaagtgcagggcaaacacttagtggagaaactagcattgtgtaatgataagagtacagacttagtagtcacacagatttgggttcaactccaggcttcacccatgcaggctatgtgaccttgcaccgattatttaatttctttgggcctcagagcctcctaaagtggttgtggcagtttaatgaaataaaatgaatgaaataaaatagtatagtatctggcatttagtaggccctcaaagtattgtttagaatagctacgcaggattttgttgaattacactgaatcttactaaagaacaagcctcttagaggtctcgaagaatttagccaagccttgtacactgtgtgaaatgtttgttatatttgagtgtgcagaactttgcagctcatggagagctgaccgtgctaagtagagactttcctttcagtggtggtgggcttggtaaatgctgattatcagggccttttgataaacttgtccaaagtggtgtcacccctccacagagcctctgttgggaccactcaacagctggcaggcttggctaggcgtagtcacagggcgagtctcagctataagagagccagggcagccctcaggaagtgggcccaaaaaaatgaaatgcacctctagtaggagcctagccctgtacttcctaagcaggcttgtaaaccctcctgccattgtcccctgtcacctctgtcaagccaggccttaggaaatgaatattactcaagagcagtctgtctagcaaaatcttttttttttttttttttttgagacagattcttgctctgtcacccaggctggagtacggtgacgccatcttggctcactgcagcttctgcctcctgggctcaagtgatcctcccacctcagccgcccaagtagctgggactataggtgcgcaccaccacacccagttagtttttgtatattttgttgagatgggattttgccgtattgcccaggctgttcttgatctcctgggctcaagccctccatctacctcggcctcccaaagtgctgggattacaggcgtgagccattgtggcaagcctgtctttttattctttgttgctgaatcttcttgagattacattagcttcttggcgttaattttgttatcctattcataggtggtaatgataaatacatctattaaataacttaaagggtgcatttgtttatctttcatgttgagtgacatcgagtaaacatctcctacaaagataaaacttgtaggttttttctgaaggaagtagctgttgtgaagcaaacatagtgaatttctaatagaaattagaattttttaaatacttataaacactccttgcaagcatcttccctgcttacagatcaatgtctttttttcttcaagggacatggcttgcagtgtggcaggcataacttctgatgctaatgttctgactaatgaactaaggctcattgctcaaaggtatggtcataaatagcataactgatgatacagaaattagttttgatgtttcttttttttttttttgagacagagtctcactctgtcacccaggctggagtgcagtggcacgatcttggctcactgcaacctccgcctcccgggttcaagcgattctcctgcctcagcctcccaagtagctgaccaccacaccgggttaatttttgtatttttagtagagacggggtttcactgtgttagccaggatggtctcgatttcctgacctcgtgatccgcctgccttggcctcccaaagtgctgggattacaggcattagccactgcacctggcctagttttgatgtttctaaggagagctcacttttgcaaagattaaagtcattaaaaatctttgaattgaaaattacagatttttttcaaccaaacttacaaaatattatttactatgagaatattcagatgttgacttgttccctccccttcaaattacaaatgactgttaggttg

SEQ ID NO: 80841 - DNA, 1932 bp, Homo sapiens
ctaatatgttatggttaactatattaatcctacagtagtatagaacactagaatttcatacattcttgcttcatgaatgaacgtgttcctccaccatgtagattaccctcgttttattaataggatattgaaagtccaaaacaacattttcaaatctggaaactaactgctgtttacataataatgaaattcagcactggtcctttgtctgttccctcttctggctgtgtccaaatcgtagaaacaaaagtcgaatttgtaatggagcttatctatggtagccagaatacaaaacagtttatgaatgcttaagttcacagagtagggtttagctaccttcactgagctcaagtaactgtagtgatactaaatttagattattgatatgtttggctttttttctttgttaaaggaaaacgtccctttggtgtttcattgctgtacattggctgggataagcactatggctttcagctctatcagagtgaccctagtggaaattacgggggatggaaggccacatgcattggaaataatagcgctgtgagtatttttgttgtgctataaaatctagcagaatgtctaataactgccataattttgccatggtgatgaatgtaaacagtattttaagatagctgcaacaaccttaatgtgatatggaaatatctgtgatttctgttggtgacagcattgctgatatagctaatatactggggttcgttaactacattaataaatgctaattttcagttaggagttgtgaaattagaagctgtgattttgtttcacatctagtttacagaccccctgtattctatgacagaccccttgggagactgaggaccccaggttaaagacactctttatagagcattagtaccccctcttctcaccccgtgccgtgtgtgccctccctgtcatcaaaattatgtatatgggccaggcatggtggctcatgcctgtaatcccaacactttgggaggccgaggcaggcaaattgctcgagctcaggagttcgagaccagcctgggcaacatagcagaaccccatctctacaaaaaatacaaaaatttgctgggcgccatggcatgtgcctgtaatcctagctacccaggaggccaaggtgggaggaggagcacctgagcctggggagacttgaagatacagtgagctgagatcatgccactacactccagcctgggcaacagagtgagcccctgtgtcaaaaaaaaaaaaaaaattgtttatacttgtaatgccaataataattcaggcatttttcttctagaccaattcatgtttctaaaaaatgtaaaaacttaaaattctatgttgattcatgttttataggcagctgtgtcaatgttgaaacaagactataaagaaggagaaatgaccttgaagtcagcacttgctttagctatcaaagtactaaataagaccatggatgttagtaaactctctgctgaaaaaggtaattcatatcctctcctttaattctttcgactgagtgagggaaattagcagctgttaagatttttttcttttttttttttttttgagatggagtctcgctctgttgccaggctggagtgcagtggcgcaatctcagctcactgcaacctccgcctccttggttcaagtgattctcctgcctcagcctgccgagtagctgggactacaggctcgcgccaccatgcccagctaatttttgtatttttagtagagacggggtttcaccatgttggccaggctagtcatgacctcctgacctcaggtgatcctcccgcttcagcctctcaaagtgctgggattacaggcgtgagccattgcgcccagccagcaactgttaagattttaacatgtcatcctagttcattgaaacagcaaccttacgaattaggtgatgttatccctgtcttctaactg

SEQ ID NO: 80842 - DNA, 1477 bp, Homo sapiens
gggcatattggctcacgcctgtaatccccagcactttgggaggccgaggtgggtggatcacctgaggtcaggagttcaagaccaggttggccaacatggtgaaacccctgcctctactaaaaatacaaaaaattagccgggcgtggtggtgcgcacctgtaatcctgctactcaggaggctgaaacaggagaatcacctgaacccaggaggtggaggttgcagtgagccgagtttgcgccattgcactccagcctgggcaacaagagcaaaactccatctcaaaaaaaaaaagaaaaagaaaatgtcatttacatgcagattgccctcttttgtctacttccacccagtttcaaggaagcactactcagtttccctggtacaaaaaaattccttcccctttaggtatcagtctgcttttcttggccatttcatgccttttatttatttatttttttaagagacttgaaaagtccataaaaaataagctgttattaccagttgaagattctggctgagccctcagaggttccaacagttccgtctaatcagcacagctaatagcaggccggcaatagcaattggttgattatactttttctaagggagtgacaaaatggctgaggagacgatatttaagtaaaaattataattaaaacattacaagatcaaaagtatattgttctcataaaagggaataatgttaagtataaaacataggagagtgctgaactaacgtttcaatgatgtggcgagcataaaccatgagtgcctattaagcttctctgctaagtatgcctgcctgcctgcaatacaaataaatgtatgtgtttgtttttagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaataaattctctgtagcagtaattgttaaatatacaaaaactgacagggcgattactttttgcacattgtggcttacagtcctttcacaaagatgggcacgttcctcaggctggccagattattcgtctctgtctgcaggaattggtttgagaatgaacacgtgagctgaacaaagccagaattgatgtgtgggtgtggatctcgcagctaggactgaggctgcccaca

SEQ ID NO: 80843 - DNA, 1060 bp, Homo sapiens
aacctctgttaatacttttgtacactctcactacagtttatatttttataggctattttctcaaggtgtttctagattccacatatctattttatataacaagttcttatgttatgtgtgtgactcccttgtgtgtatctgtgccagcctcagcctccgagttgcttttccctctggccctgactctcactgactcaccgatgtgatgtgcaggcccacttcttaccccagatagcctcgggtgctgcctgtagtcatgctgacagctgtacagtagccgccaagactgctgacggctggagacggttctggtttcaacaactacggtatattgatatcggaagtattctagacagatcctcagttgggttttctagctacatgtttgtattgcacagatccccacctgccatcctatagtgttgtcttcctgtgtgttccggggcttctgggcagctgggcctgcccggggaagtccttgcaggtgggaggccatacagagacccagtgtgtgccactgagcgtcccaccgctgctgggcaactggaggactgcagggggcgccaggtgactctctccttttatatcacagcagctcctgtgctgaccttcaagttatgttttggaactgtaatactaaaggaagaaataaactactaatttgtataatattctgcattgaaattcagttatagtcactagtgatggggctcaccccaagggcttggagggtggggcagggcttattggtgttgcggggggcgaggaggggctctccaaccttccagcctggcgtttctgggtgtctctgcccttggctcaccctggggcgggtgcatcaggatgcctttgccagcaggggcagccttgggaggccccaagaaccatggccaagctgcaggtgtgggctgggggcaccgaggtgggaaagccggaagctggagactccctgtgtccggataaccccccgcccagccacaaagaacaggcatgcctccttccgccagctgtgccatgccctgcctgagtcacaggcttgtttgtctcccgtcttggctga

SEQ ID NO: 80844 - DNA, 1311 bp, Homo sapiens
gaggctgagtacagcccctgtggctggaggtggtcacggaggcctggcaggacagatgcactggggcagggggcggtggcgggagtcgggggcagaggccgctgcaggctggcaggaggccccgggaccgcagttctgtgccaggatctgtccgggaacaccagggatgagcaaggatggagatggggtggcaaggcgtcgccctgggcaggctctttaacaggcatgtgagggggtcagggtggggtctcaggacctttcctccagaaacctcagcccagcagcacccgttctcgagtcctggggttggccatgagtaggtgggacagagacagcaacagttggagacctgcaactccggttcgggagccgctccagaaactggggctctctgcttggtggggagctgctggagcctccttaaggtggttggcgtagggagccaggttctgggtaccccaagctactggttctgatgcctctctgcccccccactccaggctgtgagcgggaccgcctgtccttcgggttctgcgagacgctgcgcctactgggccgctgccagctgcccaccatccgcacccagtgctgccgctcgtgctctccgcccagccacggcgccccctcccgaggccatcagcgggttgcccgccgctgactgcgccaggatgcacagaccgaccgacagacctcagtgcccaccacgggctgtggcggagctcccgccccctgcgccctaatggtgctaaccccctctcactacccagcagcaggctggggacctcctccccctcaaaaaaggtatttttttattctaacagtttgtgtaacatttattatgattttacataaatgagcatctaccattccaaagcacagcgtgacttcgtcttggatttggagaatcttaaaagtgagaaactcttccccccacccctctgcccaaaactccaccgccacagcacctcggcaggcgtggcttttcacctgctcctctgggacagatctgcagggggcagcgtagaaaatgagtccctgagagcatggcatctggtgaggcacggaaggcctcagaagctggggggctgctccccagggagggctgtctgcagagggtggggttctgggggcaggaaggtcttccgggcaggggcacggcttggcccttacttgctgcctgccttcagctcaggctcccagccttccctggggccccactctgtggtcctcagagacctgttccacagggattgagcccaccatgtcacttgcagggactgccccctggagtggtggggactggggccccca

SEQ ID NO: 80845 - DNA, 1072 bp, Homo sapiens
cctgcccatgggctgcggcaggtcctctgccctgtccctcgggcacagcggtgtctcgcccacatctctgcccactgctgcatcagggctccatcccggcgcccctgcccaggcttctcaggcatgtcctgtgtgaggggctcactgccctgccgccccgagggctgtcccacggttctcacgccccttccctctgcaggagccgatcccacaagtgagagtggggttccagcaccaagtgggctctaggaatgggaccaggtgctccaggaggcactgagggggcggctgggagcaaggccaggccagtcaggcacagggcgcagggacggcttcccagaggaggtgtccctgcccccactgctagggctggccctggagacactcattcctcccccgctcccctcagtgctcaggcccctgtggtggtggtgtccagcggcgcctggtcaagtgtgtcaacacccagacagggctgcccgaggaagacagtgaccagtgtggccacgaggcctggcctgagagctcccggccgtgtggcaccgaggattgtgagcccgtcgagcctccccgtgagtcccctgaccccaggctccctgctgaagtgaggtggggtggggagggtgatggggaaatggggtcgtcaaaccattgtgcccacggcactggctggttccatctgtagtctgggctcaggagccacatggccactgaaaatcctgatgccacaggatgccatgctggaggctgggctgtgctgggagtcagtcaaggggagtcccggccacacaacatcccataggcagctgtctgaccttgggggagtagagggagtggccctggcccctgatttgctgtgtgaacctgggtaagctctttctcctctaggtctcagtcttcccacagtgagaccagggatgtccctgaggctgtgtgaaaactgggcctgggtgagtccctgtccccagccctggcctgtccattccctggctagaggactgcctagagtgagcaatggaaccacaggaagggcctcctttccagggtcctgctaatgaggtaatggggtttg

SEQ ID NO: 80846 - DNA, 1081 bp, Homo sapiens
gcaatttattcctatttttagtcagggaatctcaagatcagaaaaggaaagtgaccaggcagagccacacagcacagatctgggacagagccaggaggcgaattcaggcccctggcctctgatccctgtgtggttcccagtgccccagagagagctcactgaggagaggccctggagacgtgtgccctgggcctgtccactggcagctaactccaccccatctgggcctccagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtgagtctgtgtgggccaggagcgggtggcggggatggtgttggggggtggggtgcaaagagtgggtgcagggcaggaaggctgtcaggctggaccccagacccaggtctaggccccaagtaggaagaagggtatccaagctcctgaggccaggaaggggtgggggtcttggcagctagtcactatgagagagcctgggcagagggctgctgtggggacaccatagggtgtcatgccactaggagggggagcaggagtgggagactgaggcagccacaaccctgtgcttgcctggggggcttgtagactagttgggtccttcatgtttccctgcacagatacttccttcctttgtgtcaggacctgtgctagatgctggaaacacagaaatgcctgatcagactacactctgcctgagactctgcctgagacatcagcacacattacagttagaagaatctgtgcagttctatggtcactagctggtagccttgggcaagtcacttgccccttctgagtctcagcctgctcatctgtgaactgggcatgacgacagtaccttgtggggtgggcaaactgctcttgaccccacatgatggatgagatatcagaggccttcagagggcgagtaacttgcccaggtcacacaac

SEQ ID NO: 80847 - DNA, 1095 bp, Homo sapiens
gtgtgcacactctcagcgtccactgttcccaggaggccctcagcttagattgctcaggcaaaaaccatgggctgtggccgcacagggcctaatgacagggcagcccacaacgcaagctgcacaacgtctggacctttgaaggcccatctgccctgcacagtattcccatttatggagcctgtgcctgtcccttaatgtacaattgatcttgttgagcctgtgccacagctgtgcacatggggcatcattcccatttcacagatgaggaaacaggctcagaggggaacttgcccagggtcacctagtcattcagtgagtggtgggcgggagggggggactccgcattcatacccaggtctccagacccaagagctgatgcactctccagccctccctccaggccccctggtcctgtgtgacccaaggggcagaattggtgcctatgaggggaagtccgagggacataaaaccttctttcctgttggagccctgagcttcctcaggaggtagtgggcatcaaagatgcttcccagggcccctcccctccctggactctgaatgctggcggacatgtccaagacactcctgccagcttcccttctctgggcagccctgggcccagagaacagggtgtcctggtggccgtgggcatctcctccgctcgggtgtggctgtggatgcttttggagtgattcattgccttagggagatagagggaaggtcagaagccctggccagctgggagggagcacagtgctggaaatggctggcatgcagaggagatggagaatagcctggaggcctgggcacaagctgccccactcaggatggctgtctgggactaagacaccgttttgtcagatttggatgcagacacatttccctctcctaatggggtgggtgtgtggggcagcatccccaggggcggaggcttctgagctccgctttgaaggtttggctgtgtgtgaaatggcagagaagggctttccagatggaggctacagagtgagcaaaggcccagcgggaggaaagtacagtgtgtccgcgggcagtcacaggtggtgtgggcagtgggggctcagctgagcaggacgg

SEQ ID NO: 80848 - DNA, 2033 bp, Homo sapiens
ctcaccacccccactctcccccatcgccagctccgccttaacctcccacgaaatcaaatccccgctttaccaacccgcagcagccgggggcatggagagagaagcgggggtggggtggggtagggtagccggcccctcccccacccggggggggggggggggcgcctccaccgactccgaactaccagtcccggcgtgccctggggcggcgcgggcgcaggggcgcgtgcgcggcgggctgtcgttggctggagcagcggctgcgcgggtcgcggtgctgtgaggtctgcgggcgctggcaaatccggcccaggatgtagagctggcagtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagtgtgcgcctttgggaaaaaggcacctaacggcgcaggagatagaggcgggctcgaggtgattgaggcttgagggccgggggcggcgcgggctgcgccctgagaaggcggcggtcagtgctttgtgcggggaaagcgcattgcggatggcaattccggtgcgtcattgtgagaaagcgctttgtgaagcgagagtgctgcgcaggcgttagagtgggagagagagcgtttggcgcgtggcacaccctcgtcaagtgtttgttattgttctgaggaagagggcgcggagagagcagcctattgtagggaggcgacgggagcgccatggcggcggttaggggaagtgatgtggcggcggggggggaggggcggtggctgtttcgggcggtcctgcggcgcgcccggccgcttgggcagctacgacgggtttttcggtgcttcctggagccccggggtggttgcgttcggtggcaactcagctgcggatgggggtgggtttggcgccacggggcgggagaagtgcgttgtaaaatggccgttgcaagatggcggcgccatcatggccgccggcgtctcggtcccgtatggaggcacagcttacgggcagatgcagcgcccccttccacgacgaccagaaggttgccggggccctccgcataccacagagtggtgggtggggacagaaaaaaaaaagtgagatgagcgttttcctccgctttgtgttgcctggaggcatcactctgctattcttgggcgcagtgccgagatcctatggtaatgtgagtgagctctcgctttgcagttgctcgtaaaaagtaaataaaaatgatctgaatgcagtgttgacgccgtttgcatttgtaagtcccattgcctcgacgtcattttttaaatgcagtaattgtttgattagttgcagtgtttaacaatgacttgaaagttgaatttctttttattaattggttttcgattgacatgagttttgggtaaggttagactgactcccagtggaaggcagctctttaaattttcacaacgcttcagttaacgtataataaggtggaggtctaatagctaaaaaggaagtaaagtcctgttgagaaaggaggaacactttaacattccttttcattgctatggaaatttatgctagttaccgtaaatacgatgtctacatgcgtacgatttttgttctaggggtttttagacttgcattagaattccttttagagccgtaaacctcaaaccgtagtactgcgtattttaagtttatggaatatttaaggaggttttaggggtattttgttaatgagtgactttttttgtttgtatttttgagacgatgtttgtcacccaggctgtagtgcagtgacgctatctcggctcacctctgccccccacccgggctaaagcgagcctcccaagtagctgggatcacagacgcgcgccatcacgtccggctaagttttgttttgttctgttttgttttttagggtttttgttttttcttttctttttctttctttttttttttttttttttgtatttttggtagagacggg

SEQ ID NO: 80849 - DNA, 2865 bp, Homo sapiens
ttttgtatttttagtagagacggggtttcaccatgttggccaggatggtctcgatctcctgacctcgtgatccgcctacttcgccgtcgcaaagttctgggattacaggtgcgagccaccgcgcccggccgagaaatagggtttttaatgattcttgtaaacttgttaaaaaaaaaacaactcgtaaacttataaaaaagtttttttttatttgataatggcgtgcaatatatgttgtataagcaattcttaaggcatagtgattgctttgcactggacttggttttccattggaaattcttttttgttttgttttgtttagattttgagacggagcatttgctgtcctgggtcatactcctcagctagctgtatattttttcaacaaaatactagggcctcgtagctagaatggaggtcacagggcctcggtttcagtgcacttttttttccggcagtagcagccaaggggagaaaaatggtaggccattttcagagtgcctttaaaatgtaccaggagagtgaaattaggaaacacagatctgatctgatcttgttcgctgtttattagcagtatagtttacccattttagttctcgttcctgggccgttggagaagtctttgatcttcccgttttccagtctccgtctttaattcagaaatgctattcgtaggtccagcagcctctagcagtgattctttatagagtgaccacttaaaagaattatagaactgatttaaaaataaagttaataggtcgtgctctgggagagtctaataatatgggtctttggtggggcttgaaaatacatagttttaaaaaatattttaaattttagtggtttttttttgaggcggagtcttgctctcccatccgggctggagtgcagtggtgtgatctctgctcactgcgacctccagctcctgggttcaagcgattctcatgtctcagcctcccgagtagctggtagctgggactgaaggtgcacatcaccacgcccggctgatttttttttttttttttttttttttttgagagggcggctccttctcacccaggctggagtgcggtgacaagatcttagctcactgcaacctccacctcccgggttcaagcgattctcgtgcctcagcctcccgaatagctgggattacaggcacacaccaccatgcctggctgatttttgtatttttagaagagacagggtttcgcctgttggccaggctggtctcaaactcctgacctcaggtgatccagccacctcggcctccctaagtgatgggattacaggcgtgagccacctcgccccgcctgctcttttaattttagagctaaaaaagagctgacattcttggatatttcagttgtccatgggtcttttgaaaccaagtggactgaaaataatgtgtgcaaaatctttcaagctacactcaaatgtaatctgaggtactgcctagaattgcttccaagacttccaggtcctgacattttctttagtcttgaagtaggctcaacgtagactgttacgttccaaaggttaggctttattgtctcatttctttgttcattgaagcaacttagcacctagaacatcattccacatttgaagaatgaacatagtgagaccccttaatccagccaatctctgatgcatattgatattttaatttgtacgatatttcactgagtaaaagggttggaagcagagatacaagtggagagtaaaggtcctcaacttagaaaaacagatgaggaaagcatttaaaaaactgtattttcagatatatagttaaaaccaaccaaccaaccaacctcgacagctttgcaggagagtccgcttatgtgcttaacaggtgatagatgatttgattatttaagtagattgacctgctaatgaattgtttttgtttttaccatcggataccaacgtgtttttgtcgtagggtatagttgaagtttgagccaaagtggtgctctgtatacccgtcctcatttttcctaatttggctaggaataccttaataaaagtgtgatgactctctaagatgttaatctttttatatatgagaagaaattacaattcagtactttttctccctttacaggtgagcgagtgctgtgctttcatgggcctcttctttatgaagcaaaggtatgaaacttgttttcttttgagaagttggccaaaactactggttagatctggccatttaatatacaagtacagtattttgttgttgcctcagtaagagagttgccttttttaggttcgtagttaataaatttcttcatctttctgagattcttattgttttgcttagtggctcaaatgaattaaaacattgctactctcttccacttttcttactcatctggaagtagcatttgaggggaatgttagaaggggaagatgggctgtgggaacaaagagcattttgtggttaatgacttggtgagaaaacattgctgaagttacttttaaaagtaatatatgctgagtaagcattgagctaattatattaggttaaaggtaaaagccaatattaaaaataagtacatttaactgttgattgttgatttgtctggcaaagtttgtattctgggaggccccctttgtatcagggtgtgctcaagttataaaaactgattttacatttagctgaaggtaagcaggagaatgcattccaaagtaaaaaaaagtttcagtattttgtttctgataacttttttagtacaaatatttaagacttgactataccttaaacagtcgtagctccaaaaatgagcccgtaaaatacaaaacagtataatgtttaatttatgtaatttctgcataaattcttggtgagtagttttatgctat

SEQ ID NO: 80850 - DNA, 1062 bp, Homo sapiens
ctcagcctcccgagtagctgggattacaggcaccagccaccacacctggctaatttttgtagttttagtagagacggggtttcaccatgttgaccaggctggtcttgaactcctgacctcgtgatccacctgcctcggcctcccaaagtgttgggattagaggtgtgagccattgccccttgggagactgtctcttaaaaaagaaatcctaaaatgactgaatttggatgtatggagatggtcaggaatttctaagtatatgtatacgtacatacatcttaatgatataatgtttgtaagtgctaaattacgactcatggccaggggctgtgacgtacaagcctgtaatcccagggctttggggagccaaagcaggaggatcacttgaggtcaggagtttgagatcagtctgggcaagatagcaagactgtctctaccaaaaaaaaaaaaaaaaattatgtcctgttaatcgtttttatccctgaatgttgttattgttgtatcaacgtttggcaaactctactaaactggctgatttttctcctggcacctgacactctggtgaacaattttcgaattgaagctattgaaacaaattaaactgttgtggttattttggttttctcttaaagacttttaaatccaaaaccagatagtcatcacttgtcatagttaatgacttgcctctagtaattccttttgtctggctgcttttaagaaaagtgaaatatttttaattcattgctttacaagttgtttaaactaacttttcagaaacaggtccatttactgcctttcataagctaatgaagtttttttataatatagtttaaagactttgctttagaggaatttgcttttgaaataaatatagctcctggctgattagactgagaagacacaagcatagctttcattagctgtccttggatagcttttgtaatccattgattaaagatttaaggtgaccttttatgcttgtggttctcagctttgttggaccttttgtgactaatcttcagttttgtaacttgagtattctacaagcttagtgttcttagt

SEQ ID NO: 80851 - DNA, 1003 bp, Homo sapiens
tttttgtatttttagtagagacggagtttcaccacattggccaggctgtcttgaactcttgacctcaggtgatccacccgcctcggcctcccaaagtgctgggattacaggtgtgagccactgcccggcctttttgtgtgtgtgtgtgtgtatgtaaagtaccgatgttattgatcttgttctaggaatggacagtgggtatagattgaacacattctagaatgtccatccagtggagctgtttttcagtgatgggacttttctccttgggcctcacaaataaccctgtctaaaaatttacccaagtctcctatttggtgattgtaatgaaaagacttgtaatttttactatgggaggttttacattttattaatgatgccttgtccttcaaagatagcactgccattgctatttagtattgttcttgtggaattgtcctctagtaacttaaggctttgtgtcacctgactcaggctcttttacctggtttactatgggatcagtgccatctgatttgatgagtattctgttactatggaaggagtttatttttcctgtgaagttcactggccctgtgactttggtcttgtttcatctagtactctatccaggtgaccaacccagttaattttatttctttgttaggaagttgttttcacgtatcagatgttttcagctgagaatttatcagaccttttacttccattaatataaatgtggaaaggtagaaatctgaaatgcatagaagtgcatcctgacaacttgtgggtatttttttcccagttaatgataattaaagtatttctaatcagtgaggtgtggtggtgtgcacctgtagctacttggaaggctgaggcaggaggattacttgagcccaggagtttggggctgcagtgagctatgatgtgccactgcactctagcctgagtgacagagcaagatctggactcctttaaaaagaaacaacaacatgtatttctaataatgataggtaatatttaa

SEQ ID NO: 80852 - DNA, 1350 bp, Homo sapiens
tgaccaacatggagaaaccctgtctgtactaaaaatacaaaattagctgggcgtggtggcgcatgcctgtaatcccaattactcaggaggctgaggcaggagaatcgctagaacccaggaggcagaggttgtggtgagccaagatcacgccattgcactccagccagggcaacgagagcgcaactctgtctcaaaaaaaaaaaaaaaaaaaatacacacacacacacacacacacacacaaatatctcaaaaataatctcattttgaaaatggcttgtgcagggtactttttaaaattcgtacaacaaaaccttaatccctaaattggaattctcttaaacttcagttaatcttttttcaaaaacataatagatgatggagatttctaaattttcaaacctcattggaatttgttgacacacacttaaatactccatttgtaaatgaatcttaataaagctgaggctcaattctgcacctggtcactgagattactttgtactatgctgtctgtatcagaagtgctgtgaggcccaggcgctctgaaaaatctttgaagacacatgaggatattgtagccctttttcctgttcctgaaggagctccctcagtacaccaccccctcctgacctctaggtaaatgcatgttttgaaattttctctaggaaatcatgttcaggattgctttttattattttcctcttggctgtattatataagaggtcagaggtgggaaatcattaaacaaaagaaagtcttaaatttttttttgtaattgggtgccttgagagtacacctaattgtgtcactaaaggagctccatcagcaggagaaaagatttactgctcaaaaaaagttagcattccctaagaaattacattgtttttgtttgccattttgggggaaaaaacacataatcagaaattgtgttttgaacaagctctttgaagtgccagaatgtcttaacatttttgagagagttggttctgccttctaatatttagaaagccagctttctgatcagccttgaaagttattagtgtgtattcatttgtgactgaatgaaggtggagaatggtgtcaaatcattttaatactttacaaacttaagttagtctagttggtgtttgagtattgtagacttcctaatatgtttctgacatacctttagtgttgttttgtgtcagggattctcaggtgttttacatgtattctcataacagttatttgagataagtactgttgttatcctcatttcatagagaatgaaatgaaaacacaaagctatatggaactttgtcattacacacagctggttttaatttttaaaaataactgagtttttgactc

SEQ ID NO: 80853 - DNA, 1425 bp, Homo sapiens
acaaagatagtactagtggttataagttttgagataacttttggcaagccttttcaaacctaaaaagcaagtgctggcaagtgctaaaaatacatacgaattaacctccactttggtgaaactcatggtaagaatatgtgagaagttaaggtttcaaataactgccctcctcatccccacccctaagaaaaccattgcttttttttgagacagagtttccctcttgttgcccaggctggagtgcagtggtgtgatctgtgctcactgcaacctctgcctcctgggttcaagtgattctcctgcctcagcctcccaagtagcggggattacaggcgtgtgccaccacgcctggctgatttttgtatttttagtagagatggagtttcaccatgttggtcaggctgacctcctgacctcaggtgatccacctgccttggcctcccagagtgctgggattataggcgtgagccactgctcctggcacaaaaccattacttcttgttaactctagattttagaacatctgataagaagcctagagtgagaaagtcatgtgcatgcatacattttgtatgtttaaagtttatgtaggacggtgcggtggctcacacctgtaatccccctactttgtttgggaggctgaggcaggagaatggtttgagcccaggagtttgagaccaacttgggcaacatcgggagcctctggttctacagaaaaataaaaaaattagctcgggggtggtggcacatgcttgtagtcccacctattcaggaggccgatgtgggagggtcacttgagcccaggaggtcaaggctgcactttagtcttggcgactgagtgagatcctgtcttttaaaaagaaaaaaaaaaaagttgatgtacctgaaagtggatgacaagagtggtaacttaataagtattcttaagtatttgtaataataaaaacaaaaattataacttttattaagaggtcattttatttcctaccagaattactgatctgatttttctacttaaaagtaaggtgttacacccagtgctttgggaggctgaggtgggagggattgcttgaggccaggagttctaggctgcagtgatctgtgattgcaccactgcgctccagcctcttaaaaaaagtaaggtgttactaatgaaggtatttagtatttaatgcatttggagatgtttgaagctttttatttttttttaaactctttttggtgagaagataattggcaaggattaagtgtgttactatttgaggattgttcatagttttaataagtggtaacatgttttcatgatctggttctttggaaaactgtagtgtagtatttcattaggatttaatagtaattatgtcttaaaaggcagtaattttctctatatagaaaagatttttatcaaaagtaatagttcataac

SEQ ID NO: 80854 - DNA, 1959 bp, Homo sapiens
tcaataaaaatccttgtgtctgagtaggacacatatttaccacctgatcctttatccaagttagtatttctctgtgaacttaaccctgataaagggagttgaaacagaggcagttttactggaaataattatttttcttttttttctctccttttaggaaaacgaaaaagaacaaacagaaaagtaagaatattaactttcttaacgttaatttatgttacctctatgacattgacgtttttattttgaaagctatgaaattttggagtaagcttatgtttattgattatctcaaataggagtctcacagcagtgttataaaataggtacatggtggtagagacctctttttgccaaggagaaacttgtgagcatttattttcatctgctttagtcttaatgtctcccactgagaagataacatttataaataaatggaagatggtgatactaaatgttgtctatactaaatgttcggtagagctcttcatgaaagttgtatttttggtaggaatatgattctttaacttagattgaggtaacagctgtgtaatggagaaataatgaaaagggttaatgtgtcaagagactattttccttatagagtttgttaaattagctaaatgagacccctccccgccaacatttacagcacctggaaatggagatggtggcagtaccagtgagacccctcagcctcctcggaagaaaagggcccgggtagatcctactgttgaaaatgtgagtttttcttgtgtttatgaatagcatgttaggatttttagtctcagttacatgacataaccatgggagctttgattatctacaagatttgcttacatggttaatacctgaaattaaaaattttctcttttgggggtaaaggataaatttctgtatatctttatttcacctgtagctccagatttacctacccaattgatcatttgttgtgtaagcttcatgttcacctacaagactatttctttggtgttacgtatttatttttaggagttaaagatgtacctttaagatggttgtgtttggaatagttttgatatccatggtaaataagaaaatactaagttaaaatgtatcaagtcagggtgtttcatttcctgaacaagaggaaccttactgaagaatttttacctttacaagaaaatgcactaaatagactatagttcaggtcagattcttttctcccaacagcgaaccgcgtatggtcgtttttattaatgattttaaaaaatgacagtacagctgtatgcttggctactttaagatttatccctagtgcctctaaaagtcagctcccctccatgtttggtatttagcaagaaaggttaggtttttaatactcctcctgtttctgtttaggaggaaacattcatgaacagagttgaagttaaagtaaagattcctgaagagctaaaaccgtggcttgttgatgactgggacttaattaccaggcaaaaacaggtaacttgaaaagctacccagattgttaagctatatgatacattcttgctagcaaaaaaagtttttaaaggaaaatgttatattgacttgaattattaaggtatgactgataaaataatattttaatttagaggctgaacactttagaactactaccagaaagagtaagttagaagaataaaagttcacatataaattttatgaggttataatgataaaggtggaaataactcatttttggagattgctagggcaggaactcgttctgaaaattcataaaggtgaagaagcatatgtcttactgtcattgctaatggtaggccatagaaagcacacaccaccacctgcaaggtattcatgaccctgaaaagaacctgaatcttactaagcgcctggatctattgttagtttgcaggaaataggatgtttaatggagtgacatgtttgtcaatcgttgaactctataattgagaattt

SEQ ID NO: 80855 - DNA, 1717 bp, Homo sapiens
ggtgtgcaccaccacatctgtggtaatttttgtattttctgtagagatggggtttcaccacgttcgccagggtggtcttgaatacctgacctcaagcgatcgcctatctcggcctcccaaagtgctgggattacaggcgtgagccactatgcccggcctaaaatcatgtattttaaaggaattggtggtgtttgctcacataattaaaatacatggttgtagtgcccctgccttggatgtaactttggataaattctcttgtttaaacagtacgaattggagcaatgttggcttatacacctctggatgagaagagccttgctttattactcaattatcttcacgatttcctaaagtaagtctgtgcttgaaattataaacatggatttgaaaattagcgtgtaatgggagggattggcagtatagatgctaaaacattaaacattatattggtacaggcatagatagttggtaatggagcagtaaaagtaagtgcaaacacatgggagtctcagaaatgatagatggtatatagatgatatattggtgcagtaggggaaagcagtggagtctggtagattggtgataagacagctgacagtttggaagaaaacaaagccacacttgtcatgtaccaaaattctagatgaatctgaagtttaaaattaaattgttaagataatgaaaggagaaatgtaatattttcatagttctatagtgttccatttatgataaatggttggtacctttaatacacacagagttcttcggtaagaaatgaacaaaccagtgaaaagtaggacaggaaatttacatcaatggcagcacaaaggaccattaaaaatatgtcagaaataatgatgaaagtataaactgtcagtaaagtagcacttgtcagattggctaaggtttaaatgtttgaagaaatggagaaaagggcaatcctggtttctacaagtttttggagggcatttttataatagtgaagaatttgaaacaagcacttattaaaagggtgaggtcactctaaacatactgataaagatgtccatgttttcaattgaaaaacagccaagctgtagtagaggagtatggtgtaattgttacttgtagagaaacattattttaatctttgcataagatctggctttccaatgtggatcttagttaatactgggttatttcttgggcgtggtgttggaagggagggtgggagttttcagtttctactttgtatacttctgtatatgaattttctcattacaatcgttttacagtaaatttaaaactgcaacgtggacttgagaatgtaggcaagatttatcatcttttctttactaatgataaataccttctttggacctcagtttctttatggaatgtgctctactacttgacatttcacgttcccttttatgtaattaaaaaaaaaaagtttattcatttagagatggagtcttgctctgtcgcccaggctggagtgcagtgatgcgatcacagctcactacaacctccgcctcttgggttcaaacgattcttgggcctcagcctcccaagtagctgggattacaggtgcacaccaccatgcctgactgatgtttgtatttttagtagagatggggttttgccatgttggccaggctgatcttgaactcctggcctcaaatttttgtgcctcggccccccaaagtgctgtgattacaggtgtaagcaactg

SEQ ID NO: 80856 - DNA, 1079 bp, Homo sapiens
ttttttttttcatttcaaaattgctgccagtgttttcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcaaagaacaatgtgcttgtgttgatgccttacaaaaaccattgtatatttgtgtattccttcttgtatttagacagtggtttttcaggtgcgtgctttgttttctggtatggcctttatggaatgagacgctttagctttggtacgtagcgctaatccatagcagctttggcagtttgctgtcttgagtcttagctaaaaagttagaagtttacatgactgttttttttattttccctaaattattacttactctgagcattaattaagggcattttcacctgtgtaaaattatggtcagcttttttctgtctataattgtttacttttgtgggtttactctagaaacatgagccaaaaatgtcaatagacaacacagtattaaaataacccaaaagttgtaaagggcaacgtttctcccctttgatagggacactaaagtggtctgtacttgggtagaggatggcagacgttaagaattaaaatgcgtctgggtgcagtggctcacgcttgtaatcccagcactttgggaggctgaggcgggcggatcacctgaggtcaggagttcgacaccagcctgatgaacatggagaaacc

SEQ ID NO: 80857 - DNA, 1018 bp, Homo sapiens
ggagaaaaggctggcatggggcggcctgggtgtatatgctgctgtgcctttgtcctgtcctcccagattccatgtccttgtctgaaaaggagagctttcctgttccctcgggctcctggtgataaaatagctgtgtgagggcccggccagggctaagagggggccctcggtaaattttcgggagaagtgggatatggatcattcatttggcagctaaggagagggaagaatgaattcttcacaaagtcaggtccgtgatttgccggtgatcaaataagccgaatgctactgttttatgaataaatttagagggtctcacccctgaagtcagctcttggtgagcagcaaaacattctagaaaggcctgtggtggggagaccgccggccgggcctcagctcctctttctgcccaggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagatggagcatgctggtcctgggccatgactcaaaccaggtctgtcctcgccactcagtctcccaggagggaggcatcagggggtgtccaggctctggctgggaggatggtgggggtgctggcggtattatccaccagatggggtatccaggatgaagagcaggcttaatt

SEQ ID NO: 80858 - DNA, 1050 bp, Homo sapiens
gaggcagtcggatcactttaggtcaggagttcgagagcagcctggccaacatggtgaaaccctgtctctactaaaaatacaaaaattagctgggtgtggtagccaggtgcctgtaatcccaggtactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattggaatggatctattttagggtaaggcacggttcaccagcagattattctggccccagaataatctctccagaggcaaactggtagtcaattgtcctaaactcaaaccctgcctccaactcttgtcctgagttgaggtctgtcttcctctaaagccctcagctgcagcagggcccttaatcaagatctggaatcccctgaaaccctaaagggagccatgttgaggaaatgtgcattttccccagggaaaacggccatagattggtctctggaacaggttcgagacccaaaaacggagatctaaatgctgtgtggtagtgatcttcacactggaggtatggatccttggggaaacaggaagatatttcaagtgatgccggcagagagtgttctggaaatccatttacagaccttttatttccaagtgtcctctttgctaaaactgggagagagcccctgaaggcaagggggaacctctttcctctcattcaatctgaacctgaacccatgggtataaaaacaatagggacagcaaacaaaaagacaaaacggtaataaatcgttcatatctggcattctcaattcctcaaggaaactgaattgaagaggagaggacttcatggggatatcaactgatgaggtcttaaaaataatgttgagtgaggccaggcgtgggggctcacgcctgtgatcccagcactttggtaggccaaggtgggtggatcacctgaggtcagaagtttc

SEQ ID NO: 80859 - DNA, 1032 bp, Homo sapiens
gacaggcagggacatggtgtgaggtggggacaggaagggacatgaggggtgcgagttggggataggcagggagatgggggggtgcgaggtggggacacgcagggagatgggggacgtggggatggcgacaggctgggagagggagaggccaggctgagacctccccgcgcggtgccagccagtccaggcagatccaggactcagccaggcctgatacccagataagcccttcctcccagaggagataagggagcgacgcggccggccgacaggtgaactagagctggcgagttagtcggcgccgccccctcccgcgagcccggcctcgggggagtaccgcccaccccgccccgcgctcgctccgccccgcgctcgctccgccccttcgcgctcccgccgctcctccacgctcgtgccgctccccccccgcgctcccagttgacgctctgggccgccacctccgcggaccctgagcgcaagagccaagccgccagcgctgcgatgtgggccacgctgccgctgctctgcgccggggcctggctcctgggagtccccgtctgcggtgccgccgaactgtgcgtgaactccttaggtacgcagagggcgcgccgcccgagagggtgctagcaggccctagagtggacgctgggagaacttggccaggggcgcactgggctccggaggaacggggcagagctttccccggtgagaggccaggaactctgcgtgctggcacggggaggggtaaactgcattataggcgggggttctcggagggtgggcggcttgtaggaccagaggagcagatgggctgagtgtccagggtcccacctagccaggtggctctccagcctagaataccaaaggagcccgcagctccttccgccttcctcaactggggacacagagtgtcacacagaggactctgatctgtccctgccagaggtgagcaaggacgtcccagccttctctagcagcttcccccgggacttggcacacaggggatccccgtagtgtcttgggagtcccatc

SEQ ID NO: 80860 - DNA, 1009 bp, Homo sapiens
caggccagggaagtcattctcctgtcccacagcctcctgacttgactcatggcagacaggcagcacccaacctcaacctgtagcctcccctgccctgactgccaggaagtgcgcagtagctggactggggtgggcaaggagctccttctgagtcacccacgtaatgcaccctggcactgccagcctgcagcagggatggctgtcgccttgccctgcgacaccatggggcgcacactggaccccagcctgcacctatgcccaggcatctgctgagggttgggggtgatggtggactgtgagtctcctcagctgactcaaccggttgctccctgagcagatggtagcagaggtcttggggtctgggatgccagagtgtggggaataagcagccaaggacccatccaaggagctgaaaaagcggtgggaggtaggaacatgcatgaaccaaggctccaagaacctgcagtgtgctcatggtcccatcaaattccactcactaaacacaattcaaagagaaaactatcttaagaatttcaacaaaagagcttaaagtcccgaatgcagagccttctgagcatagggccccatcacacctgcgaatccagctctgcctggaatgttcaaagatctaaagccaacaatttcaccttgttccgcagcagccaagccctgaactaagagtaatatcaacttgcaacctcaaggtcaacaaaaattccagattctacacatctctgctagcctgataacaggcaccttcacgacatactttcattccccacaaccatcctgataggatcagtcacctgcatttcacaggagaaaccagactcagagagcccaagtcacttgcccaagctcacacagctgggaagtggcagagctgagactggaacccaggtctcctgtctgcttgccagtctttccactctactctggtagcctcttcccacagggctaccagagctcagttcagggatgtccccactccggcccacccagttcattc

SEQ ID NO: 80861 - DNA, 1403 bp, Homo sapiens
tggattcagagtccaaacacaactgtggtctagttcacactttgctgtttattagttgtatgactttgggcaattcgtgtagcctcttggagcctcagtttcctcatctgtgtgtgggataagccctcgttaacagtgagggtaatgatccgtgcctatcaggagtattgtaaggattgaataagagagtatagggcagtgcttgaaagcataggctcaggactcagactctaactcagccacatactaactgtgtgactctgggcaagttacttaacctctctgagcttcaattaggcttgttgtgaggattaaataaaaccacgtaaaacccttagcacagactcttagttagcattcagtggatatcacctaggatgttgacaacagcatttgctgtttgctggatcccacatttgtctatgggttagcagtgtgactgcttttctcttcctgcccagatggagtccgcctgcgtgaccatccatgaggctctgaaaacggtgattgactcccagacgcattaccggctgcgggaggcccaggaccgggcccgagcagaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcctggagacttgtgcctttatttctttgccctaaaggactccagagcttactgcagagcatgggtgtgtgcataaataat

SEQ ID NO: 80862 - DNA, 1099 bp, Homo sapiens
ggattggcgaaattgaacggaagctggaatccctgtcgggtgtccgtgatgaaatctcccaggtcttgggcaaactaaataaattggaccagaaaatgcaacagcctgagaaggtgagtgtgcagatagatctgaactccttgacaagcgagggtccgtctgatgacagtgcctctccccggatgttccacgcacacagtggctcccacggacccaaactagagaacaaccctgactggtgctgctctgatgctagcgggagcaacagtgaaagcctgcgggtcaaggccttaaaaaaaagcctcttcaccaggccatcctctaggtccctaacagaggagaacagtgccacagagtccaaaattgccagcatctccaactcgcccagagactggcgcaccatcacttataccaaccgtgtgggcctcaatgaggaggagataaaagacacaggcccaggagataataaagactggcatcggaaatctaaagaggtaatttaaatttaagttcacataatcgggcaccagcttcatcatagccctggtgtatttcaaagccttgaacatggcgttaaacaggcaagaggcctggcctctgtgtgccagtcatccttccaggtttggcagggttttcacattggaatagagaggacaacataggcaggtcgtgtgttccaccaggttgtccatcagctaggaggagcacatgctgcgatattgctgacagcagaacgtagggttgggattcattagacaggtggtgtgagaacagattttcatagaatggggaacgtatcagagcaggcaagcatcaccaaggatatcttcctgtcctttctgaaataggatgcaggccaggtacacgagggaaaatactgaaaaggtgctggctgatacatctttttcatggacttcattgtatgtgtgatgttcctttttaagtatgaggtttttttcattataaaataaattgatgattaggaagtaaagaagataaataggatcatgaggtcaggagtttgagaccagcctggccaatatgttgaaaccccatctctactaaaaatgtaaaaaaaattagccaggtgtggtaacac

SEQ ID NO: 80863 - DNA, 1048 bp, Homo sapiens
aaggcactgaggtcttctcagttaccccaacacctactccagagttttgaatacttgtcagcagtgcaaaaaatattatctgtttaaccacttatctatatgtctatctatctatctatatgtctatctatctatctaaatacttgatttttatttattgtcttctctgttaaataacttgagagcaaggtttctttcgtgtaaaagaagctgttgtaatttcatccaaatttgatctgtttccacctgctgaatggtgctctgacaataatggaacagaaagaatccttatcagcatctgattccaatgtcttgttacaggtcaaagaaaaaaggattgacagaaactagctaccttatatatattttttgataataaggtgggatataaatagattttggtagcaagtgtaatcactccgtatgatataataaatttctaaaagatttgagagcatctcaatttttaaagcaataggagtctagcatccattctgaaaaatcgcaaataatgcttagcttgctgtgtctgattctgttgttcaccattaaggggtagacagttaattttattatgttaacaagtgagggatgaatgttttcatctgtggtgaacctttatttttagaagtcttcatgttatctatttgtattatcatgtttatgtatggattttcaatttcagtaaccgaaaacttaagccttagtatgaaaaactgaggatttataattgaaaatgaaaaaaatatgttactctctatcatcagaattatagtctttggtgctctgttttcaatggggcatattacataaggttgtttctttcaccccaaagagactactaggttaccactctgggcattgcctttccacctaacccctcaaccagtaagactctacaccatattgtagccccactattctcctctttatcacagatgaagtgccagagcatcagagataggtagctcccaacctcttgctctggatttgcagaagagggggagatgtacttacccaggataagaaaaatctagtcaaatccacc

SEQ ID NO: 80864 - DNA, 1050 bp, Homo sapiens
catgcagggcagacatggtggctatgtgtagtctttgataagtgtcagctgagactggtgagaattagtaaccactgaggccaagagcttattcgtatcctattcaggggctttcctctgtgccctgcatttttcatggcccctacaatgtaatttatgcaagtatgtctccttcttactttaagcatcttgtcttacgcactattcaccatgataggccaattgctgtaatagatgaccttagaatttcagtgatttaaccaaatacatgttgattgatcattcatccaacagtccgatgtaggtgttttcttgttagagcctctcctccaagaagtgactcaggaacccagggtccttcttccattttgtggctcttccctccatcaatgcctcagctcctctccattccacctatggaaagaaaaaaaggatggagcattatgcatgggaaggacctcacttctactcctctggctagaacccagccacatggtcctgccaaagtgtaaaggaggctagggaatgtgggttggcttaatgatcaggaggaaaaggaatcttggtttggtgaggtactagcatctgctgcacgtccttactcaaaggcccatcttgagggacaaggttactcagttgagatgaatgagggttttgcttccttcccacagatggcagatgatggtcatggctgagatctcagaacccgggatccttcagctgagtcccttgtgcgtctttgggttctccactgtggctgcattctctgcaccacattgccatagggtgatgagtgagggttccaaaactcctttttgtaaaaagaatcattgtgtgctttgagtgggagctttgttttagagaaacaaagccaagacatgattattctgtctgtgtagcactcttcaacacctacacgggaacagcagctcagaagccatttaatcatgtcatgcctcagagttattaaactgagaaaaataaatgtgaatctgtgctctggccaggcgggtgatatgaaataggcaaagcaagccaggcatgagaggt

SEQ ID NO: 80865 - DNA, 1050 bp, Homo sapiens; identical to SEQ ID NO: 80864

SEQ ID NO: 80866 - DNA, 1031 bp, Homo sapiens
tgctgctataaagacacatgcacacgtatgtttattgtggcactattcacaataacaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatggtctcactcatagatgggaattgaacaatgagaacacatggacacaggaaggggtacatcacactctggggactgttgtggggtgggggaaggggggagggatagcattaggagatatacctaacgttaaatgacgacttgatgggtgcagcacaccaacatggcacatgtatacatatgtaacaaacctgcacgttgtgcacatgtaccctaaaacttaaagtatgaaaaaaaaaaaaaaaacagaaaatctcagatggcaacgggcagcctccatgtttccccaggagttgagtggaacaaatagtccagattgtggggtacaaagaaatgtcatgtatataggcttaatttagggtacatcttctccccacaagactgagtgatttctagaggaactgttggaggttgcaaactggtagccctggggccaaataaaggctgtagatttgctttgtttggcttactttatggggtgtgtatatttttatatattctttgaaggtcttcaggtaaaggagcttgttccagctccgcttctgtcctaataaccctctaatacgtgtatatagctgcttgacctcctgaataatgtgggtttgcaacacttcattaagcgagagtggtctttgttgtcaagttgaatacaacgtcatggccacttcagttccagtgagctgctgcaagcacagggcaggtaactcagccccttctcttcccattctttgaaggaaagtttgttaaaaggaagataaggattcaggactctaaataaatgagtcggg

SEQ ID NO: 80867 - DNA, 1031 bp, Homo sapiens; identical to SEQ ID NO: 80866

SEQ ID NO: 80868 - DNA, 1037 bp, Homo sapiens
cttatgaatttattggtgctgtcttcatgctaatgagtgagttcttattctcttagttcccatgagagctggttgttgaaaagagcctggcatcgcctcctctctctcttgctttctcttttgccatgtgatctgcacacaccagttccccttacccttcctccatgagaggaagcagcctgaggccctcaccagaagcagatactgatgccatacttcttatgcagcttgcagaactgtgagccaaataaatcccttttctttataaattacccagcctcaggtgctcctttatagcatcacaaaaggactaagacaacaaggtttgtttgtacagacatccctcagcctcaactctccttacgatttccttctgttatagggaggacatctttcacatcggaatttcatctcttgctttaaagaagaaggagggttagagtgttctttttgtacttgctgttttctaagtgcttttaaatcaaaatagtcaatactctagaatggcatatttggggtgttatattccgaactcctctgaattaaacttaattcagttatatctcattagtgatgcccatgggatatagttaacaaaatgcagcccagaagtggatgaagccttccagggagggttgtattcatctgtatcaatcagtggccctctgtatctctcctttgtccctttaaaggtgacacattgacacagagtgtcactgactgtgcccttctgttcaccttgagctctcccatcatggtaaggaggatgttcttttagcatctgtgcctcagactttctctccagaacctgcttcttgttctgacttctcatggttatagtttggtctcctcagagtccctgacctaaacaggattgacactttgggctccctgggagttcttttctatcctcagcctgattggcttttccatctgcttttgattcaacctcacatttgccatttcttttttagactgtgcccaaatccatccttcctttagctctccacggctatcccctcagtgcatgtccaagg

SEQ ID NO: 80869 - DNA, 1037 bp, Homo sapiens; identical to SEQ ID NO: 80868

SEQ ID NO: 80870 - DNA, 1120 bp, Homo sapiens
caggcaagtgccaatatggaatatttcaaagatatttaaacttcgaaactatcaaagctatcaacatcttcttttgtcttctgaaaaatcagatttgctaacattgggccacatccccagtaggcagaagctaagcaccagctgccccttagacagggcaccgtctccatcacctcctactgtgtccttgccactggcaccaagattagcagtgttcttgctgagctgtggctccttccatagcctgctttatgtactctgtgatttgtacccacctggcctctatagaaatttgagtttatagcccttgattttaaagataatgaagagatctgcagttcccagaatttgtcctgtggtctctttcatttccaggcctttgccaatgctggctttcaacctggaatattcaccttcccctcttcacctggtcagcttctactcattaccttagatggcacttcctgtaggaagcatgctttggttttccaatatagagttaagtgcccttccttataacaatgcaggaagttcccttcctctcattctgctgtgaagtcttctctgtcactctgtattataatttcttatcttcttccctactagatttagagcatttttaaggtagggacatgtcttgttcaccttaagtccaggagttggcaaattatagcccacaggtgaaacttaaccggcaggctctttgtgtacagccctaacgctaagagcagtttctacatttttagagcatggtaagaacaaaacagtatgtgagagacagcctatgtggcctacaatgcctaaaatattcactctcacaatctttacagaaaaagtttgtttatccctattctagccttccatctggcacaaagtaagtattgaataaatgtgaaatgaataaatagctgttgtcttatacctggcattccaagtaatacacatgtactggagattctaaattgagtggagagataaagacattgtatatagcttatcaatgtatggttacttaacctcataattttacctgctccagggggaataccccccatgccctctgcattgcatgatgctgctcacacattacatatatgtaatactatgtttatattacaat

SEQ ID NO: 80871 - DNA, 1120 bp, Homo sapiens; identical to SEQ ID NO: 80870

SEQ ID NO: 80872 - DNA, 1023 bp, Homo sapiens
ctatggacacaagttttcactgtgagcagggatctcctccttacctaccatttcccctgaagcacagccccaggaacctagtgaatcttctctgttcccagtggagatgggataccagccttttgtggttgtgtgtacctgggatcgccatactgccctggtgtattcctgctcctggctttgtgacaaccctctgctgattgctagcaagtgacagccttgtcctcaagcacaggtggtactcatgggcgtgagcagtcaagggctctggaggcagcccagtgcgcagtgcttcttatcaaggaggctagtgtcggatcccacacccaccgagggtgctaatgtcctgggaagggtggcactggggtctagctggccacctggagtttctgtcaaggtctagaacaggagcaagtaagagttgatgtccactggtcactttcatataaatacatttgtcatttagaggcaggaactcaggatcatttcaactctaaggtactggaattatccagacccatgtttgtatttaattgaatgacttctagattcacagaccttacagatttatcaagttcagcatcccctgcatatcatgtgatgaaatccctgcaaaatagcctcaatcctctgactcagcactttcaggaccaggggcctccctgcttcccatgacagtcaatgcagtctttggattactcctcaactaatgtttctgtcaagctctatttttcaaaaatagttattccttaaaaataaaaaaggcttttcctccttatattctccctattgccttttcttgagcgatcccttctttcgcaatagaaacagagctacagaacatgtggttgttgaggggcctcagtccataccattcacaccacgtgattcgtatgaagttggccccctgtgtgcactatgaacaggcctctttctttgcatgaagaatgtctgtactgagtgaaggactgtggaaagaaaagataggtagaagccttctagactgctacgcagtctaagaaa

SEQ ID NO: 80873 - DNA, 1023 bp, Homo sapiens; identical to SEQ ID NO: 80872

SEQ ID NO: 80874 - DNA, 1057 bp, Homo sapiens
catggaatggggtcttgtcagctaagaagcagtgcttaaccagccattgagtgagctgttagggaccctggaataattacagccttctcaaatgagaagatgaagaggggttttttagtgtgtgtgtgtgtgtgtgtgtgtgtgtgtgtgttttgatagtttgagatttaaaattacatagtagaactaataggccctttctgtctcataattatgtttgtcttgatacaaacccttaaacgtttggctgctggtcttggatgaaactcccagcctcagatggaattgtaacgccatgatgagccattatgctgtggccaagggtagtccctctgcgacacttgctgcctggcagtgctgttgttctcagcatgtacaacaagggctcatatcagaaggaggttatattttccatggagctgtcacaggggcccaaggactaggaggcaggagctactggctcaggaatccttgggagttagatgggacctgggactctgtcatttccccctttgctggaaacacagagctttgagaatgctacagtccaagcaagagtggcactgggctgccttcatctatatggagattattccttcaacagagcaattgcagataattgaactttataaattgttctatcccaaagaataatgaacattgagaccattccaccaggatgatgagtttagtcctggaatagatgtcgtacaagtcgggtggtgaactgcactgaacatgcctggagtgatgttaggaagacagcaagctgaaaattagcattccagaagggataaagccatctgcatacaatattagaagattttatgacattatgtttctaggtagtttggactccctgagttagttaagaaacttaattttctttccatcacaaatatcttagggatcttttggttgcaagtaagagaaatccatgtgcttattaaagtaaagggagatgctttatgagtgaggcaggataacctggtagagaaattaggtgttttttccttccttctctcaaaaggctggcaaaagactagctccttatttt

SEQ ID NO: 80875 - DNA, 1057 bp, Homo sapiens; identical to SEQ ID NO: 80874

SEQ ID NO: 80876 - DNA, 1048 bp, Homo sapiens
tgctggcactgtgtgtattgtaccattctctagcttacttctgacagtctccgctcagatcctgccctgcagaagcacactcctgaagttccctagcccagtggcagccttcttgaccaagtcctttcaggatgacttgagtctattaatagttccacttgaggtgactactcgactaaataggtaattggctgcacgccagactggaagtgtcacctgctcccatgctactcttgagggctgctccagacagtccacaactgtcagagttctgctacttccccaagtgctggaagtcacgtgtcacattctcccaggaactgctgttcctctcctcccagagctaacagtagcaccagggtgtctgattctgccaggaggtagattcctcttttggcaaacacttccatactctgaagcagcctttacttggcttggagtgatggcagggaatcgtggggaggggaaggaaaatgtcacagcacccttacacttataagtcctctttcttcaaagagtctgcttaatctctttttttctaatacaacctggagaaggatggtggcggcgactaaagagccattctggctctctgttggtaaatcctgcgtggatgtgcatgttggacaccccttgtcctgtacctacatcctttcagaccacttttttccctccagccattgggtacagcagactggctgcatacaggtgaagccagacagcagttctcctcacctgcatgattttcagccctggaatgtcacatctgagtgagacccttgcaaggaccttctcagtcattctggtgcatgtacaaacctggaagtgtgttgtagttaacacctcaaggggtaatgaatgcttggccagtgtggattagaagccagtggataaattatcttgtcttccaaccctttggcagacaattccgaggtgtattctccatcattcctgagaggattgttaggctagtagcagcaaacttctgtgcccatggtgggaaccaggtggataattcaccctcaaattggccttccttctgtttccg

SEQ ID NO: 80877 - DNA, 1048 bp, Homo sapiens; identical to SEQ ID NO: 80876

SEQ ID NO: 80878 - DNA, 1052 bp, Homo sapiens
cctccccagcccttccccttgcaccttcaggccaagttgttggtacagtcagctaccccagggactgtaccatctctcttgctttctctaagcatctccatctctttattaatcttttctagtttccctagtttgagtgtgccttctgtccctcaccatggccctgacctgactggtacagacgctgcatccagtttgactgattccaccaccaaggcaaataagcagcgctctccctgtctgctttaatttcgtagggaaagaacaaagagcttccacacttcactagagctacactaccattcacattcccaggcctgcatttcctagctgtatgactttgggcaaattacatcatcttgttgggaagattaaattaagtcatgtttgcaaagagcttagcacagtgtctagcacacagctgaatgtgctgaaagaaattataaaagagcaacttcatttttcttggtttgtaaacagatacacctcaaaggagccttttaaagagaaaggctatttctaacagaggaatgctttcctatcacacgtgtttcggagactgtatttcagtgagccatcacggctcctgctctgcctaaggcttgagcagtttcttacggaccgctctgcatgtttctagctgacaggaggtggcagtagagagctaggcccacccttgcacatggtttgggctgataggaaatctgcatgatagctcttgtagtgttagtattatgactcaagaaataactttcagagtcaacagaaggaggataggcattattcatatccccaagtataatacagctagaatttattgaacacttactagagttttatctcctttatttagtccctctaaaatagcattatttttatctgaagaagaaattgggtttcaaagagaatttcagtaactttactaatgtttcttagctagtaatggttgttatgggattcaaacctgggcagtctctgtaaaagcctgcacagataactgctgtgcaggactgcctccaaggctcttgtccttgatgtttgtgtttaaaaaa

SEQ ID NO: 80879 - DNA, 1052 bp, Homo sapiens; identical to SEQ ID NO: 80878

SEQ ID NO: 80880 - DNA, 1052 bp, Homo sapiens; identical to SEQ ID NO: 80878

SEQ ID NO: 80881 - DNA, 1052 bp, Homo sapiens; identical to SEQ ID NO: 80878

SEQ ID NO: 80882 - DNA, 1010 bp, Homo sapiens
cttagtacctgggtgatgaaataatctgtacaccaaacccctgtgacatgagtttacttgtataacaaacctgcacatgtacccctgaacctaaaatgaaagttaataaaaaagttattgaaaagttccatccacccattttacagatgagtaaaatcagacaagcagaggttgcctacagttagtgaaaaataataggaagttctaatgtcttctctgtttcatttttaggtccatctgattatcaacaactcagatgccaaataaatataatatttagaaatgccatttatattaagctactgctgatgtggatcctattttctgcagagcatttttacatatctgcagtaaagagagtttaaattatatttttttccagtaagttttatttttgtcagtatctgctaagataggataagctgatgtatagatttttttttgttaaaaaccttatggcagaagctgtaaagtagggattggcagggtgctttttctgcagagggccagatagtaaatatctggggctttgtagtccatacagtgtctgttgcagtgattcaattctgctgttttagtgtgaagacagagcatggctgtgtcctattgaaactttatgtacaaaatcatacagtggaccagatttgacttgcaggctatagtttgcaaaccccagtggtaaagtattgggacaccattcccacttttcagtctgcagcaacctagcttgcttctttcatatacaattgtagttgtttatggtgatggtgatgatgatgttgattaagaaaataatgtaaatcaaattactattatctgttgacatgattttagagttattttctagacaacgtagtaggcttaagatataaaaaacatacttaagaaaatagcatgtttgaagtacctcttcaaaaagaagactggaaatttttctgcatattgttaaaaatatttttttctaaaggaaaatagctttgttcttataaagataagacataaagaataaa

SEQ ID NO: 80883 - DNA, 1010 bp, Homo sapiens; identical to SEQ ID NO: 80882

SEQ ID NO: 80884 - DNA, 1010 bp, Homo sapiens; identical to SEQ ID NO: 80882

SEQ ID NO: 80885 - DNA, 1010 bp, Homo sapiens; identical to SEQ ID NO: 80882

SEQ ID NO: 80886 - DNA, 1023 bp, Homo sapiens
aggcttggaaatcatactgtgcaataattaattaagaatagtgggccaggcacggtggctcatgcctgtaatcgcagcactttgggaggccgaggtgagtggatcacctgaggatcaggagttcgagaccagcctggccaacatgatgaaaccccatctctactaaaaaaatataaaaattagctgggcgtggtggtgcatgcctgtaatcccagctacttgggaggctgaggcaggagaatggcttgaacccgggaggcggaggttgcagtgagccgagatcgtgctactgtactccagcctgggcaacaagagcgaaactctgtctcaaaaaaaaaaaaaaagtgactttgcgagctcatcttctaaaaactgagaaaaatagaaatagctccaaaacaccgttgtatttctgtatctgaagaaattgttcttcactgcttttaagagtaagctagacttttttttcttgagtacaccctcacatgaatgtgagcataggatggactgccctctagactcttccctaaatgcctaatttctttctttctttctttctttttttgttgtggtaaggaaacacataacaaaatttaccatcttaaccattttaaaggtacagttcaggagtgttaagtatattcacattgctgtgcaacagatctccagaatttttcatattgcatatctgaaaatctatacccattaaacagttcttctttcccccctttcttcagcctctggtaaccaccattctactttctgattctatgggtttgactgctttcaagacttcatttaattaggatcatataatgtttgtttttttgtgtgtgtgactgacttaatttatttcttgattgaatcacacagataaacaaggtattgtccttaaattctcagagtcactaagctttgattctaaagagatctgagatattgaatctataaataacttaaatttacaagaagaaaacaaacacattaaaaaagtaggcaaagacatgtgcagatacttttcga

SEQ ID NO: 80887 - DNA, 1023 bp, Homo sapiens; identical to SEQ ID NO: 80886

SEQ ID NO: 80888 - DNA, 1023 bp, Homo sapiens; identical to SEQ ID NO: 80886

SEQ ID NO: 80889 - DNA, 1023 bp, Homo sapiens; identical to SEQ ID NO: 80886

SEQ ID NO: 80890 - DNA, 1045 bp, Homo sapiens
agaagatataatttcataagaaacttgcatctttgataacatgttttcaaaacaaagtattcaagactaggtttttaaaggctatttatgagatggattgaatagttttcttaatttccagcagatgtcagtgttttacaaatttattgttagtccacagagacagatttgtcttcagtctcccaatttctgtatcctttagttatttaattggcacataggggattatctgaattggaagggatttgaagatcatctaagtcagtttttcattttgtagataagagaacaggcctaggtgggaaatgacttgtccgaagtcacacaaacagaggagggctaaaacccaggtgttcttgtttccaaaagacttttcctttctgaaagactcatcctttcgtggttgatacaataggccacctccctagtgaggttttcctgtgtttaactcccttctcaagggaatacaacttccttcctttgtacctattaccttggaacttacattattctaccccttattactattatttaataatctctttacagacaactgattagatgcatttttagctgaccaggttgttaggtcctagagggcatgaatagtaacttatctctgtgttatctgtagttccttgggcagggccttccataaagtgagtcattagtaatgactattgatttgaatccattaaattttgattcaaacttttttctgctcttttcctgtaaagctgttttagaaggttttagagaggattatgttttttttttttttttttttgagatggagtctcgctctgtcacccaggctggagtgcagtggcgcaatcttggcccactgcaacctctgcctcctgggttcaagcaattctcctgtctcagcctcttgagtaactgggattacaggcacgcgccaccatgcccagctaatttttgtatttttagtagagacgggggtttcaccgtgttggtcagactggtctcgaactcctgacctcgtgatctgtcttggcctcccaaagtgctgggattacaggcg

SEQ ID NO: 80891 - DNA, 1045 bp, Homo sapiens; identical to SEQ ID NO: 80890

SEQ ID NO: 80892 - DNA, 1045 bp, Homo sapiens; identical to SEQ ID NO: 80890

SEQ ID NO: 80893 - DNA, 1045 bp, Homo sapiens; identical to SEQ ID NO: 80890

SEQ ID NO: 80894 - DNA, 1058 bp, Homo sapiens
taccacttgggcagaattacttaacatctcaaagtccaaatttccccatctgaaaattggagataattacagtactgactaattgtgttgttgagaggataaagtaaggtagtaaggtgatatatgtaaagtgcctagtacagttcgccttgtagtcagagatcaatacatggcagttattaacagtaagcagaaattatttcccccaaaccttccatggctgcctacaatgtactagtccttttcttccgtaattcttatgtacttggcactttacgtatattagcacgttttattaattctttttggaagtatatcccttttctttgctgatagactctttcggagcagaaaccttcttctaaatcatttgtatccctggtacctagtcatatggtttatgttgtagactttcagtaaaagtttcttgaggtgaagctaacagttttgaattcaaagcgtgcctgtataaatgaatagattatcaacactttatagctatgaaagaaaatctggatttaaaaaactgtgtgcatgtacacagggacacattaaaaagtatactagagtcagttgttttataaggcgctgtaacttgttgtttttagagacaaggtctcactctctcacccagactggagtgcaggggtgtaatcatagctaactgtaaccttgaacttctgggctcaagtgatcctccaacttcagcctcctgagtagccaggactacaggtacacactaccatgcctgactaatttttaaattttttgtagagacacgtctactctgttgcccaggctgatcttgaactcctggcctcaagcaatcctcctggcttggcctcccagagtgctgggattataggcgtgagccactgcacccaaccaacattttttatatttgtgagtaaagagttaacatcggtcccggactaagctgggcctgcctgggggaataaccttgaaacttatcttctctcagcactagttttggggaagccatagagttgtgataatgtgggatgtacctgtacctgcctgttactgtgtgctactac

SEQ ID NO: 80895 - DNA, 1058 bp, Homo sapiens; identical to SEQ ID NO: 80894

SEQ ID NO: 80896 - DNA, 1058 bp, Homo sapiens; identical to SEQ ID NO: 80894

SEQ ID NO: 80897 - DNA, 1058 bp, Homo sapiens; identical to SEQ ID NO: 80894

SEQ ID NO: 80898 - DNA, 1058 bp, Homo sapiens; identical to SEQ ID NO: 80894

SEQ ID NO: 80899 - DNA, 1013 bp, Homo sapiens
tctgtaaaaacgcaccaatcagcactctgtaaaatggaccaatcagcaggatgtgggcggggacaagggaataaaagctggccaccccaaccatcagaggcaattggttcgggtctcctcccacagctgtggaacccttgttcttttgctcttcacaataaatcttgctgctgctaactttttgggtctgtgccacctttaagagctgtaacatttaccgcaaaggtccaaagcttcattgttggtcagcgagaccaagaacccggtggaaggaaccaactccggacacactatcactgtttatatatcctttcttagagtatatttaacacaaccaccttgtactttggtctgtgtagtctagattgtgagcaatctaagcaggaggacagtaccatattcatgtttatgtttctgaacagaaccacagtatagtaagacttcagttatactaatttaaatgaaatcaatctatcagtgatgttaggttaaaatgaggtgaaactgtaaactgagaccaaatttcttacatgaccgttatgccagttacagatgaggaatttcacacagattctgaataatggcagtattgaatctcctttcccatgatgaattaaaaaagaaaatactgtctagatctagtgtctgattttaaaagtcagttttagaattaaccaaagtactggcatggctctgttttgtaggattacagaagcactttgttttaaagtgctttgtactttttgtgatttccaagttttctctcatgaatatgaattgcttttataatttaaaaaatcctactgataaaatttgtcagtttcattaccgcgtggtcatgtagggatcataatataacctgatacattaaaagccattgatgttttccttgttacttagtgctagtaagattatacatcacagatggagaaattttggtttcaataagtttagataatgcatttttgatagaattggaacccaagacagctgatatgatcttatgatctatt

SEQ ID NO: 80900 - DNA, 3199 bp, Homo sapiens
atctcggaagttgtaaccagttgtgaggaagttaggaccttggggttacctaaagataatttatattaagttgttgggccataaaaactgggcagaattggccacgcgcggtgactcaacgcctgtaatcccagcactttgggaggccgacgcggactaatcacgaggtcaggagatcgagaccatcctggccaacatggtgaaaccctgtctttactaaaaatacaaaaattagctgggtgtggtggcgggcgccggtagtcccagctactgggaggctgaggcaggagcatcgcttgaacccgggaggcggaggttgcagtgaaccaagatcgcgctactgcactccagcctggcgacagagggagactccgtctcaaaaaaaagccgggcagaattaatgattttgaagctccgagaaacaggattaaattcctctttcaaaccgaaatcggaatttgattttttaaaagtgtaaaataccataaacttttaaggttagttgttcggtaaccatgtcaccaattttaaggcactttctgagttgtgtatagtttctccagagccctaggggaaatgttttgcaaaatatgcacgtttagctttccaaaacaagttgtcttttttatttttacttttttacgttttaaaatgtgtttaaagggagacatcacaaatgtgcaggagaaaatacaggggtcggtggatttattatcttgtagtgataactttttgggtgtatgcatatgtcagaacttacacgttttacacttcaaatatgtgcagtttattgtcaactatatgtcagtaacgtttttaagaagtaaccaaaatatatttaatactaccaaaaaaaaacacggtaaagtataagcagataaaaacatcataaatccttgatgactccccccaaacccaaaactggaacattactaaaacttgcatttgtctatgagtttcttatctgtgcagtggattttgtgtatgtcacttccttgactttttgaaaaatagttttatcatatatgtttgtatgccgaaactgtgtggcatttaatttgtttttcttttgagctttataaaaatagtatgtggctgtagtttatttcattgctttatgatatgttaatctgccataacttatgggcacttcgaccgtgtttttattgttttttattttgttttgttataagcagtcttgctctgtgaacatttcttgtttccggctcttggtacacaagtacaagaatttctctagagtaaatacttaatgtggattgcattagacggtattaggtaatcaggactagaatagattgaattacttagaaataagatgaatgaaaaacattaggattctctattatgtttaaatagaagattcatagccgtagtgattgaactagttcaacctagttgaacatttgcatgaaaacccaaaattcctgttaacctatgtgtaatgactctcttactttgaagtcacattgtaaaaagtctggcactgtttggtatctccttttcaatgcaaaaatagtatagtagaaaaaacgctggattgtatgtaaaataaattatcctttctgctgttcctctcctcccctctaatctctagcaaattacttaaaaatttctcttgtgccttagcatactcatgtaaaagaaacttgtcctaagcttatccttccacttttgcacagactttaattaaggaaaacacctgtcaaatgtcacaccctttaagggaaagcattaggaccaaggtgttattctgtggaattaaattttgtatcctttggaacatttttggaaaagttgtgtggtggttcaggatttgttaactccatatttaaatatgttttagattagagaatgcccacaaggtgtgtttcccgaggatctgtttcattatgctaacaggaacacagcgacaaattagggaatagtatctccttactatcctgaagataggtgtgtttttatgtgtttcatgtttcattcatgtatgtaagtgtgaatttacatgtaattttgaataacctttttgtttgaaggcatgggagtagagatggtttcattttttctatatgtagcttgcagacaaatatcaggatgctttgttttggtagggctgtattctgcttttaaaaaccttattttttatttaattataaggacaatgtgtatatggggttttccccctcaaacttgagaaagaatagaaagttactaagaaaagccacctataacaccatgatagataactattattaacattttgtcaggtatacccctggtctttatgtgtgtattcttaatatcctaaactattaagagtccattctaaacactctcagcctggctctttcttaagaacttaccgaaatgtaatctgcctcaccatcttatttcatataagatgataatagaagtcatctgttaccattgcttcaacttttctactcttctgcttcatttaaatgtgtaaatttgtaaattacagtatcttactctctgactcaaaacctcccagtagcttttcaatataccaaataaaattgaaacctcttactgtggcttatatacctcagaccagcaaagtccactagaaatacaacgttagtcacaaatgggagctacattaagtaatttaaaattttctggtagccacattatgaaaaaaagagaaactggtgaaaatacgttttatgtaacccaaaaactattatttcaacatgtaatcagtataagaaattgttgatgggatagttgtctttttttagactgtctttataatttggtgtgtattttccacttaaagtacatctcaattcagactagctacatttctttttttgtattttttttgagacagagtcttgctctgtctcccaggctggagtgcaacggtgcgatctcagctcaccgcaacctctgtctcctaggttgaagtgattcttgttcctcagcctcccgagtagctgagactacagacatgcaccaccacgcccagctaatttttttttttttttttgagacggaatcttactctgttatacaggctagagtgcagtggcacaatctcggctcacagcaacctgggttcaagcgattctcctgcctcagcctctccccagtagctgggactacaggtgcatgccactacacccagctaatttttgtatttttagtagagagg

SEQ ID NO: 80901 - DNA, 1082 bp, Homo sapiens
tttagaaatgaaataagctaactcttaattttaacctgtttgctacctaaaatggtaatcatcttgatgttctttcaagcaggtcccagagatcttaaaatgatccggaatcactgagtccacagttctcttttctcttggttatgtatagatggagagtggtcttggtgttatattagtgtatgattcgtatttgtttcataattaacttcgaagtgaaaaattgatgcgagagcaaaggtttatttggtttccataactatttactaattttatgcttgccagattttaagattaaactgtttgccatctcttttttttttcttcccgtaaaacctttggccatctacagtcacttttcctcaaatcttatgctgtaattcaaactgtatattctttttgctgattgcttctgtacctcctctgcttccagtgttcttttgcaagagtgtccacacagtgggaagaaaacctgaacttgactcatgaagtgctgggcattcaaaacagtgaatccttgcaaaggatcttgggagtagacccctgtgaattggctctttcaatttgtccacttaaagggcataatagattatgcagctgtttgggcttcagcagggtattgctccatattcatgcctagttgcaattatgtgaattttcagtttgttacaaagacttccctttgtattcaaaacaattttgttggctttgtgttctaatatttgagttttctctgaggaaaaatagttgcaagattttgaactttgaaaacttcaaattaaaatgtttaaaggttttgtcactttttattttctgatgcaaaccatacattgaaagcatattttaagaagaagtcactctaataagctttaatttcgagtttatgaatcacaggatttttggtagaggtaaaaactatacttacaccgtaaattagacattaaatgccatttaatcagtcagataatgattaatgttagagtaatgtttgatgggccaagctgctaaaacataagcagttctaattaaaatatataaacttatcacgtaaaaatagcaaacttagtaatgtataaagtgac

SEQ ID NO: 80902 - DNA, 1049 bp, Homo sapiens
agtgtatttcagtacaagaatattttttagagactgttttctttatattgttgctctttgttctcatagaaattaaggtataaattgcaataatcattgcaataatcagaccaaaagccagctaagcattttcagccattgtatttgctatgctacttgttccggatcatgcaaaggtttttaaattaatgcttttctgctatatctgttgtttaaacaatagtgtaataataatgaaatcaagaaaagttacctatctacccaccagcagatcattgtttggtcatctcatttttttcctgttcccttctctgtcttatattcttgcagttttccaataattatgaatctgtgcagttttatgttttcacttaactatctgttgaaattgttttcatttcagtaactatgtaattctcttaaattgatgtgacctgaattaacctagttttttgaattgtctacttttaggttctaatttttcgtcatttttaatagtattgcgttgaacacacctgtgtgtagctgtaaaatattttcctttttaaaaaagatttcttttggaaaaatcctggagtggctttacctagatcaaaggataatgaacacttcactggccaaattgtttttctaaaaagttataccagtttatatcgacaccagcagaatatgcttcaaagtttttctgatgtgtagccccttaaatgttctgttaaagtgtgcctatggagctctctgacttgttgattagtttttgcctaaaagcctattttcaacaccactttccaagatgtagatggatataaagcaatttttctggatattaaaatcagctgagggaaattggaaacacttttacccacttaactgagcaattgtatctatgctagatattttatatacttagtgtatgtgttgctattagtaagtatggggcttaatgttttacactggctttgttattcaggctggcttttctttttcttctggtaagcacataccagaagaaatattttctttcaagaaaatatatcagaaacatttttagg

SEQ ID NO: 80903 - DNA, 2230 bp, Homo sapiens
ctttttggtttcctagggagagtggaaagtagttttctacaaggagaagaaaacttttaaattgacctaggtatttgggtcaagatatgaaaagtgatggttgcgttttatttcaaaaataatgtattcaaagtctctgttgttagatgccattcaagaggaacatagtgatttttttccctccaaataatatgaggaaaaaacttaatgggcagtaagttgataaaacttgaaagaacctagagccatttttgtttaaacctattaatgctaatttttgaactgatgtgtctatgaacttgtttgactaaatttggttttctgtgtttgtatgccatcggagaaaatgaactcgaaacagttttgtcgttagtagtgctttggtagaagagagcagatccatctatccctgtttataccttttttccccttcgcaatataaataccctgtgtcatctgctaccaatagatttttgtaagtactagatttctcagcaacatttagtgccattgactacttttcctgcttgaaactcttctcattattttcatgatactgtctgtgctttcctcattagtgatctctgtgtcttttgcaaatgtttctcctttacaaccattaagtaatagaagttcgtagcattttgttcttaactcttctctagacttcccttttgataatctccagtcccatatctttaattagcatactatacatattaatggttccaacgtctgaatctaaaatccaaaactttttttgtacctgagacccatatttatccagctcaccaaaagtcacagcaaatgggtgatactgccacccaagccagaatctgattgtcattctgattcttcttcatcaccagttagccacaattagcctataaattttaaattcagtgtctctagaatcaatctttttttttttccttcacgtgttagcataaggccacacggtatgatttcttagatgactaaacacccccctaattgatcttcatttccattttaggctctgtataatacattctttactgtgcggtcatatctgtttttctctgcttcatattcgttagtgaatactagctagagtgaagaataacaccagctgattctgtgctaaacattctctcagatggtccccacgctaagtactgttagtcttttcgaaccagtaagtcaatttagaaaggctagctaatttgtctaaggtctccttggctggtaagtgactagcatactttaaaactgaggtttgtcagactggaagtcctttcctttacacactgagctgtgtgctttcctgagcttacttctctattccttttttccctcacatcattccacttcactctttaaccaccagctatttgtaattccttcttctaaggcatagtgaaaacttgctgcctgtctaaaaatgctttaagggaaacaaacattaaaaaaaaaaagtatttctgacagttttttggaacactttgataaaggatattaaacattttagcatccccaggatacaagaagataaaagaatgaggcacaggcaaagtaaaggtagttttccttatgcacatagttttgagtttcatagctgttgaattcctcacgtttaataaaagcttgagaccaagctgtgtagtgggaagattaggcaaagtgcaaaagcactttaagctatttgaaatgctaacaactccttaaataactgttggcttggaccttgtgctcattctgcatccgggtgtataaagcacctgcctgtgaacaaaagtcaaataacttactgagtaacttatacatagggtagagaggctacatagattattttgcatcaaatattctatcatcaaaaaagttaaataatgcagacaacattacttacaaataaaattgacgtgaacagaaaaatagttgatttggaatcattttcatttaaaatattttctctttgtcctctgtgccattccccctctaacatattttaaagcaaaaggacctctattggaccaaaaaaagaaaaagtagcctttttattcatagctttgaaagcaacttggtggtaaaggaaaaaggtcaaattgatgaaacttttgaaatacaggtaaatattaccaatgtttgtttctttgaagggatcaaattattaactatagttgggaattaaaggtaattataagcatagtaaaaatccatgaattacccattgtaagaataggagtgagtt

SEQ ID NO: 80904 - DNA, 1124 bp, Homo sapiens
tcttgtaccaaagctgtgagatcctttgtgagtaggggccatattctgtcttcgtgtgtgagtgtgtgtgtttttttttttttttttttttttttgagacagagtctctgtcacccaggctggagcagtggcacgatctcctcactgtagcctccacctccctggttcaagcaattctcctgtctgagcctcccgagtagctgggattacaggctgtgccaccacctggctaatttttgtattcttagtagagatggggttttgccatgtttgccaggctgatgttgaactcctgggctcaagtgatctgcctgcctcagcctcccaaagtggtgggattacaggtgtgagccaccactcccagcctagcctttgtgttctcttgacctagcattcaactatatgttgaattgaaatgaatatgtaatctctgccttctagctgcttaccataggctgattgatgatcacttgtatagactccattgcctgtggaaatggaatagctttccttgtaatactgcctgagctctgctttccacccagtccgttttagcctacttgagccctggaccttgactgctgtctggatgcttgaactatgttttcctttttatttttctaatcatctagaatccagcctaactctccacccttctaggtatttatattttaagagtatcagtctacttgtgactcttgagtgcactatgtagaatcatggtatcatgttttatttagtctgtaatatccttcatcctcattcaaaatattaaggtgagtctcccaccataaaccaaaacaatcctttccctataacgaagctaatcactgtataacttctcttccttgtttctatttgtgttgtttcatattatattgtgacttgttaatttgtctgttttcctgagtagcagccattccttattcaaatcatactgctcagaaactttttcatttcagcttacgtagctattaagtagtaaagcaagaatttgaagccagatgtacatttttttctgtatcctcagtatctgatagtacctaagtactcaagaaatgcctcttgaattgaccagtgaccacaactctgtcagaatctgcatttcattctttttgatgtct

SEQ ID NO: 80905 - DNA, 1086 bp, Homo sapiens
gacagaccatttatttgtagaatctcccttaatttgagtgtatctaatgtgttctcatgataaaatttaggaatgtggttttggcaggaatgttacacttgtgtgcttttcagtgcatcacattaggaggcacatgtccacttgtttccttatcagtgatacttacttagatctttaggttaatgtgatacctgccaggttcctctacttaagttaatatttctccttctgtaatacataatttgtgggaagacactattagactcaatatataccagtcctcatcaaactttcattcacaaagagttttaacattctttggtaactttgtctaaatcaaattattactagatggtaataattcagatatttaatggatttagatatttaaccgggtttaggtatttaattgtaggagctcagtaccatagtaggaaccgctttgagctgttggattctttagcattataaagtgctttgtgttgaacaagaatgtctcctgagacttctatacactgtttcaagttctgtactctgtaccacgtgagatgagcctgctttatttgtgtctctctaactgcccttcaaaatgtgttcttttttgtcttttcgataggttacttgctttaatttcatatagtcacttcttgtaagagatgactttcctgaatttataaccatcctgttggttttctgataacattcattcatcagtatcacacttaacatatggtatccaaatctggatactaattccagatacagtttgatctatcagtacaatggatcactgtttgcctgtaatctagctttatgctcaagagcaccaggttttggagacaaatagatttggcttcaggtcctagctctgccacttaactagctctgtgatcttgaaccagttcctaacatctccaaacctgttttgtcatctgtaaagagttggtaataatagcacctgacttttaaggatggaatgaagattaagcgtgcatgtaaaactctcagtggtgtctgttatatcgtaaacacctataaaatgtaaattatttttatgcagaaagcatgcttctgttttattgccca

SEQ ID NO: 80906 - DNA, 1028 bp, Homo sapiens
ggcgtgatggttgggtgcctgtagtcccagctactcaggtgactgaggcaggagaatctcttgaacctgggaggcagaggttgcagtgagccaagatcgcaccattgcatgcactccagcctgggcaacaagaacgaaactgtctcaaataaataaataaataaataaatacatacatttatttttgcagtgcaaactgtcattatgactgcctatgtaatacatatttgctaatgggatggagaaacaaagatttttatcttgtaattgtagttcttaatttacagactttctgtatttttggtattttgaaagttcagtttagtagaatagttttttttttttatgggaacaaggttttattttctaggcaaggcttctaacacttgattaacctgtagtaataatggtactgtagaaattttaatctgtcaagaaatgtgctataaaccatagaaaatgtcagcaacatggctcctcctgctgtcacaaaacaatctcattctccctagtccggtgctatgacatgtatacttgagactctaaaggcattccactgactgttggtaaaagtgttctttagttggtagctgtttattctaaataaattagctagacttaaggaaaacagaaaaatacctacttttgcttactttggataaaatgattatataaagtaatccttactcacctagtctgtggccaggtatagaaaatctatggattagttatatgcatattgttaataatgtcaaataccaattggaatgtttttatttttcactttttcttcagccacccttttaacctagctataatagcgaaagcactccttaaaattttaggtggttaaaatgtggtacgtaaattttatatgtctcaactctgtttcatgttaaatgtgttacaggaatgaatctgaagtctgctgcagtaaaacacagaaggctttaaaatgttttcttgcataaaattcaaaacttttaagtagctgcttatgagaatagggaaggcagaaagctaatgtc

SEQ ID NO: 80907 - DNA, 1520 bp, Homo sapiens
ttgctctaccctttaccttaccacaatagtgtaggcttctcattgatcctgtacgaaattctgtcatttggttttgcttagatttttaaatgtatttgagcttgttttactgttgtataatgcagtatattaaaatgaagtttttgggctatataaggccatgtaacatggtcatgtacacaggctatagagtctggctgcctgagttcagatcctagctgtcccttctaacatctctgtgatactgagcaaatttcttaaaccttcctgggcctcagttgtgtaatctgtaaaatagatacagtaataatttgctacctggtgggatattgtgaggttgagtgaatcatcagtgcttgcaaattattatcattattaaacctgtttgttctttgagaggaggaatactaggtagcatattataaatgctcaaaataatagattttaaggctttaggattaagaatttgaacattacaaagtaggatattttcaattaaggtatcataagaaacatctcaagaagagtagaatagaaatctttactcccggctgggcgtggtggctcacgcctgtaatcccagcactttgggaggccaaggcggatggatcacaaggtcaggagttcaagaccagcctggccaacataatgaaacctccgtctctactaaagatacaaaaaattagccgggcatggtggctggcacttgtcatcaaagctactcgggaggctgaggcaggagaatcgcttgaacccgggaggcagaggttgcactgagtggaaattgcgccattgcactccagcctgggcgacaaggcaagactccatctcaaagaaaaaaaaagaaaaaatctttactcccctgccttcctgtctcaatctgctgtgtgcattagccccatttcacattctcagtagctacatgtgactgatggctactgtgttggacaacactgttctagatagttggtttcactaggtaatgtatttgcattaaacatgacatttattgatgacacaattctctttgtctggaacatgaaagattggttcttgtatcagatataactccaccaagaaagagaagaggaagcaaaaaatatttcttcaagaatcttggtgaaggttaggtgtattttctctgggttttatgtaaagtgtttttttttttttttttttgagacggagtcttgctctgtggcccaggctggagtgcagtggtgcgatctcggctcactgcaagctctgcctcctgggttcatgcccttctcctgccttagcttccggagtagctgggactacaggctcctgccaccacgcctggctaattttttgtattttttagtagagaacggggttttttagcatgttagccaggatggtcttgatctcctgacctcgtgatccgcctgtttcggcctcccaaagtgctgggattataagcatgagccaccacgcccggccataaagtgatttttaaacaatttataaaatttattatagtgtagttatttttattt

SEQ ID NO: 80908 - DNA, 1023 bp, Homo sapiens
tttgagaggaggatgttagaaaccattccatcacacttttaataaaaaacggtatcatctcaggtggaagtgaggcctattcacagatctcctaacaggtgattactgtctctgtggcaaggagaacttttatgaacctgccctttgtgagctatgggtaaataaggagtcttggatttatgactgcagctactattaaatagtggacagtttgaacctctctctctcatgatgaactgcagatatgtgacttaaataagccacccaattctgaactgagctttatattgcaacttacgggttaaagtattttcacaatcaccgtcccagttgaccccctcaaaattctatgagttagaaaggacaggcatcataactatcttaaatgaagtacttcaggctaagcacttatctaagtaggaagtttatattcacaaccaacttgaagatgagtcagttcttttttctttttactacatatcaagttgtccctgtatatataacagttgttttgcagtgatttgtagttaaacttcctttcatgatgcatttgttagtcatccctacaaggtgtgttacgttttaactgaaagaaaatcagtttctgaagtatcttgcaatcatttctggcatccatttttatatacctctatgaagtgagagtggtgtattctaaaactttgtggttttgatacttaacattttgtggttttgtggctaataaagttgtaattttggagttagatgtgatgtttgtgcagatacgtgaaaatcagacattagtatttctgttcttgtacctacattgatgagagcagaactgtgtgtcctaaatatcttttacagtgtttaatagctagcggagtgataggtacgataagtttatcaagatatccttgaacaaagagctatgacaaaagaaagtacttgcttatagtcatggaattttgctatgtctttcctgataatatctctaaccaaaatagttgtgaaatcatttattcatccagcatgtatttgagt

SEQ ID NO: 80909 - DNA, 1851 bp, Homo sapiens
aatcaagatttaataaaagggccgggcgcagtggctcacgcctgtaatctcagcactttgggaggctgaggtgggtggatcacctgaggtcaggagttcaagaccagcctgatgaacatggtgaaaccccgtctctactaaaaatacaaaaaaatcagccaggcatggtggcggacgccagtaatctcagctagtcgggaggctgaggtaggagaatcacttgaacccaggaggcaaaggttgcagggagccaagattgcgccactgcgctccagcctgtgcaacaagagcaaaattccgtgtcaaaaaaaaaatagatttagtaaaaataatttgtttcatcaggaatactcagcaagtgaaactggttttttgttttttaactgtgagagtatggtgatgaatataatgactactattaggtagtcattacataatgacatcaccatattatgtgacatctccttgtcatataacgacaactgtactattatagtatggtttggtgccgctgtcttgatggcatgttaaagctctagctgttttacccttcattgcttttacactgccaatgcaaatgtcaacacagtgaataagacgaataacaagttcttgttattatgaaaataggggctgggcgcagtgtttcatgcctgtaatcccagctctttgggaggctgaagcgggtgggtcacctgaggtcaggagttcaagaccagtctggccaacatggtgaaaccctgtctctcctaaaaacacaaaaagtcatgatgataggcacctgtaaatcccagctactcaggaggctgaagcaggggaatcacttgaacctgggaggcggaggttgcagtgagccaagatcgtgccactgcactccagcctgggcaacaagagcaaaactctgtcgaaaagaggagaggagaggggagaggggaagggaggggagaagatggggttgggagggcagcggggagggggaaggacctctgaaaggatctcaagaatccccaggagtccacagatacgctttgggaactactgatttagagtgtggactccagccaactgcttgggttgaatcccagctcctcacttactagctgtgtgtccttgaacagtttatttctctgtaaaatgagagtgctaatagtacctacttaataggactattatgaggattaaagggattggtatttataagtgcttggcacataaagttctatataagtattgctcagtaaatggtaaagcaagttttcttctgtaaaaaatgtgcagtttcatgagcagaaaagatataaatttagagaatgaccatatattaaactttaaaattagggaaggacattcatttacaattgaagatttaccttagggggagaagagattttttaaaaggttttgggtggaggggttggggggaagtacaaagtctacatagttgaattaaaagctttaagggcaaagagggaataaaaagccatagatagatcgatcaatctgtggtaatcgtgagaagaaagagaatgaatgtccatgaatgtggaagccagtgggaaaatttgaacgggttcctctttttgcaaataagaatattgggtggccttgtgctggtaaaaactgtgccttgttctttaaggtatgtgatatgaaacctaggtcagtttgagaatatgaaattcactgcaacttaattttactaatagaattactgtttggtatgctaaattagtcacattgctaaatgaacctctttctgagtaggctgaatggaaaagatgcccaaaagcttggagcatgaggccaggcatccttgtttttttgttttttttctttttttttggagtctca

SEQ ID NO: 80910 - DNA, 1053 bp, Homo sapiens
tgcccagtagggccctagctgatgggttttaatttgaggaacatgagtccaatattgtcagatcttcctatttttcaacagaagaaatctggaattacgtgacattccccaatttttgaatgctagcaactaatttttttaaaaaataataggtactggccaatcaaatatggctatgggtcagatttaactgaggtttgctagttcacaacttctttggactaattcatcattataaattatattttctccctatttttttcgggaggagggagaaaaagaatgaagtgaaaaaaagtatgcattttataactgccttgggctgttggtcattcttgctgaataactgtttcattttataaattatgaatattgcagtgtgaaacattctacatcagttttctccccttttcaacagaatatagccgttttttgcctgacatgaatacttgtgacaataatgaagtgtgtttactcaacaaaatattttgtggggttcatgttaggcataaagagggtttgaagaagaaacttagagtttagctgggaacagagttgtataccagtgagaagaaacttagagtttagctgggaacagagttgtataccagtgaagtatttgagtaatggtacaattaagtgccccaaaagagtggtacaagcagcttccttaggaatatagagtagaagaggcttgaggtggtcagaaaggggcccagaagaaatagaatttaagctgatttcctgaagtagataggattattacaagcagagtacaaaggtagatgggatatactaaaaaaggcgcaatatgagctagaagcttgtttccaagagtgagcatgatttgtttcaatcagatggaagcaaaagaccctctgcttttaggaagaatagagtaagaacagttattgaaattttgctatgtgccacacactatttggatgcttttcatatgcattatttaatctggttagataagtgatgtaagtgccctcttagttgaaaccagggaaatttagtaacaagtccaagcttttacaggtaataaaa

SEQ ID NO: 80911 - DNA, 1044 bp, Homo sapiens
ataactgttaagtattgtctgggatgttagagggagtaataggttggggatttgactacgaatgttatgaacagtcaaaagtcacattttatgaattctcttcaattcataggcttttgtttattataccatgctaatcatttttaaagtatctggtagagtgatcttactctctgtctctggatttgtggttttataattccacagtgcagcagttaaggaattgttctgccttttctccccttatcccttttcctccctgatcatttgaatgccagactgattgccccaaaaaggtatagtagcaaagggagggaggcaggacttccagtttcttcatagctaccccatctatgccattacacattcagataaactaaattactctttatggttttttgtctttttcagtctttctgactcttcatgtaaaggtacattttatggcctaacgattaataaataagactgattcttttttttttttaagaatcctgtgagaaaccctttgtgcctcttgagttatgaaaatcattgttaatttgatgccgtgcaggcagtttgacttgggaaaattggtagtgttacaagttttcaaactttaatcttaatgttttgaagtaattgtaatgaaaagcttagtggtcatattgtactttcatctatgactttttacttgagtttttatggaaatatatttatccttttactgtttggttgctagccatatatttaccagtatcattgggagagttcctttaattcctctcttacactttaatgttgttaataagcagtatagcatagttggtggtttagacccgagttcctcagtcttttttctctattttttccctaaggagcctttttaggttttttttttgtttttttttttcttaagtggcccccacctccagaagattttaactccagagagatattgcaggtctgtttatgtattttatgtatatctgtgttttatacaagagtaagggtttttgtgaccctttcctccaaaaatcagtgttttctcccttgaggggc

SEQ ID NO: 80912 - DNA, 1100 bp, Homo sapiens
tcttcaccagaaatgatactatgtgaaatgcttttgaaacagaataaataacacacattagcacatgaacttccagcaaaagtttaaatgcttagatattagataatataacatacatcaaaacttataatgtatatctcttattactaggagggtccaaactgagctagacttaataagttatccttgaccttctgggggtagagtcttcaaaacagatttctttctctaggagttctttatactttctgagcctgtacagacttggcttatgtagagtgggttggagataaaaagttcaatgtgtgtccttttggtttttatatttttctctcctttttagccctatgtcttgggacagttatgtagaatagtttgatatatgtgggcttttttctttatcatataaaagcagttttggataatgtgtgattggaagttacgtgtctgagttctttgctaattttatgtaattttcaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctggtaagtaattctagtgaaacccgtctatattcataattgaaatacaagtggatatttcggtatacccaatacctttttctgctctcacattatatttatattaccatattcatatcagtaaaatttctcattacacattgtgattataatcagtagtgaggagttaggaatgagtatcatcactcattgaaaatactgtaaattcataccataatcttatttctgtggctgtggaattctgttactttatttagaggggacacctcaagtgtcttggaaagtaagggaagagagtgataaaagaacctttgttcttttatctggtgtgacttacagctcaagtagttgttgaaggaaggagtggattattgataaccacagctcagtggacttgagaggaagctttactccattaggaaggaggagtatcgtggattaactcatagtaa

SEQ ID NO: 80913 - DNA, 1051 bp, Homo sapiens
atatattttttaactctgaagtcacatcatttagaagcctgcatacagcaatactggtttcatttttattctgcttttaggaaccaatatattaagttcctacactggggttccttttttccagttcatgataagatatgttcagttttgctatgccagaatatcatttacagctttgtcttagggttctttaagcatgtctttatcatgctagttttcatttagtgaattcatgtggtacttgaaatacacaaaggacatatacactgttgctttgtttccaaggcagtaaaattctggtccaaattagtctctagttttaaagctctatgattatgtttaagttattaaaaaaaagtatgtctgtgttctcatcttaattatctacttagatatgttgaactcttactgtgtcacattagttaatattcatgtgtagagatcaccttttaaaatgaaatattttgcttttctagccctgtatcaaatcagtcacttttatcagaatctgtagcatcttctcaattggacagtacatctgtggacaaagcagtacctgaaacagaagatgtgcagggtttgtatatgaactagcatgtattttgttatttgagtattataggccagacactatcctaggtgcatgtataaaaaaattgccagcttaaaatacatgtttttctgttttccctatgaacacaatactttatatctttaagtatttaattaacatgttggggagccatttcacacttacatgtaattttatcatcagcataaatgttgcaaattcaaaatttgtttagtttggaaaatataattaaatgaatgtgtggcagtgttacactgttctcttttactattttggccgtttcagtctatatactactctgtaagaaaactggggctgctggtttgaggggcatctctttcttttgtgttttgactcattatctgagagactgtgtccatcgtgcctggcagttctccttttttcttccccatgtgtgcaatagtcacattcagttgctcgtattcacagcatggtatc

SEQ ID NO: 80914 - DNA, 1001 bp, Homo sapiens
ctcgtttagcaaactacccaggtatcagttttcttcttcctcactccatatgcttccctcaagggaaatttatatagataggaaaaccatcccaaatggaagaaggtatatgagtagcagctatatgtctaagccagaagtttgtaacattttgtaattggaacattcagaacaactttttctctacatgtattctgcttataattaggatatgctgccaccaggttggtggtactgctttcatattggccacatggctctgaagaatttttatgtttcattgagaatttagcatattgaagcatgtttcttagttgttctttttgatttaaaaatatagcagtaccttacttacatagtgtcactcaggagtataagtcaaatttccagttcacaaatgctagcttttaaaagaactactttaagcattttggtacactctaaaactgttgaagaatatgcttaaatttggtcaacctcttagtccctcagatcttgggtcatagtagaaaaatactgaatttggattcataagttctattttcctatcttggtatgcctgcttaacttcactgagccttactttcattactcttaaaagagaataagaatgtccctcttacagggtattaaaagatactgagataatggaggttggatgagctttgtaagctgcagaagatattctttatattgcccaagtgatttgggagttgtaggaggcctagagtaagagagaattttgaagctttccaacactcgaatgatgtcatatgttaagatggtaaggtctacatcactgaagcattctaggaaagatgagttgatgttagagaccatatagagagaggaatgctgtgcttagtgacaggatgaactagaattctcaggctctttcctactctgagggtttctgactttatacaaagttgaattgtcaaatcattggttcagaaaaatcagagggggacagtctctttggactgatttaggaaagctgt

SEQ ID NO: 80915 - DNA, 1242 bp, Homo sapiens
ttcagatggggaataaggtaaccatccttctcaatggccttacggtgtagttggggaaatgaggcacataaataaaataggtaagtaattcaattcaacagatacttattgtcgaatgtctgctatgtggttggagacactgggataggcactgataatgggataaataggaccgatgtctcccctcaaagaattcaaagttaaaccaagttaagccaatgagggaattttaatatgaaaagtgctatacacagggtttcccaccccaaggttgttggagaggcagtggaggaagagctgattatataagcttaaacaagaaaaacaagttagagttagcctgataaaaagagggacaggaggggcatagaaagagtattttgtatggaaagcacaacttatacaagagcccagaggcaaaagagagtttgatatgtccagggaaactgcaagtccttcagtatggctgaatcatggagtactgttgaggaatagtgagagatgaggctagagaaagaaggatgaagaaaatcatgaaggacctctgggctttatcctggggggtagttgggagccattgaggaattctaaacatcagagggaacaccattagattttcacttaaggcagatgattggatgcaatgtgtgaagcatggattgtagagggaactcatgaggtgcccagtatttggaaaaggtgttaaggaaaatcagagtgagaagctacagagaattgagacaaggaaagggtatttgaccttggtcttgaaaaagaggaggacctagatcaaatggggaaaaaggaaaccctttggaatagattctaagaagtgtgagcaaaggtacatggcatattcccagtgtagattaatggagcagtggatccctggggaaagtctagttggggataaaactggagaggttaagaatttgatccatgggaaattccaccattttagagcaaaatgtcacgtctgcaaggtcatattatatgattctgactctggcgacagcattcatgagggctagagtagttagcaactggagggaggcatgttaagatttcagagtagtaatttaacccgaatcttggtaaatctggctttggtttccatacataaatgcatcaacttattatcttacaacattttaaagcttctttgcttcaatttgccttatttctaacatttaaagtgcttttatgtgaaacattctgggaactttaaacatacttaatatt

SEQ ID NO: 80916 - DNA, 1050 bp, Homo sapiens
gtttcaccttttccctcctcgttctctgagagacctatgtcattctgaccccgaacaatattaagaactatgcatatggctattgtcttgcacactcccttagaatattcaagtagtatttgtttatgtgccttttattgattaaatttgtagttactagaaaaattagaaagtacagttaaaacctaaagaaagtctataaaaccactgttaacatatcattacatattctagattattttctacatgcatatatacatacatttaacaaaaaggggtcatatttttgtaaacaactttgtaatttaatgactagttttctgtgctaataaattcctcagtatcctctgaataatagactagggagggtgggatgaggaatagcaaaatcttacagaataattaaattttgccaccttcgtatttttgttagcttcagtatcagacacagcacagcagccatctgaagagcaaagcaagtctcttgaaaaaccgaaacaaaaaaagaatcgctgtttcatgtgcaggaagaaagtgggacttactggtaaggacctaaatcaaatgtttaaaattaaaatgatgttttataataatgcatagcttactgttgttgacttcaattaagattgttcctgttcccttgagagttaatattggatatacttcaccttctgaattttcttaaggaaataaaaatagctttgattatacacctaaaagtgaaatgaatagcttttttaaaaaaagttttatttcagttgaatttagaagtattagacaaataaggttagtgtgccagattctgtgaaaggtcaaagatgtggctcctgcttttaaggagagaatattttgaagtacttggtaaactggaagtactttctatatataaaatagggctaatcatacgttgttgtgtgggttcagtgagttaagacatgtaagcagttagcccagtgctgccacacagtaagtaattaatatatgttggctactgtaacatagctatcagatgcagatggtggtgggagggagaaagaaatgttcaaa

SEQ ID NO: 80917 - DNA, 1232 bp, Homo sapiens
tagtgtttggatttgaaaaatgttttacattttcaacctagcaactgtgtttttgttaagaagtaattgttgccatatcacaggtgaagaaacaagctcagaggactttctctagggcaaacctgcgtttgtagataggaataagaaatgaagctctcaggtagtgaataagaatgtagtttgtgagacagtgtatttagaatgattctttagtttacattgctgccctaaatatattgtgctgttcagtattaattatgccaaagaccttaatatttcatccttcaactcatgtatgtgtattactccatttccagggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaatgctcccttgtat

SEQ ID NO: 80918 - DNA, 1445 bp, Homo sapiens
gtctcttataaggacatttctaattggatttagggcccacctggataattcaggatgatcgtgtctcaaaattcttaacttgattacatgtataaagactctgggagttaggacatggctgtatctttttttttttttttttttgagatggagtcttgctctgttgcctaggctggagtgcagtggtgcgatctcagttcactgcaacctccacctctcaggttcaagcgattcttctgcctcagcctcccgagtagctgggactacaggcgtgcaccactatgcctggctaatttttgtatttttagtaaagacggggtttcaccatgttacccaggctgttctcgaactcctggcctcatgtgatctgcccacctcagcctcccaaagtgctgggattacaggcgcgagccactgcacccagcccagaattttcttcctttttgaggctgaataatattccactgtatgtatgtaccacagtttgtttatccattcatctgtggatggaaacttgtaagcacctgttgatttttgagccatgtgtatgtggcgactctttgtttctagtttttgaagtttttaaagttaattgacaacatataacagctctgatgccctgcattctcttgccttcctttctcaggctgcacttaccagtgggctaccatggccgtgcctcctctgtcgtggtgtctggcaccccaatccgaaggcccatgggacagatgaaacctgatgactgtgagtgaccgcagcgtccaggccttgctggtacccagctctctgttcccacacagagagttctgtggcctcactcacagcaccgttttttttttttttctggtgttattccagctaagcctcccgtatatggtgcctgcaagctcttggacatggagctggaaatggtaagtgagcttgatgttttattgccatgggatctatagacacccggcaggagagccctttgggatggctccccgcaccatgagccgcccactcccctcctcttcagccacatcggcagccgctctgtgtccccacctggccatcagaaggacagttgatccttattacttgcagattctgtatttgagaattcacaactacttgctaatatttatttgtaagtccagaattaatattcacagagcttttgtgggcatgtgtggacatgcgcagggcagtgaaacatttgagctgcctggtgagcatgttcctaggtgaggctggacaaggtgttactctgccttcttgtctcagcttatgctgtaaacatgtgtcctttgtagtctattcggtgccatgttttttgcagatctgtgcttttttggctgtttcattgtttttttataatgaccccaagtgctgtgctaaagtgccgtctagtgtccctagcacaggaagactgtgacgtgccttatggagagaatatgcgtgtt

SEQ ID NO: 80919 - DNA, 1058 bp, Homo sapiens
accttaggttttgtgggtttggaaatctctagtgaccaagaggaactgcttccaccagggaatatagttatgggtctgttaaattggaagatgatcttgtgccatctggggctccttatgttgaaatattggcagagaaagagatcactgcactgtcaggatggttaaccccaatatccaagggaaagtggggtttctgctacacaataggggcaaggagtactagctttggaaccctgggattcgctagggcacttggtactccctgtatcccttgtcctcattctgtaagcctgaggtgggggcatgaaattagatttctaacaagctccccagagatgccaatgctgtccatccgtggaccatagtttgagtagtgttgccctagagcacctgctattctttctgataattttacagagcttccaggtgagatcttcaaggcctcttcatgttctttaggaatctgtggatactgtggcaactcattgaagacacggcactaagaatttgaatcctctgtggatgaagatttgggtcattccaccagataaaattctccaacagctaagggactgccagaaagtagaggggctatggaatgggtggtgggagaacaagactgcagttaccactctgggcctcatgaccagccacagaagggggcactagcagttgtgctttacaggaagtgttccacttacccgggactggctacattatgatttaagttgcaggagggagtgggactaaattgctatcacccccagacaatatggctgctggtgagattttatgtttcccctgtgccggggacaaaatatttttctcccatctaagcaaagtttgtgaatggctgctaagtggtaataagatgaattgtgctggtttttcttcttttgctccagtgtgctgcctatgtggaccgtatcacccagggtcccctgacctttagcttctgttgtttttggccaatggaagacccagacaggagattggagggcaggaggcaagaggtcaaggtatttattcccccagctctcttcctactgagctgc

SEQ ID NO: 80920 - DNA, 1063 bp, Homo sapiens
ggaagacaagttatctgctctgaaaatcatgggacaagcataggataacagttacatgcattctcatttcaaaagagaaaaaaacagaaggaagaaaagaatcatagtcccaagaaatctcaaaatccaaccagaaaaactccattggtttccaaagcctgaataatcctctatttttgaagtctccaccctttctgcccacagctctgccctcttggccacagctcttccctcagagtcatcctcccttttttcctgaagggtagcacatatttttagctggttagttttatcagtatgttttctgcctgtagaattttgggagtccaacagcttttttttatttcattttgtctctgtcccttttaatccaagctggcagtgtttctgctgatataacatttgaaaaatttttgcggatctcccatatatgtcgtggtgatttagtccttcagaccagagagttttccaatatttttttctggataactgtatctctatttctaacttctgctgagatggctgaggggatctgcgagtgacacatctaagttttacagcattagcaaaagattgtccagtcccacctttggctttctctccagagcatactttcccaacagtgaatatcctaattttagcatcttttgcaacccagatatgcagagaatccttgagggtaaggactaggtctgatttaacattgaatatccaaaacatactatgtttcctgttgtggctttcagtggaagtttgatatcttgaatttaaaagtatggaataaatacagaaaactgatattcatctaccttggatcaggttaccccaaagcagactctgaggcagtgattcatgtgcaaggatttatttgggaagggctcctaggagaaactgacacgggactggaggaagcagggctagaagggaaagaagcccagcaagggtgcaatttcagatgaagggcaagtctcagcctgatcctgtggtgctctgtagtgtaaattacacaacagagtttttcctccctcaggactagtgagctagactttcatactcctgcaca

SEQ ID NO: 80921 - DNA, 1067 bp, Homo sapiens
gccgggcgcccccgggggcgcggagccgcagctcggcgcggtgggtggtggagcggctgtcactacgcggcagccgcagcatcagcaccagagcggcatctgcatcccaatcgctgcccatccggtcccgggcaggcgccggtccggacccgcgggcggccggacgctggcctcgcatcctcgggaacccgaagggcaggcccgggagcccccgaagttctgaaaataaccgcctttgccttccccatcccacgcatttttctcttccggtcccggcttttgtggcatcacggcgtcagccagtcctggctggtggagggctccgcgctgacggagggaaaagtttggagctgggattcaacagggtacaactcccgggactctcccctgcccgccccgcccactaagcgctggtcctttgcgccctttgcgactggctgctgtgtgtcctaaccctccgggggcacaaaacacccagcctgtggtcaccagcgtggagcagccctggtcctgcccaggtgacatcctctgctttctggtctgacctgtccccagggtgcagtctgtgacaactgagctcattaggaaatatttcaaaaatggaagagttcttgatcaagtggcaacattgacttgttttggtattgtagtagggaagttccgttttcactgggaaagttccctacctgatgagcagggtgtgggagaagagaaacgtgaacatctaagctagtacaaacttttgggtgttgtgcagaggctgctgtgggcacggcaggttgctgggtccctgtggaagatgcagggagagtcacagagggcggcccccaggaaattcccagcagagggaggtcatgtgttggagatagggagggtcgggggaggaacagcaatgcctagcaaagaaaagtgtctctcatcatagaattaggaatgaaagatccctttcatctaaggcggccagggaaggcttctggagattggacatttcggctgaaccttgaaaacgggaatgtttgaatatacagagccagtagcagaggggcattgcaggcgtaagtaacagt

SEQ ID NO: 80922 - DNA, 1572 bp, Homo sapiens
cagagtattttcactgccctaaaaattctccatgctccacctattcattcctcccacttccgaattcttggcatccactgatgtttttactgtctccatagttttgccttttccagaaagtcatgtaattggattcatgcattacgtagccttttcaaactggcatttttcacttaataatatgcatttacattttctctgtatctttcagtggcttgatagctcatttgttttggtgccgaagaatattccattgtctggatgtaccacagtttatttattcattcacctactgaaggacatctgggttgcttctaagttttggcaattatgacgaatgaagctgctaggggctaatacttactgagtaactactatgtgccggggactgatcttggttctgggatcactgtggtgagcaaattaggtataactcctaccatcatgctgcttgctagcaagacaaatagtcacaaaagagtaacacaattgggttagttatgaaaagtgtaaatgttatgaagaaatgatcccctgagataaaataaccaagggacctaaattagaggattagcaaaggccatttgaagtcagtgaaagcctctctgaggagttgacccttgagtcaagctccaaggaatgatgagaaatgtgaggaagagcattccaggcacaaggaagagccccttcaaaggccctgagttgggaagagctggagaacagggagcaagggtgaaagcggtgtgagaagctggagctgcggtagaggccagctcacgggggaccacttttgggttagggactgagacttcatttttaaaaagcgctggaaatctactgaagggggtttgagcaaggggcatgatctgacctgcacttttaaatgctgcttctggctgctgtgtggagagccaattggactgaagcgggaggaaaagtaagactccagttagatggtgctaacttaggtcaggggctgtcagtagagaatgagagagagggaggtggatttgagttatactgggggcagggatgccatgctgaacaactccaggggcaccagttacttccctgtccatcccttgggcacgacatgtcctgcttggggcagaatcatcatgacttcattgtaaggagttaggggaagagtcaaggacgattcccagctttctgtccaacacctgggtggttggaggtgacaggaagttagtgagaggcagggggcctgtggggtgtgctccaggcttcagtattggacagctgagttgagctgcttgtgcgacaagcaagtggaactgtcatggaggcagtgggacacatgctcccagagatctgggctggagaaggaaacaaagagggatgttggccagccatttaccaggttctctaaatgctttccttggggtaagttagttcacagaacatagagcttttggtccaagtaccatagttcccaaacaatgcttgcatttactgctttattgtctgtctttattgagattcactaagacacaaggtcatagggagattatttctgcatcttttccagatccagcaatccattcattttta

SEQ ID NO: 80923 - DNA, 1092 bp, Homo sapiens
tccagggtgggagcaccagaggagttggcctgagtggaaacccagctcttcgggtagagccaggccttccaagagacaaattagctgaaggccttactggtggctgagcgagggaggtggggccaaaggagaggagggtggccttccatatactctgcctgttgagtaaggcaacttcctgcctgttttggcctggaccacccaattaccctaacagcagttaaaaaagccactgaaattattaaatcactgaagggaggccaggaaagttacacagttgccctttatagaggtcagtagatgagctgagttccagacttagaggaacaggaagccaaagttaattggtgcaccaatttttaaattaatagccacacaaaatagtattgtctttcttatcttcaatagacctctaagttgggtggcaggacatgtgagaaacctgggcacagaggccaaacgtgtatccacacagtgcttctcaactgggggcatttgcaatgtctggaaacattcttggttgccacacctccagggagtaggggtgctactggcatctacgggtagaggccaaggatgctgctaaacatcctactgtgcacagggcagcccccacagcaaagagcttatccagcctcaaatgtcaatagtgccaaggttgagaaactctggtctatgggaacaaaactctgtaggcctctggacagtggcaactagaagaaaaccccaggagtttcacaaggacatgtggcccccagataataaagggctggcccctttaaaacatgtcaagaaaatgtgacagctttaaaagcaagatgatgcttttgagataattatgaaatccgtgatggaagttaatttaaatgtgaaataacagaactgcaaaaagttattttattattatttttagaacagcattgatgtttctatcccatcagcagtttgaaatgaggcatagtctggaatcgtttgccataatttgatatgcttgatggattccaagtcccccaaagaataaaatgaatgaatgtgatcaaggatcacagctgtgttctctctctcttttttttttttttgaaaatatttcac

SEQ ID NO: 80924 - DNA, 1099 bp, Homo sapiens
ctgaggtcctgggcgcagggtgggtgggagatggatacaacaggggagctgtttgaggccaccttctccttttatgttttccaactcctgctcctgagaggcagcacctggatccttacctgcgggtaaaccactgggatgtctggggtcactctcccctcctaccggttgtcgcctgtaccactctccacgctcactgaagcccagtttccagggagctccccaatcccttagtgtctgcagatacagccaacagccagcactgccatcgggccacctggccacacacctcctgccctctgcctgccctcgtccttttctcagccaggacaccccattgcctcctccataggtgccagctctgcccgaggttctctttccctcttggagtgatggaggctggcagtacagagtacccttccctttaagttttggttctcacttttgaagaaccctgagcctccaggattgcgggcatagtaacttcctcctgagaagagccgttattgggtcagtccctgcttcagaagcagcaaggtccgttgctgctgagcggaggctgcatgggcctttgaactggcttcctttcatcctgggccctggtcctccctttcccaccccttcccatagaaccatttgcctcccagtccaaacagctgcccccctcccatgcacattgctgaccccacagccctctcacattcctctggctcagaggccaggttccctccctccctctgtccacaggagcaggcagtactaaggatatgctgtccaaggccattaccggcttagaagtgggaggcgtgtgggcttcagagacagctttgaaatggccgtggatcacttggcactgattttgcacctgaataattgagaaccttgtatgtgcctcttagggcagcactcagagcaaaatttatccattcattgattcatttattcatccgtgtcaaaaatatgtgttgatggtaaaaggaatttgaggagatatgggcaaaaaaaaggaaaaaaatgtgttgaatggctagtgcgtcccagctacgatgccatgcacatgtgcaattgtgagcacattgtcttcagctaactgcaccgg

SEQ ID NO: 80925 - DNA, 1045 bp, Homo sapiens
tatttatacaccatctgactgggagagttcaaaatacatcatacatacaaggagctttttaatctgagtacatctagaatgcagatttacatttgaaagtgaacatgcggacttgagcaataagttcatgtggcatggcttatttgtagtattgatgttgttatgctgtagacgtagagatggtggtgacctgagtatcgtaaggccattgatcatgcacaagttcagggatgccagaaatgatcttgcaataggtatttgactgtttgtcctttcaaaggccaaggcattcatttagaagccatggccaaataataggttttgggcaaatagtgtagctgaagctgaactttgatgggtccctgataaatatgtttgcatatatgattctgtatcctgctccattaacttactcttagcattttcctataacattatctttgaaatcatgatatttaaaggttaagtaatttttatctgggagtattccataagttatgagcttttctctttatgtcagacttgttagttcatttggtttctgttcaacttccaactgcctttggacagtcaacatgcatcttggtcattcatttctttcccctacctttcatatcctcagccactgtgaagaggtctctgcagtcattgagaactggcctcttcccttttatacaggaaggtccctcaggtatctgaagacagttttatccctccttctgcctcaaggactctccaggccaacaagttgtgtctcactagcaggtcctcctcagtgaacccttcaccatcccatggttctttctcgtatttttgaatgtggagaatcagagctttgaaccctcctgtgtactcttccaccagcaacccatgccttgcactttctccttcagggtctgtcttactgcacagggctcctgattccctagactcaggtcttggtaggccagagtctaggttttggctgagactccttctaagacctcattagggacattcagttcactgacggacaccaatccttccaacctagatgttctgggct

SEQ ID NO: 80926 - DNA, 1041 bp, Homo sapiens
catgtgtggcatggtagttgtaaatatgcaactggcccaatcatatttttcttctgtctctaaaattttttttgccctatacagtgtaggaggatcaggtgaccaaggttttttagaattttccctttttgggatctgacgccgacacactattttgaggcagtgacatcatctctttcctctggcgtgccctccttgcggctccatcattcaggccttgtcatctctcacctggactgctgtgaccttcattcattcccaggagaagtccaggtacagtaagaatgaatcaccagggaccagacctggactgggtaggggaggggttgttcagagacaggcctccttgaggagtgatatttgagcaaaatctaaatgactgtaaggaactaatgaggtgaagagagagaggagagctttcttgccagaggacatagcatatgcaaaggtcctggggtcagaacggaacatagtgtgttcaagaaactgataaggcagcatggctgcagccagagaggtaggctggagaggtaggcagtggcctgatcacacaagaacaagttgatgatggcagggaactccaggtttgggctaagaggaaagaaaatgtgttagaagacagaggcaagggctggccttgtctgatgtggcttccgagtgtggaatgagtgggaaggacaagagtggaatgcaggaaggtcaggggcgtcctgaggcaggccagcagcagagcccagaagatggagagacctctcggaggtagcagcagggcttgctattggattggagaagcagcagcggaggcagcgctgctgccaggcacctggatgagttcacctaggaggacacatatgataggaggctgcacaagatgccctgaggtctggaagaggaggaagaacaggcagaggaggcctaggaagaggggcctgaggcaggaggtgaaggacgtggtcctggaaaaccaggcgaaaatgcttgagacagagcagggggccacatccccatagaaggtcaggggcagaagagccactgtttgcc

SEQ ID NO: 80927 - DNA, 1878 bp, Homo sapiens
taaccaaccaatcaaccaaccaaccaaccaaccaatcaaccaaccaaccaactaccccccaaccatccaaccaaccaaaatcctgcaggaaaaacatgatggacattttcagactcaagatatcacctagcccctttctcctgttgaatctattttattttcgatgcactatttgataaacaaggtttctcatgaagttgaatcaatttgtacttttaaagcaatttctgataacacacagctccttgggaatgcaactgtctggttacagcagaacccacttctcacagcccaaggcctgcagggtgtgcccgtttttaggtggtccaatatgattcttaaagggggcataagtggaggcaatgggaagtatcaggatctgggatggagtgtggctagaatgcaaaagcatattcagccttgtaattttaggttggaaaaaagactgttatgtgtgttgtatagtctctaaaggagggcctgagatttttatgatgagggagagggttaaaaagcccagcagcagagctcagtggttatgccagctttccctgtattcagcacgctcacttgcactcgctgggtgctgatacagccacttctctctctgcagctgccaccatctttacagcagaaccagcagagctataatgagcagtgttggtgcctggggcaaagctccacagatcaactctgtaataaatgatgtggctcaccgctggggcttcctgcaaacccagccatccgatttcaaccagccattcttgctaactaggtgctaaactcagcagttgctaaaagaagacaagaggtgtcaacttaattgattttttttacaattccaggccttttaaaattattttaaatgtctatgtgcactctaactcgcattccctgaggacagagccccattgcttgcccaagtccttttccagaagaggccagcacagggctctgtgaggagggaggtgggctgagtcaggaccaagtccaggcagagatgctcaggcccagcctagtacttacaggaccagaaaccgtctctgtgctgggaagtcgcctctgagcctctgccaggagtttcctcttcccctcccgtagggcctgggctgcggtgagccgaggctgcttccctcctcggcctccatgtttctgaccccagcctggtgtccacaccctgatttgtggttgctccccgagctgatgatttgactggggacccagtcccatttctttttattttatttttagagacagggtctcgctctgtggcccagggtggtcttgaactcctggcctcaagcaatcctcacaccttggcctcccaaagtgttgggacgacaggcatgagccactgcatctagcttcagtcccatttctgaagaagtcctgcaccactgtgctttccttcccgggtcacacacacagcgtggcactggaggcagatgtggatcctgagcaggcagagacagagcctagcatggagttccacttaaagccaagggaatgaaacatcaagaaaagcaatgagagaggaaggaggatgagcagcaattgctgacaaatcacccaggggcaagggcaggacctgtggaaggcaaatcaatgggcttgacctctctagggtgcttgtcctccaccatcctcactcctacttccttttccctgccggagggagggggcacacaaaccatgattccacttgccaagcctcaatggcttagagatgtatcctgtgtctaagcaaagaaacctccatttttacagggccgtttccatagtaattcttgcatctgacgtttttacatgttttgctgaaattctatgactgaggcctccgctgttctagaagctcatgataatagctccttcaaccac

SEQ ID NO: 80928 - DNA, 1058 bp, Homo sapiens
agtaaaatgcattttcagccccctttttgaagactcttctatcatccattcactgtgttgaattaaagtgagtacaataggacttaaaagtcatattttgatttctctcctttattatccagatgctgctgtgtaatagagacacatacaagatataaaacaaaggatgatttacttagacttatagaaaagaaataggcacagcttatggtagtcctatgtaaagtagagaatccaagatggtgatagcagtccaaagcagcagcatcttggcaggtgtggctctaaaagatcctttgtgtcctccagggttgcattgttttccatgttgctgatgagccagtgagactgttttcgggtggattgagtcatcctgagtatttaaacatttgtgtcctgatttacctcctggttcgcctccgaattcctagagctgatggctgtacacatgcacaggtgtgaggcacaggatctgggtccctaattttcccagacaaatgctggttcccaagttcccggcggacttcagaagactctggctctggagcaaggccatctctttctcataccctctgcttgattgagccacagctgacctggccagcgtggtattatttaccatggggctcacttccttatctgtctggtcccacaaagggctgggtaaagaacagaactctttgcaaaaacaaaagtgaccaaccatcctggtgtgtccaggacttttccagttttagcactgaagtcctagatcccaggtatctccactcctatactgagaaaatcaggatggttggtcaccctaaacaccccgaagatcatgaaggctgaggacagagggctggcttataaattgcattttgcaggagtactgacaatcacactcataccaacttgagctaaaaggaattttaaagataactgtatgtctcacacccacttgtggttttgttaaatgcttgcatgagttctttggaatgttgaaactgctatttctttttcttaacgctgaaatgtttttgacagcacgcacggggtgttaaataaccttcatgtgg

SEQ ID NO: 80929 - DNA, 1036 bp, Homo sapiens
taaacccctagagactaggatttgtcttgttgggagcttcttgggtgtgcccatgcaaggatggctcgccctgtgtaatctgccatttcctggtaacctgggtgtcctgtgccttctccaagtcactcattagccactgaagccctgcccttagagcctgagggtatgggtcacccttactgggaggccagcagctctagaatctgtagcagtggtcatttaatacacactccattctgatactgagctgttcaggcaaggagtttctcaagccaggctgccaggcaggctggccttccttctccttgaattccatgggaactgtgcctcatccagtccaccaggactacaaagaacaagatggggaatgcagggactctgagacattctctccaaggagctccactcacgtggatgtccaggaaagctcagacatctgtatcatttttcattttgtttccccaaggactctgggtacacttgacaccaattaagtaccccctctgccctaacatgtttaggaattgtgtgaattaccattacagagacatgattttttgagaagagtttgaggtattagttcaacaaatatctatcaagtctttttgtcttatgtttacactgagaggcccagtaaagggtgaatctgaataactacttggtgagtttccacaagcacagctgatttgagtagcttgagccccaaacagccattttcccctcaacagccatgtttgtggtcctggatttaatagggcaaagtcttaaatgtccttttcactttgactcatcaagaccagccacatttttaagcagtacaaccggtagtatttctctttcccttgtgatcccttcaccctgaaaacttctgttttcaaaatcccgtgagcctttttaggctcttaatataccacaagataaactaagaaaaaagtcttaatgtggaataggtgatgcagaggggtgcaggtattcccaaagatggtgagagaaaaggaagagacacctttccatcatagccagagcaatccattgt

SEQ ID NO: 80930 - DNA, 1049 bp, Homo sapiens
taccatgcccagctaatttttgtatttttagtagagatggggttttaccatgttggtcaggctggtctcaaacttctggctttaagtaatctgcacaccttggcctcccaaagtgctgggactgcagatgtgagccaccgtgcccagccctcgtgtctcaattttttatgcttacaaaaatacctcaggcatatgggagtaattagaagattttgatatgtatttagagattgagactatagacatctgtgcttccaacacatagatgtaagagcttgctgaggcatcagaagggccattttgcccaatagtcattcaaagcactcagctgttaggtgttagcccctagttcctggtcatttggtgttaatggttttatcccattagatagtaatccctaatctgatacttctcttttttccccctctcctgatctcgtgctttctggaaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggtaccctggtcatcacatcaccattggaaagcggggggaatcccagcgtcaccaagacgaaataaactacgtggggaaccagggctcaaggttgaggaaggaatgaagccaacatgttttgtttccatttttctccaagaagctgtcttcaaaagagggtttgtctgatctttgggtcttctgcttttatgtttcccataaccttaatgggatgtcactcaaaaaaatatattgagcatttgaacatcgtgctcagcacactgacacaggaagaagttagtaaaaacgctgtatgctggaattgtgctgatatgatcagcctatgaaagtgatggtatatgaaaaaatctccacatcactgatcattagagaagtgcaaatca

SEQ ID NO: 80931 - DNA, 1038 bp, Homo sapiens
tctcaccttccccttccccttcccttccttctatctagcaccttttgtgccaagcactatgtgttgggcccttctgctccaatgacatgactacagtttcaatatgtggcaaagctgttcacgcctctggcaacccagtaccttctggtgatcactcattgctctcccatccccctaggctggaaattttctctccccaacaaaggactaatgaagatgggctaaccgtgtttacagtagctgtatcgtagggatggtgcaagctttgtgcatttttctagcttattttccagaaacaaagttctcatttcccaaactatttgtgtaccagaataaatatgcagataaaggaaattgaaggctgctttcccaataagaaagttgaatcatcctgggtctgtcagtgtattgtgccaatcataatcttttctttataggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggtcagtggagctccctttatgaggctgtttgactctagaaaacattcttggctgggcatggtggctcacgcctgtaatcccagtactttgggaggctgaggcgggtggatcacgaggtcaggagatcaagaccatcctggctaacatggtgaaaccccgtctctacaaaaaatacaaaaacaaaaaatttgccaggcgtggtggtgggcgcctgtggtcccagctactccggaggctgaggtgggagaatggcatgaacctgggaggcagagcttgcagtgagccaagattgtgccactacactccagcctgggtgacagagtgagactctgtctcaaaaaaaaaaaaaaaaaaaaattattttagtaaacaggccaggaaactgga

SEQ ID NO: 80932 - DNA, 1051 bp, Homo sapiens
aacttgattctatctacaaagactttctttccaaataaggtcacatatgcaagttctgagtggacatgaattttgggcagggggtggttggagacactgtaaaacccagtatagattgtaacagtggagatggagggaagtggttaacttcaccagatatgtaggcagtgaaaccaacaaggggagttgatccactcactctagtcctttacccaaatagtgttttaaaaaagctgatatccagggtcattggtggcctcgttggtgcctcttctcattgtcagatctcttctactagaagcaagtttaactgcggggaggacaggaggcacctcctcagcatccctgacttgtcgtgttgagtcaagccacaaaatccactgcttcctttgatgtttatgcattcactgatggatccctttggacccacaagcctatttttgtagatcaacttgggtgcaatgcagaatgtgctcattgtgccctgctgggggataggaatactcactggtgttaattttttataattgctaatcacctatgcagtgagtcagcagaggtacagccctaggaatggtcttctaggctgtgggtggtgtgggatttgatttgccccaccatgtaggcatggagcccattcagatgtgaacgtggttacaggttgagccttgctgtatcgattcctctgcttcactttcctgctctattcctcttcatttccttccagatggggctactgatgctcaccactcatccatctggagtaggctgaagctaccctaggtgggacagagcagcacttccccctcttcctctccacacctccctgatatggcagggcttggaattcagtcgccgtgcagacccaggcaggcagttgaattcctccaggctgccccttgctgtacttctccctgcttctcataccacccagccctgagcccgggcttccatctctcttcgcctgcctttgtcctgacctgattcatcctctcatgcctgagtcctgcccacctccccgtgccttgggtcagacctgccccttcatgtt

SEQ ID NO: 80933 - DNA, 1057 bp, Homo sapiens
tattttgaaaaaaaaaaatccattgcactgtgacttattcccatgccatggagtgggactgggctgtcttctatagtgcattcctgtgtgaattcaccacatgcccagcacccttctccctgctcccagcttgaactgtgagcatcttgtgtgaaatgggagaacttgctcagcactggtctgggtaggtagagtttgacacagcctgtaactccagctggtaaggacgctgcacttggtcactgctgtgaaaccatgtgtcctttcttaaaaaccttttccaggctcaagtgccataaagttctgaattagtagtggataaataagtggataaatagttctgaacttgccagtgggatacatgtagcctgccattcattgcctgtcaccagcctttccctgcctggataaccatatagaaccaggaaagaggagacgtattagttgataagtggcccaggttactaggggagggcctgtgtttatagcctcctagttgttgagaatatgtcaggagctcagcttctggaagttgcttaggattcctactgccaaaggaaaatgctttgttaggcttgaggggtagaattacttgtagagaaaagcattagttctaaatcctcaaggattctttggaaaacaggaaaagagagatacatggagcatccataggagcctgtaaggagttgtaactgggccactgtgcagtcatgacagcttagcctccacagtgggtggttgtgattcaggacagagctgttggacaccagtgtatgtatgcgaggcaccctggactaggggacacagagatattcaacccctggctagctgctttcacaacgtttgtaatccaggaagggaggcaagctatctgcctaagtgtcgataatgttggggaccatgtgggcaatatactaaaaggatccctaaggtttccatcctctggttattcaatcaaacactaatctaagtatggctgcaaagggattttgcctatgtagttaaagtcccaagtcagttgatcatcaaatacagagattatccagtaggcatgacc

SEQ ID NO: 80934 - DNA, 1043 bp, Homo sapiens
ctccctccagcagccaggaggcaggggctaactcccggtctcaggagaccctccctgcctgcggctctctgtgccgggagcctgccagtcacttgtactctgattctctaagggggtttgttgagctttagtgtgtaggtcttgaaatctgtacataacccttcaaagtaggaatgcctgattccattttccagttgaagaaactgaggatccgagaaatgaagtgacctgaacaaactctcacaacccgcatatggaggagccatgtcttacatccttgctgcctttttcatttgaaatagcgtaattactaatttatcagctcactaatgggtctcctttgtacatcaaacccagaacaatatctgcttccacagcttctggttgtgttggaagatttctggggcctcttacaaagccagccattgtgcaacttgagcccaagtgctctaacaactgggtccctgagccacagggaagctcatagctctgtaccaaaagcaggatgctgataggacatcaagaattctgacattagattctccctgaattcaaagaatggggaaggtgagaggaccagagtgagaaaactaattgtggtcctgggggctgtttgattgtaccatttcagatggagcagttatagatgcccgcaagttcccagatgtggcagtgggcatggctggctgccccggacaggaggaaagcgtgctcagaattgaggaggacacgtcctgagagggagatgttaggtgggccttccacatgggtgctgaaaccatgtagggtgatagcaggtcttggggtaaagagaaaggctgtgggtgctgtgctgaaagtctaaaatgcaggaggaggagagacccagaggtgggaagacaacagaaacaaaggaggggtagtaggtggacgaggtggatgacatgagtctggaaggagcgtgtcatgcaggagtcgggttttgaagggcttcggggactgaggaagacagcaagactacctttgaccccatgccatgtgggacatgggagcatgagccttct

SEQ ID NO: 80935 - DNA, 1006 bp, Homo sapiens
actacacaaataaatcatgatattgaataaatttgcatcaatttataaaaggtacataaggagaaagcagctatagcaataataattgttacaaatcaagctgcaaaatgtaaatttttattaaattctacatgtcattgcagtccatataaataaatactttaatacacaagaacacaaagcatatggcaaaataatacatttgaagaaacgccaatgccatcttcatgcttggagtaaataaaacgtttcgtagaatgttggtaattggcaagcaaatgaaaaaatcatgaattctaagaaaaactagcttaaacttaatatatatcattgcctccgctgggtaatgggttatgttaataatggattctggtagtaacaaattgaatctctagtattaggataatgatccaagtcctatctctgaccaactcatacacctgtcacgtacattcctttgctcattaccatgctctgtcaatagacagtgaagccttgctgtcttctagtagactgtacctctgaccttgtatatgaggccttccatgaacaatatggatgatttgaaagcaaaataatttttagatactgtttaaaacgtaaaaagaatgagttttctatattcacaaatatagtaagcaccttaatgcagttcttaaatgtaaataataataataataaatacttactgaaggcttactatgggtcagatgtaattataaatgttttagctacattaactcatttaatcgtcacaacagctgcatggaaagggtgctatcatttttatgtgataaacaagcaaactgaggcacagagctataacctgcctaaactcatacagctagtgcatacataatggagccagaatgtggacccagctagcttgattcttaagtttgtgcccttaatcagcatatacatacatatgtatacatatacagtcttgcatcacttaataatgagaatacatcctgagaaatgtgtcattaggcaatttaatcgt

SEQ ID NO: 80936 - DNA, 1065 bp, Homo sapiens
aacaccccctgtagtgagcgcagacattctgccaccatactgcttgctgggacttactgggagggagggatagagatctgctctccctcacaacatgccgtgttctgtgctgatctcagccatggtggctgtaagcttgtaggttggtcttgctggagccttttcctcatatgcagggaattcaggctttgtcgactcttccctccacccattcttgcctgaaccatatatttcaaagttttctcgccattgccatccttccctggttgccagggctgatatatatgtttctccctatctcagacttgagtcatttttgttgtaaattggggagggacgggtagttactcaagtggtatcagttcaatctgttgagccaaaagcacctggtatacttcaaagctttgccttgcaaagtgggggatccatttctttagggtcaccagcagaaaccctgaaatgcaaagtacctactgataagtactccccaaaatatcttccaaaattagtccccgtagatacaccatgaatacaagaattccatgctcaatccatttgggaaacttggcagtctgtattctcctcctagataattatactccacagtccacagttgcatattaaattctcttagacttctacagtgatgaaatctctttatctttgtttaaactatgtttcccaaatgtgtttggccaaagaagctttttttgcccaaaacttactaatattcctctgagaatactttggatgcatgccgtgaacaagtacccttaactctgctcgtagcagaaggtggttttttccttctgagttttgtggaatgcaaaaatatgtttcaattcacatgtgacaatgtaagtccccggacagcctccacccagtgttgttgaaaaactgtccactgttccctgagtgtttgcacagggttaatgcaatccttgggaagaaatgaagaagcatttctggctaatgccgagtttcatcccaaacagcagtttccagttaaatttcatttgtgtgttgtttatattactcaggatttacttagacctggtatgaggg

SEQ ID NO: 80937 - DNA, 1037 bp, Homo sapiens
ctattgggtactggccttaacacctgggtgatgaaataatctgcacaacaaacccctgggacatgagtttacctatgtaacaactggctgctactccacactgccacgtgaatgccccacagccctcaaatgcagaatgcctgaatcctttcccagcccccagtcctcctctcatcaccatccacctgtttgcccaggccagaaaccaagaaacatccttagcccttccctcaatcccactccacacattcagcccctcctctctttcttctttcctacccccctgaaccagatcaccccatctcccattctgaccattgcagtcatttccttgctggtctctctgcttttactcttactctactccaagccattcggaagacataaattaggttttgccacgtctttacttaaaacatgccaacagggcatttagaatcaaatccaagctccttatcatagcttcatgctgtatgtatacctggccccgtctcatcctcatgtggacactactcttgagtcacgctggccttctttttgttccttgaacatgcttttcccaacctcagggcctttgcacatgctgttcccctgagggaatgcctttccttcactcttcacattactgacatcttatccttcagctttccactcatattgtctcagggatgccctctgtggtcaccctagctaagaaagtcaccccagcctccttctaagtcccttgttttccttcatagcaactatttatttgtccattggcttgtttggggggttgtttttctgtcttccttaccagaacctgacctccctgtgggcagacttcattacgtctgtgctttttttttttttttttttttgagacggggtcttactctgttgcccaggctggagtgcagtagtggcacaatctcggctcactgcaacctccaccttccaggttcaagtgattctcatgcctcagcctcccgagtagctgggattacaggcctgtgctgtcacggctggctaatttttgtatttttagtggagatggg

SEQ ID NO: 80938 - DNA, 1149 bp, Homo sapiens
tccaggagccgtcttcagatcctgactgcaggtcatctctcctcgccctcctggtaaccccatggcatttcatcttgtgtttctgtagtggcagcaagcatactgtctctgggttacagttatctacacattgatccttcacctgctggctgagaggctctttggggagagagaatgtgcattggcagtagggatttatgcaaagggctttggggccaggtagatctaggcttaggatcataaggctttaggcaacatattcaactcctttgaggctcagtttccaggttcacaaaatgctgttatggggactgcttgagctaacatgtctaaggtgcttagcctataacttggacccaggagggtgcagaactgcccgctcccttgttctgttctctttccacagctcctaaggctgagcttccctttccccagctcctaaggtcgtgccttctgtgtgctagttgcatggagctaacaaatttcacactgtctcgggcgttctagttagaagaaacaaacaaaaaagaaggaccgcccttcctgtgcttcctcagagtgcagaagatgtgggtttcaaaacgtggacagtgactccctatgtcccctgtttttggtgcagacacagagaagtccctcttggttgctgacctgagaggcacatggccttgacctccagccccaaggggaaacagccaggttgctgttggggccgcagatgtgcctggccttacttactctgcagctcagcctcctcccctgtggtgtcagggacagcctcccaccctcccagagctcttggtttggtttatttatcactcagggatttcccaccagggagccttatctgacatccgcaggctcagatcttgtctggcttcccctagggacagtgtggagggaggatggccagccccagccgtggggccagcacaccattgagtccctgcgggaagtgtgctctgagagcctgctccttgcaggtcttgaggatagagatggggtattcacaggtgaccaagatgtccctgtccccatgctgcatgcagtctggccaagacgacagacaccaccgaagaatagaccacaagtgtggcgggtgtgaggaatgggtgagtcagaccttccctgatcacagggaccaagtcc

SEQ ID NO: 80939 - DNA, 1050 bp, Homo sapiens
ggccccaggatgaacggcttctcgctgggtgagctgtgctggctcttctgctgcccgccctgcccgagccgcatcgccgccaagctggccttcctgccgcccgagcccacctacacggtgctggcgccggagcagcgcggcgccggcgcgtccgccccggccccggcccaggctaccgccgccgccgccgcggcccagccggcaccgcagcagcccgaggagggcgcgggcgcggggcccggtgcgtgcagcctgcacctcagcgagcgcgccgactggcagtactcgcagcgcgagctggacgccgtcgaggtcttcttctcgcgcacggcccgggacaaccggctcggctgcatgttcgtgcgctgcgcgccctccagccgctacacgctgctcttctcgcacggcaacgccgtggacctgggccagatgtgcagcttctacattggcctcggctcccgcatcaactgcaacatcttctcctacgactactcgggatacggcgtcagctcgggcaagccctccgagaagaacctctacgccgacatcgacgccgcgtggcaggcgctgcgcacccggtgagcctgccggggtcgccaggcctgacttccagctgtggggaggcggggtgggggtctcttggggcccctggggcggcctgccaggagaggggcccctcctccggggctgagggccagcggagagccccttggccgccgtaaattcgcttttcttgtcccaccctggcttgctcccaccctctccaaaaaccgcgccagccttcaggttcctggagagctcggactcagagaattttgcctgctttggctcgcctgtgtgtcgccggcccaccggctgggtcttttgtggctccggtcaccgcgagtggcagagtgtgggtgcttaagtaccgggcagaaagaaacaacttggttcgagtttcgtttgtacgagctgaagtgaccttgggcaaggcacatgggtttctagactcagtttccttccctgtaaagtcagtgggcgagacaggatggcctctaaaagactttc

SEQ ID NO: 80940 - DNA, 1002 bp, Homo sapiens
cactcaggactttgccccactcttctgctcacatcgtcttttgtatctgcccttctcctgtgctaggaacaatggatcctgactggatcttaattggattaggagaccctttgtgttccctgtgcacctggtactcagcccctttgcttgagttatcacagtgttgctgtatctgttatttaactgtatctccactaaattggaagatctctgagggcagggacactatgtcttctctattcctgacagttggcaaaatgtcttaaaataataggtagtcattggtatttgttgaacgaattgcacataatgggcgccccataaataagtggggtaaagttaatttttcctaagttggactcttacaagtacttggatcttattttatcttcggggtttaatatccatgggtacaaccatagacaaaaaaaaaagggccagatgtattggcttgaggcctcatccactttgtattcattgtattggtgttcttgtgacactgaaatgtctgtattgaagagaagaacaatactaacccatcctttgtatgtctctacatcttttatccattacctatttgtgccagctcctgcgcatgctagagtgagctgtccagcccttgaaacagatgtaaatactaccagtgtgcagacccctcatgcatggataaagacagtgaatccccccagatgatgagtattaaggtgggcacgtaatccagagtaagggtttcaggaggaagtagatttggtaagaaaggtggttgttgccgtttggccaatagatgattattttaaactcttgaaaagttactgaaaagagtgtagcggagaggcagggtttgaaggagccaggaagagtggcatgaacaatgaggagagctcattgagcatgatggagagccccaagatcaaaacttgttttacgtttgcattactggtaagaaatataagtatgttgtgaatacaaacaagtgagggaatgaattgaaatcacttagac

SEQ ID NO: 80941 - DNA, 1080 bp, Homo sapiens
gtaaacccagcaatttgggaggcctaggcaggaggatcacttgagcccaggagttcaagaccagcctgggcaacatagttgggacccccatctctacaaaaaatttttaaaagtagccaggtgtggtggtgtgtgcctgtagttccagctacccaggaggctgaggtgggaggatcgtctgagccccaaagtttgagactgcagtgagctgtgattgcgccactgctctctagcctgggcaacagagtgagatcctgtctcaaaaaacaaaacaaacaaaaaaccccaaactgttaaacacacatttatttatgctctgcttgtgccagaccgtgtactacgtactcttgaagtatcgttaatcccaagctgtttctttttgttgtaaaaggatggatagatttcagaggcattttgaatacgtaactatgatttgctgttttataacttttgtgtcggtgattcacaggatccataattggaaaatccatgtcacagcaaagctgtagtggcatcctctcaggtcgtgggacccttgaaaaacaccttctgttggttgtgaatggtgttcacagccagcagtctcagggtggaattctcctccagtagcaagttactttcctgggcatgttgaagttaataacctaacttctttgttctcagtgttctcagagggaatactatgatgccactaagggaagaaagcttagagtttctgcttgagtttgactgattagggaacagaaaaacagaaatatgtcggccgcggtggctcacagctgtaatcccagcactttgggaggctgagacgggcggatcatttgaggtcaggagtttgagactagcctggccaacatggtgaaaccccatctctactaaaaatacacaaattagctggtcgtggtggcaggcacctataatcccacctactcaagaggccgaggcatgagaatggcttgaacccgggaggcagaggttgcagtgagccaagattatgccactgcactccagcctgggcgacagagcgagactccatctcaaaaaaaaaaaaaacaaatgttatgaatactgtttgacata

SEQ ID NO: 80942 - DNA, 2003 bp, Homo sapiens
ttctaccattttgagcctcagttaaaataatgatgatggttaccatagctgcaaccaccttgtcagttgcttaacacagtgctttccacatagtaagaggatggtattgtttaggattattgataacatttttagagctataataaccaaatgctcagatcatgctgaaaactaggtgcttaaatcagaaggagtgttaaagaagttgcttcttttcccactgtgtatagatacaaatacccaggtcaagcctagcttggtggatgtggaagtggaggaacggtaaaggtgttttagttttatttgtagctaagggggaagtctctttggaattgttgcttatggcctcaagagctttggagagtggtatgcattagtattttaaatctgatagcatttcatctacctaggtgtttatatgcccaagggagatctttaaaggagaggaaaccctacctgtaatccaacacctgcagttactttgcaaaccattcctggtttgcccctccactttgcactttttggagctgggcaggaatcagagacttctctgagcagagttagggatggcaaggaccagaaggcaaaagcctgtattgtgtgcaccattcaagatgttctggttgctctttacttatgagacgatccttaatagagttaaccttcccttttcctagttggccaggggacctgaacagcaagcttccttttaaaatatgaatgctcccataatgccttgtacctcagattcatgtggctttttcacagctctgtgtaatggagctcattgataactcccacgttattgattcactttagagtgttaaaggaccatggctccatggtgaaattggaaacctctgttttccaggaagtcgaggtcattcagattcaatgctcagacggatagttaacggttgtacgtcaattacttgctgaattgctgagaggagcctaacctcaagcttacttgttaacagagtactgtttaaatttccaaaggaaaaacgagcgtagagaaccgccagtactgatgattagtttgctccttcactttacatgttttaatggttacagtgaaatctgggcagttattttgggggaaaaatgtaaaggagcctgtgttcagaatatatccacaaaaagtgagtttccagatgttaagtataaatctactagctaaaatctctgagattatgattgataatcagatgagaattcttacctaatctcagactgtttttggagactgtcatggacataactaaaccctgtgcagtgatgattatatggactgcaaaggtctgtgatactagaacaagaattttgtctgctgatctcacttaaataattttatttatccctattgtcataaataactcaagggtatttcagtttctccagttttgattgttgtcgtgatgtttaactatcactgttgtccttataacatgtaaactttatactattttaattttaatgtaactattaggaaaggacaattcgcatgctaatcactttgaagcatgttttatagtatacaagaagactggataaaataagttcgttaaaaaatgaacatgccattgtaaaggccaagggaaaacttctttgtgcgcagaaggtctgctgaaaaatcacttgataaaaagcagattaataggagaaatggcatataaatttatctgtgtgcacaggagaaaaattacagaatacccagtatcccaatggggtgcatattcttatatatctacttcttaggggaaagggaaatgggaaagtgtggatgattttagagggatggaaatgatttttaggggaattcaatggacttgaagaacatacagtggcctgagataaagtctgttggatctgcagggcagacagtggtttgtgacaaaagtctgtctaggtgtgttgacatactgcagtctttcttcctgcagtaggagttcagttaatgaaaacttacagaaggcaccagaagtaattgttttcttctt

SEQ ID NO: 80943 - DNA, 1710 bp, Homo sapiens
agttttttaaaaaaaagctattggggcctggcgtagtggctcacgcctataatcccagcactttgggaggccgaggcggacagaccacttgaggtcaggagtttgagaccaacctggccaacatggtgataccccatctctacccaaagtacaaaaattagccaggtgtcgtagtgcacacctgtagtcccagctacttgggaggctgaggcatgagaatcacttgaacccaggaggcagagattgcagtgagctgggattacgccactgcacttcagcctgggcaacaaagcgagactctgtctcaaaaaaaaaaaaacaaaaaaacacacacatgaaaaagctattggtagctgttgttggcctccaggatatagttgcatactcctcgaagactcgcacatctggatcaccattttctttacccctggatctcctgctttcatcccgtgtagtgtgaatatcctgggctgttgagagcctgttcagcagccccgcctcacacttcccggcctctccctcattgttctcctcctccaccctgcaccactctgcagcagcccacacctgtggccacaccttgtacctcgtgatcacctggaatgctttgcttccaggattttgaattctgaaatactcctttctgacacacctaatatcctgttggatctgcctgtttaacaaacatattaagtgtccactgtgggccaggctttcttccagaacaaaacaagcaaaacccctgctcttgtgaagctttgtttcataagtgcccatgaaaaacagtaatcataatgagtatgtgaatgatagtttattattcaaatatgataagtgctagaggaaaacatagaacagggcaagggcattggagtactagagaatggatgggttggctgcaacttttaaaggatgattagggtatgcttcattcagagactgacacatggccccaagcagtgaggggttagctatgtgcagaaatgggctgagggaccagggtcctaagatggggcatggttggcagatgtagagatcatcaaggaagccagcggggggctagagcagggcaagtaaggggtgcaggggtaagaggagtagtaggagatgaggactgggagtaactggggaggggtgagggcattagtcacatagggccttgcagaccattgcagggactttggctttgacagcaggaaatgggagccattggagggctttgggtagaggtatgacatgatttgacttaggttttggaaggatcactctgtgttaatgacaaattggaggagctgatatgtcgagggaggaaggtgagagaccaattaggatgcaaatgcagtattttagatgagagatgctggtggcttgggccagagtgttagcaacagcggtggtgagattttggatgtatttgaaaggcggaaccaacaacagtatttgctgatgcagagtggtgaaggggagtgtcaaggataacgccaaggattttggcttgagaaacaggaaaactagaaactgagactgattttttttcttttttttctttcagtttcattagcttttttctttttgtggagatggggtctcactatgttgtccaggctggaactcctgggctcaagcaatcttcctgcccctgcctctgcctccctaagtgctgggattacaggcatgagccaccgtgcccagcagaattgctgttgattg

SEQ ID NO: 80944 - DNA, 1028 bp, Homo sapiens
tgcagaattcaaacaatttttttctaaatctatagttttactgactgcctatcagcttcatctcctcggatccatgagacctgtgcatttgctgtctttttgttactttgccatgttgtttattaaaaacaaaacaaaactttataatggaaaaatctcaaattatatacaatgtacagaaaatattaagctaaattccatggcggtctcatcacctgcagcaactattaacattccaccattcttacagcatctacagttccactcacactccacccccagcctcttattactactttgtaagtctttttttttttttaaggaaaaatgtacatgcattggaatgtacaaatcatagctctcttaacttcctagcagtgtcttcttgccacccacatcagctctcaggcgcagtgatgagccagccacagagccaggctctccttggtgtgccgtggtaacagtgtcctgccatttttgggatgtggattgcactatgagagtatagttaagggaggttgtggataaatttaataccaaatagttaccgaaggaaagccactgaggtcttgttcttttttttttttttttttttttttttttcaaaatcagccttagaaaggaaaacagaaagaaagatagggaactccaggagtgtgtcccatttgtccagaattagtggtatgccataaacagagccctggtctggagctgggagaacattggctttcattaatattgaggtacaggccaggtgcagtggctcacgcctgtaatcccagcactttgggaggccaaggtgggtggatcacaaggtcagcagttcgagaccagcctggccaacatagtgaaactccgtctctactaaaaatacaaaaaattagccgagcgtggtggcaggcgcctgtaatcccaactactcgggaggctgaggcacgagaatggcttgaacctgggaggcggaggttgcagtgagcagagatcgtgccattgcactccagcctgagtgacagagcgagattccgtct

SEQ ID NO: 80945 - DNA, 1051 bp, Homo sapiens
ttgcattttaaaagattactttgtatacccctagagaggttcccccccatggaattctatattgtctaactgttttctgatgacataaaatttctcctgagtctttggaaatcaattgaaaggaaggaaagaattgcaatggccattcagattcctctcaccatttggattgggtggttctgaccactttaccattttttatgttgattctgatcagaggaagatggctgaggattagtaaacagaaacctggataactgtaggtgggcctaggttaagagcaaggacagtagagccagaccacctgagtttgaatcctgcctacactgtttaatctctgtgcctcagtttcctcttctgtaaagcggggaaatgataattgtgaatatagtaggattgttattcatagtaaatgagtgagtgtttgcaaagtgcttacatgtaagttggatagaatacatttttaaaaaactgaaaggaatgagggaaagatatgaatgaatgaatttatagtagtagacagctttcaaagatttgaggaagagcaacccacctatttctaaatgggtttgtgatcttcaaagcgctttcacgtacactctcttggttcctaagaacggttctgtgcagcccacatggctgttaagtagtgagtgcaaggtttccatgtatttctttcgacttttacatgttttcagggtttcagttgcccagattaacttgttgccattagtagtcatttttgtcattcgctttgtaatgcttttgtcagtctaaataaagcagtgtgtccaaatggtctagcaacatagtctttccctatttgacctgaaaaaaaaaatttagagcaattgaattttaattcttacagtatgcttgtggacattactgtaattgttttcttgagccatgataacctatattaaataatctggagcaacattttattcctgattatttaaacaaggaccagtttttcctactgacttgcatctttttagacagggagtcaaaatctttaaaagtcagtctgatgtgtttatggagtctg

SEQ ID NO: 80946 - DNA, 1833 bp, Homo sapiens
gatctcctgaccttgtgatccgcccgcctcagcctcccaaagtgctgggattacaggcgtgagccgccacacccaaccctttttcttttcttaacctttgcattgtagttaaggaatgtgccatagctttcatttactttgattcttaagttgatccctttataaactttataaaatctttttacatgtctgtagttttcctctgattgtctgttccttctgtgtgtctgtagctgcctagtgctgggagttgaaataagttctgtcagaggtcatatatagctgtattcaaatcttgtagtttaagacagggagaaagaaaggtttaacttaaagtacaaaaagaaaatacagttaactcgtctgaaagtgttgtagggggtgtgatgaattcttaaggagacctgaccttgatgtcttttccgtgcccttgaacagctgaactttcaatctttccttctcccacatggtgagagatctgaatcgtctagggtcactcagtagtttagtgcatttaagcagagattgagggcagttcagccagtggagagggcgtgttagagtatctggttgcttgagaaatttaagatgagaaattcaaactatctggttgtttggcaggtggaaccgcatagccccatggtgcttctgttaaagaatgttgtgtgtgccctcgctagccttgctatcctagaaggtttgaatagtccagattcctttgagccactcttgatcctttggctaacaatcagtgtcatagcatagcattcttttcaaattagaatataatcagtctccagaaataaagacaatttcctagaggtaactcagcaagtattgggtgagcaaaaggtggggaagaaagggaacagtatgggtgaggactgtgaaccaatgcttgttatttgaggagctgcatgcagtggggtctgtgagcgttcccaaggttgagggggccaatgaccagtcgggtgacatgtgtgctgttctttggcctgattgctgctgcaccatgaattctgaggtttccgagtaaggttctggttcttcatcatttaaaaatgtgaatgtggtattaggggaagggctggggtgacatccatagggattgtcaggcctctgcactccagacttcactttgccactcaagacacagcattgttgctgccactcctccctgggtgcagccgtcattggtggctccgtggagacttatggctctgcacagaggggcttagctctggaggcaggcatctgacctgggttcacagccaggctctgctgcctaagagcgttgtggtcttgggcgattcatctacctggcaggaaccttagtttcctggtctgcgtaatggagctggtggcaccaccttgtaaactgttgccaggattagagatagggtatgtagagtgccatcatcactttattatactttattctgttgtgtgccacgtgccttctaataatgaacaagagcaagcacctgctgttaaggagagtgactgtatgaacacgtgcacgcacactcacctacctacaaactcaccagaatggtctctggcgtcttcctgatgtacaggggccttctaagagccaggactgctattcacacacagatgagacctcagtcctccctgggaaaaacacctttggtctgacctgatcaagcatgctttatcacctggtggggctgagcttttaggagaagtgacagtgactagctgagaaggaccaaaggaggcagatccaggcctcatccattcccctcacttgatagataggagatctaaaggcaggtaaatcacctcaatgcctatgggcatttttattgg

SEQ ID NO: 80947 - DNA, 1147 bp, Homo sapiens
cctgccccagcctgtcagtttcactcactgcctatttaattcttgcagcagtcccagaggcaagccttactccacctttctatggccgtggagagggtgctacaggtgcaaggcagagctgggttcagaccttgtgctgtctgattgcagagcgtactcttctttctatgtcctctacgaatctccaccttccctcccctgtccccgacctcctcatggtcatgaccacatactccaggttacttacagaatccctgttttagtccagcattaagagagaggactctaagctctcatgtctgggtacagggcctcagacgatggcatcaagcaggctcacttgctctcagctttgctttcttccttgtgtaattctcaaggaggccccaggctcagcagaagagggtgctgacatcctggggaggactgggattgaccaggcttgggtcctaggcttatcccctaagaagtcactctggccaggaggattcaatactcttattgcccagacctggacatgtattcacacctagagttcaaggactgggaggcagagggatgctccaaaaagacagaacaggtcatacacgttctctatccccagtaagtcactatccaagaacttcctggcaaacatctcagcagttttagtgcaggagctaaatgtagcattgctgtctcagattcacagtcatttgcaagtcagtgtcaagcaggcaaactcaccaaccatctgtgtctcctccactatagcacttgtatgaactcatcctacaaagagataaaacaattagaaattagatacttgagtttctagttctaagaaatatttttcagccttggcaatcaaattgataattaaattcaatatttaaagtttttttttccccaacagagaattcatgaaatctgtaccttaacttttggctgggtttcttggaaatggaatggtgaattttattttattatttatttatttatttatttatttatttatttatttttttaaaacagggtctggctctgtcacccaggctggagtacagtggtgcgatcttggctcattgcaacttccacgtcccggactcaaaccatcctcctacctcaacctcccgagtagctggggctacagatgtgcaccaccatg

SEQ ID NO: 80948 - DNA, 1879 bp, Homo sapiens
agataaatgggagagctcctgacaaaggacaaagtcaaggcccattaacttaaacaggatgcagtgtgtctcagggaggccaggcttgttcatggttgtagaaggaaaagcaagccttacattaaaacaaaaacaaacagattttaactttataagtgatcgttcccatgagacaccatctccttggcgctgtcagcctccattgcaggaacttcctgcctcagtgcttcctcttgctgctgagatggctgccaaaccctcggtttcagggtgctcttgggggcatgtcccattcccatatgctgagtgggaatggaaacccaaattcgtgctgatcaacctgtactcagcatagcctgtgactgcaaaaggatggtagacattgggagaggctgagagcaaaaacttgcaaaggggattactgcacacatcgcactgcccgtgacaaagagtaatgattcagggctgtggcttcccccggtaaaaattgggagactttaatttcttgtgctctgttttaagaaaatcttacatcatgcttaaaaatgttaatgcttgcatgcttactaaatattagtacggtctttgtttttgctgcaagagattctgttcctgtctagatccccaaggtgatggtaaacttcgaatggattatatgtccactggaatgatgactgtgtctgaaatttaattttaatttgttcaaaaacagcttttggctagaatcacattctgttcaaagcaaaaggtgccccccaactcactgatccctgagcctggaaattgttaacttgcccaaagggagatacaattttatctacccttgtggagcttacatcgtcattgtaagtgtagggcatgccacggtgcagttaaacacatccaccttcctgtcattaagcatctgagtggatggctcaggaaagaaaattatgtctgtagactggaggagtcaagaaatgtgaaaggacgaggtaggaccggaatggacctgtaggaccccagagttgtccaggtgatgacaaggagggagaacattccaggcagggggtgtttatgagccagtgagggaagagcctgagccacaggagcagaagggccacctggagagaaaagaaaatgttggaatagtcggatggggctagattgtggacatggacttttatcctaagcacagtgattgtccaaagagtttgatgaacaaagcagcataaaaaaagtttgttttttttttcttttttcaaggaagatatatctgttgggaaggacggattggagtagggagtgacatgagtgggacagtttatatagatagaattggaaggaaaacaggtctgggagagaagagaagaagtcagctgtgggcattgattatgcctgagggattctcaggttctgccttgggaaaaagggagaagctgggatggaagctggtaggccatcagagtgtatgctgttagcgtgagtcagggtacagcaatggattgacaccaggtcagtagtcaagaaccgtaacacctgcttccttctcaaccataagctgatacacagaaaccaacaggataggacagaacaggtgggaagtttgggcagccaaggtccctgtggggcagtctgagcaccatggaggggatgtacaggcagcaagagtaaggtttccagaaagactctgggtacctggatggagatgttcatcattgggcaaactgtgcgggttcacaaaccaaacagaaggcaggccctgattaattgtccaaaagatgctgccatttgtagcccaccacaaagcaacagaagtggtgtcagagaaacaatgggtctgtaaaacatctcaaagatagaaatggtgagacttagtgactacaagtgtgtgagagac

SEQ ID NO: 80949 - DNA, 1690 bp, Homo sapiens
tcaaagagctgatgaaatctcagtcttttgtatctagaggtggttctgctaattcacacaacacgttaaactgaacagtcgtgattcccagcttcattaccttgcaggaatgggaatgagagctgaatgtagggacaattttctagtgctgtataaagtagcctcgcatctgtttctcaaccttatccatcatttctgacattcatgcaggacttgccctgttgccaccaatgttctcggtatttcacatgcagctctctttctgccactggatacatgggttcaatccatttgtgaagctgtgatagtgtaactggaaagctagtgtggtgaaaattcctttattattttttgttaacatgctgatctttcccggacaaatgaactgaagggtaatttactggaactctcgtgtacagcttcatcaactgtaaccatataaatataactggaatattcttaaacaaaaagaaactaggggtttttttaagtgtaaatttattactagccaacagagttttactattttgattgtctggttggtttaacaaagagcctagctgactttccttctgtaaagtcctccttgtaggcttttttaaagtactgtacatatttgcaatcacattgtgcatagattcttaatggtagatatgatttcttttgtcaggctacaacaatgaactgcagattccttgtttgtaatgtaaatgattgaatacattttgttaatatgtttttattcctatgttttgctattaaaaattttataacatttccaagacaaaaattccaagtttatgctttgaagaatttatgtaattaaaatttcactaaactaatctttttagtttaggaattatttgggttttgacactggaagttgcgccaaataagcatcagaaataggagatgcttaacattgctatactacttgtgttggttaggggtttggatttgggggttctttggttttaatttttttttccacatttaaaagccttaaatgtactgtaagcctcagatcgttgtacaactggactgcggttgattgccagtttgtgtactgttgcttggatgcggcacagtggttggtaatggaataaaggatgcatggatcagaatgtgtgggcttgtgcagtttttttcttcatctctccatcaaagaaaatagtgaataagaaaacaactttttgtcgtaatgtaggaagaaaaccttgaggctttcaaactgcaccatctttctcaaggtatatggttttgttctataaaaggccttggattacttttggaagaagccaagatataaagcatatagcagtaaagtgcagatgatatctaaatagaggatgcagtggattctggctatgaaacaaaattgatgaaggtgacctcattgtgacctggctcagaggaaggacagtgcctcttttgttgggaagcctgaaacaggtgtgttccatagttttcagccctttgaccagctgagcagaaaagagcagctgagggatgctagttttcaactcttggaacgcactctcctaagggtgcattaggaggaagtggtggtcaggaaggtgtgaagacatgagtatgcacatgtgaatgcatgcatatgccagctacttcctgatcttgaatcaggtgggtggggctggcttacccgagggggcatcagcaaagctccagt

SEQ ID NO: 80950 - DNA, 1085 bp, Homo sapiens
gtaacagtgggaaccccagggagaaatcctctattggtttctgagagacacccctcctgagctgcaggctttttctagagctgttctccattcagacctggggccggattccaggtgtttggtttccactaagtgaggatgcgtctcctttctgagtgccttactatttctttctccctagtcaagaaggaaaaattaagtggctacctgaagtccttgcaaagtatagagaaggtatatgtattgtttctaatatatgaattcgtgccttacgcttgtggaaatccgtttataactattaaaagcctagaagtaacattcagagcaagatattgtgaccgtattattattcattctgttgatgattattatgctttatgatccctaaaattaagcagagtaatacagatttggatcactcattataatcgcatgagaatctcaaatcctaatttaaatgattgtagcatcctttgaaaacaagaatggaatgattgctactgtctcaaaatagaatgagtctatagtttaaaaaacaaaaaaaaaacctgttagcactcttgttcaagactgaattttgaatgtgaaaatcaaaggtttgaaagggcaaatgaattgtcaaaatactctttttgggaacatttctgtgactcttggtgtgtggaggagaaatatagaatctatagacttcggggccttgatcacttcaggaaatgatcacaagtgtattagcctgcacagaacaagaaggatcccttcttaatgtgagggatcaccttgggttccagttgaaaactgaatgccccctctctcagtgctcccctttctataggtacctgctactgccctatcttagaactaggacttgaaagtgcaaacacatgaagagggtctgtctgttctagtctttttcaggtgagccttttcagagggaggattaggaccatatctaatctgtctttgtatccaagctgagtgattttgacctcgttccctaatttctctgggcctctgatgctttttttaccccttgttgaccacacgtagggcacatagtcattaaatgaaatcatggctatgcaaat

SEQ ID NO: 80951 - DNA, 1052 bp, Homo sapiens
tgctgctgtaaatgctgctttctctgctcaatcatctagcaaactaccattcattcttcctgaccctgctgaggcatccccttctctgtgaagagttccctctctccttctccaatgtatcagtaagctattgctgtgtaataaaccacccccaaggcagtggcttgaaacaactgtgtattattgtcctgtgggtcaaccagctggttctgctgatccggacaggcttggctaatctcaactctgttttgtatctatcggcagaacaactggaggctggctggtctaggatggcctcatttatgtgtttggcattggctagctctcaattcagtggatgagggtgactggaccatgcgtctctcatcacccagtagactagcctgggtttgttctcgaggtgactgatgctgttctgtgagagagaaggaaagcatgcatggcctctggaggcctggatctcaaaacccaatggcacaccagcacttctgctgctttcttttggctgaagccaggtcagttcatgttcaaggggaggagatttagactctaccttttaatgggagaagctgcatagttacattgcaaaagacaaggatctgaggggaggagagaaggatgagtggaatggttgattgatttttgtgatcaatccaccacacccacctttgatagaggtacttactctgtagtacaattggccttccatactgtgggttccatacctatagattcaaccaattgcaaactgaaaatatttgaaatatgtttgcatctgcactgaacatgtacagactatttttcttgtccttacaggataataatacgggataacaactattgacaaagcatttacattgtattaggtattataagtaatctagagatgatttaaagtatacaggaggatgtatgtatgttatatgcaaatactacactcttttatattagggacttgagcatctggagagtgtggtatctgagggagttcctggaactaatgtgcagatgccaagggacaactgtactattgtacttggaagtactcatgg

SEQ ID NO: 80952 - DNA, 1020 bp, Homo sapiens
ttggccgtattgctgggaattaatagcaacattgcatatggggaaagcatgagatttgggatcacacagacctagattcaacgccttccctaactggccaaaagaccttgagacagctgcacaaatttcctgcaactctgttcctcatctgtaaatggtgatactaattcctggcggggattacatacaaagatgcatggaaaatgcctagcacagtgcctgggatatattaagagctcatccatagttgtcactgatttgagacagtgacaactatggatgagctctcaatatattcttgagttgcatgtctatcagaagatgtgatgccaggttctcaacagtcaacttagaaacacactcttggaatagaaacacgttgggtaccatttgtacgtgtattatatatgtatttccttttcatcttttacctattctcttttaaacagagtggtggattaaaaggtaatgaattacgcacaaagtagcttctcacttctcactgcctttcatttttcttctcctcctacttggcctttctcccccaccaggacctttactctggtcttctgtgtttgctaattcattagtcaacaaatgtttactaagcacaaagactcgttctttgttctcaagggagggaggcagacagatgattgcagcaaggttgaggataaagagaaatccggggttgggtgcggtgactcacacctgtactcccagaactttgggaggctgaggcgggtggatcaccagaaatcaggagtttgagaccagcctggccaacatggtgaaaccccatctctactaaaaatacaaaaattagctgggcgtggtggcaggcatctgtaattccagctactggggaggctgaggcaggagaatcgcttgaacctgggaggcagaggttgcagtgagccgtgattgtgccattgcactccagcctgggcaacaagagcgagactccatctcaaaaaaaaagagagagagagaaatccaggatgtggaggggcctggagt

SEQ ID NO: 80953 - DNA, 1049 bp, Homo sapiens
atccctccatctctatcagctcatggtggagaccatgtgttgaggagatcatgaaggggctcttcctctgggtgctctgtcacccagcccccagcagcccacccaggtgtcaaaagacaggtctgcccctcactccagagaatagctaggatcctggtggcatggcactttggaaagtatgagacccctccttgttttacagaagaagaaactgaggcagggagcagccagtcattgcccgaggcttcctggcaaattagtgacagagccagttgagaatgcagcccacgtttgtgttgcttcaactcagccccagatccttcactctccatgggggctgctttggggaagccagctttgcacccccacttccctggaaggcagagcactaaggctgccacccagccatcgctcaggcgggtccacacagccccgggccaacctccctggcactcacacccagtgtccggagcagctggtcagtgggcgtggagctcctgcttgtgtgcccccacccctgtcgcgccctccccctgcctgggatgagctgcagctgcctcggggcctctctgcctgcgccccccagccagcctgtgccctgctttaatgtgtcctggggaaaatagctggcaatgctcaggcgacaagcaaaggccattttttaaaaaaagactaatgccaggatgagggggcaggagggggtggaaacagctgcaggctcctcttccaaatttagccaggtgactgctttgccctgctcctctttctctggggtttttgggtggccattgcctccatggtaggactgtgttcctgaaaaccaccccccagatgactcacagagctgtggcagctcagagaggaatgtctattcatttcagctggggctcttgtcagccagttggacctgaccagcagctccactgttgcagaattgggctgcttcctacttcctgtgtccccatccgatttcagggcctaccatccccaaagtgacagaagatagcatggaatgaggcagccatgcccagatatcagaggtgctgaaa

SEQ ID NO: 80954 - DNA, 1050 bp, Homo sapiens
tccctggtgctggtcctgagagcggaaggcccttcaagttctcctgatccaacctcacactaagccctggaatcacagaggatggggctggagagggaggcatatggaccccagtctgcatgctgtcaatgccgttgaatgtggagagccacaggggtcactgctttctctctagagtcagagtgggaggggacccagaaaatccccttcctgtgcagaacaggagagccacaactccctgagcacgactctgcttatgtagagactccttcctctgcacggtattcagtttgactccaagggcagggaagtgtccttctctccacgactccactgaatgtgaagccagggcatgctctgactatctatctgctcttgcccacaggtttgctgacaatggcattggcctgaccctggccaggtaagggcaactgtcattgtacttggtcctctgtgggatcttgtctctgggcatctcaccttaaacatcttctctctacagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagtaggtttgcaaccatgtagctccttattctgagtggcttaacctaagtggctgtgatggaagggaaaaagttaatgggtagtttctacctgttgactatgaattcttctaccagccagaggaatcactgaggtgactgagactaacaattaagggatgaaatctggaatggggagagagaagtcaaaaagtggtgttgaatatgagtcaacagggtgacgtggccatcaaaatgcgtaatgcattcctgggctatgttaatgggaatttagtgtgtctgggatcagggactgtgagtccttttctctgacagcactctcacttggagtgtagcatccactcctgaggatggcagagcaatagagtcaggccgaagcacacttaaaggagaa

SEQ ID NO: 80955 - DNA, 1013 bp, Homo sapiens
gcatacatgttgggtttggagaaggagcaagcctagactggggccaggcccaagaaggaccaccaggaagcccagccagcctcgcagacccttgcttcctgtgctctgctcaggagtctgaggcaatgggagaagtgtgtctgagcaacctactccatgctaagccaaggcaaaatcttcaagtcaccagttcttgtccagtctctcctacctccacgtccaagcctgttgccgcttcccacctccttctgggtctcagggccttcttggggttctctgtcagcctacagtcttgcttttcagtggggcctccctttcttctaggggtgctgaaaatgttgccttacaattatttttatcatgtttatcaccttccattctgtgtccttttcccctctgtttcccaaacccagcacactgccaatgtgaaaggcttactcccagaggagaaactcatgtgggtcttaatctgatttaattgttatagcaactaaaactaaggcgataatgactaacagctctatcttcccaagaaacataatattggcacgctccagtggtatttacagtatttacccaatgactctttatgtaatggaaaaattggggaaaatgttgaaatacaggaccattctccaaactccaaactagcaactagatggatattcaactcatccatccattcatccatccatccattcacccggcagtcattcattgacacttagtgtgtctatacatgctttaaattaattaatgaattaataattaattaataatgatctggggcagggggagtttctagaggtggggatcaggaatggttttacccaggaagtctctgctaccatccacctcagaaggggcaaacatggcgtttagactgacgtcttacttccttaactccataggaatggaaaacatttagactgacatcttacttccttaactccgtaggaattttccaattagaggaattcagttatatgatggccccatcaacatccaaaact

SEQ ID NO: 80956 - DNA, 3031 bp, Homo sapiens
aggctgatcttgaactgctggcctcaagtgatccttgcacctcaacctcccaaagtgctaggattactgtcactggcaaccatgcctagtgtgtgtttttttttaatatctcagttgatcctaaagttttatttatctttggatctttagcttttatttcatctgaacagaagggtgtatagcttagtttagactctttgagggacaaagttaatagtttgacagcttcagctagaagtttctgctcagtggaaagtgctttgtgtgtagctatgttcacacatagagcttggaccatgctgttaaccgataactaatttagtatgaagaggctcagttttcacacttgagtatggtcctgaggtacaattttaagaaatctgcttctttttcctcaaaaacagttctgaaatttggggtctgcaaatattctggtttaggaaatataaaagcaatgacaagaaatgggaggagtacttagagagtgtccggccagcaaaatattttcaattagcttaaatagacacctagacagaacaaataaatgtcttggtgatgtctgctccagaaggcccactggtctctgtggagtggtgggagcattagaaactgaagggggaacgcgtggtgtagtccctaaggaacagaagaatcttgcccgctggccacactagggctccacccaggcctcattctttccgctttgttccttgggacctttcgagtgtggacgagctgggcagcttgctgctaagctcaagggctaggatttttgtccaacaaccaagtgtcctcttgagtccttcatagcctcttatcatgacccactctaagccattggttttccacctttatcagcagaagtcttttgtcccataaaagtgtaactggacactctagaatataaaacagatacagatcagatcgaagctgcctctttacctccccagcagcagcccctgagccacctctgcagtgtcctagggaggttttccaaatgttcacttttaacacgggcatccatttatacaacaaaggaacatccagtgtctgtttctattttgatctgagctggatgtttaatagttcagcaagctagtattttaatacatgagatatcagtagctgctaggctttggaaaatccaatttttcattccatattcatgtagaatttgaaataaactgataagtgccagagaattgctctgaccccttagcaccttactagtacgtgctggctgactgattgcatctctctgcccaaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacattacatggttagaaaatgtcagtgttaaagaatggtacaaagtgaaaagtgtatccctctcttgccgccggtggtagcttgtcccagtggaagctgctgttaacaatttgtgcccccacatccccctccctgcccatccaccaaaaaaaagtacatttacttatgtaaatgtacttatggtgatgtatgtttgttttggcctcacagcatctgtttccccttaatttggtagctgctcacatttccctcgaaagaaccacaccctctgcattctcagttctctgctttggatgggacatttgccctgcagtccccccaccctccaggccatgccctctccagggtgaggcctgtgtgatctaccgtactagggtactaggccctgaaagaggcttttcttgttcctcctgcatcttgaacctggagcgggagctgttgtaggccccgcccttggagaagagaactgtctgacagtggggagagagcgccacacc

SEQ ID NO: 80957 - DNA, 1003 bp, Homo sapiens
tgctcattcttgaattttaaataaacggaattgcatagtaaatcttattttgtatctggcttctgtcacttaacatttttgggatttgttagatgtatcagtatttgttctctgttgctgtgaagtatttcattgtgtgaccataccagaatgtggccatttttacagcctaccatgttgggtagattgtatgagagtttaaaagctctagaaacccatcacatgggggcgctctgtgattggtaacctgggtgtgggtagtatgtgctgcctgaaacttagactatcttgaaagttaagaagaggaagaaaacccctggttttcctttttatgttgtaatttaagtcatatacatgcacctgacatcatgcagaagtttttgcctgtgccagttgaaaagcaagattctgatgataggtttgatgcttttcccctaatctgatagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggtaaagcagcaacaaccagctgagagactcataggctgtgctcggtcttttctttattattattattaattatgatgatgatgatgatttttttgagacagagttttgctcttgttgcctaggctggagtgcagcggcgtgatctcggctcactgcaacctccgcctccctggttcaagcgattctcctgcctcagcctcccgagtagctggaactacaggcgcccgccaccatgcctggctaattttgtatttttagtagagacagggtttcaccatgttggccaggctggtcttgaatttctgacttcaggtgatgcacccg

SEQ ID NO: 80958 - DNA, 1174 bp, Homo sapiens
agagactgaggataaacgtccgacatccagaaatgggcttttttagagccgaggcagcctccagaacttccagttccaatttatttcacaggcgagaaactgaggtcaacagggacgttggttagtggttcctggaggccctgaaggaacttttggacctggcttgtgcgttccagagaaaaaggtcggcctctgacggaaaacgaaaaatgagcactcagggacccacccagccgggacagagcgcctcagccggaccaagaggaggagccagtggggcggggccaaaatggcggaggggcggggcttccagaggcgggggttaggaaatggtacggggcggggcccggtaggctagcgagggccgggaggcggggcctcggaaaggcggacaggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggaggtccgcggcgcgcgcacaccctcccggctcttctctgtgcgggaccctgttccctatgaccccttacctgttctgtcttgggacctttctgaccccctaacctcctctactcatgccttgaatccttactgacccactgaagccactgttgaccctccattcctcctctgacccgcgcgccctgctgaccctcgctccagccctctgtcattccagtgccctgttcctcctgccatttctcaaaccacttcaatcacggatctgcccctcactgttcagctttgctctcccttcacccttcagtgccctggttgtctttgcgttgattcttgtggtcagtgagccctgcaaacagggagagtgacctttcccaatctactaaagagcatttccttctgttttgcggtgagtgggtgggagagtgggttgcagtgaagatggtcttccttaatggttatctcagctgtcttctaaatcagtataattttag

SEQ ID NO: 80959 - DNA, 1071 bp, Homo sapiens
cgccgccgcagcccagtgccctctgcccgcggcggtggatggcatgatggtgcggggaaggcaccgcggccttggccagctgagtcgcgacggccgccggggcggcggcagtggccgcggcagcggcggtggtagcgggctccccagcggcatgccagtgccccccgggcgcgatggctagcggcagcgccgggaagcccactggcgaggcggcttctccggctcctgcgagcgccatcggcggggccagctcgcagccgcggaagaggctggtatccgtctgcgaccactgcaagggcaagatgcagctggtggctgacctgctgctgctgtcgagcgaggcgcggcccgtgctcttcgagggccccgcctcctctggtgccggcgccgagtccttcgagcagtgccgggacaccatcatcgcgcgcaccaaggggctctccatcctcacccacgacgtgcagagccagctcaacatgggccgcttcggggaggcgggggacagcctggtggagctgggcgacctggtggtgtcgctgaccgagtgctcggcccacgcggcctatctggccgctgtggccacgccgggcgcccagcccgcgcagccgggcctggtggaccgctaccgcgtgacgcgatgccgccacgaggtggagcagggttgcgccgtgctgcgcgccacgccgctggccgacatgacgccgcagctgctgctggaggtgtcgcagggcctgtcgcgcaacctcaagttcctgacggacgcgtgcgccctggccagtgacaagtcacgggaccgcttttcgcgggagcagttcaagctgggcgtcaagtgcatgagcaccagcgcgtcggcgctgctggcctgcgtgcgcgaggtgaaggtggcgcccagtgagctggcgcgcagccgctgtgcgctcttcagcgggcccctggtgcaggcagtgagcgccctggtaggcttcgccaccgagccgcagttcctgggtcgcgcggcagctgtgagcgccgagggcaaggcggtgcagaccgccatcctgggcggcgccatgagcgtggtgtcggcctgcg

SEQ ID NO: 80960 - DNA, 1068 bp, Homo sapiens
tttcctggaaagtgatttagctccctttgtctccacttacctttccatcatcatgaacagtggctcaggctgcttgaattctgatttgtattctgcctatcattttcagattaaatcctaatcctgtgtggtatgccagccttcccaactcagagtctctggatggaactctaaaagtactgtacatcaagtgagaatagttagcatcttttatgtacacaggtctattcagacaagatcctcatgatttcagaaaaaatatagagagggtcctagactgcttaatagaggaaagaagtatcctggaaagcttgttaagaacgttctagagccacaacatgattgtaggccaagggcttgtttttgtgaccttgatctaagataatgccatggttgattgtatgttggaagaatctttgattggaatttggagtaatattaaggtagtttgtcttttctgcagacatttttaggagtctttttgtgtgagtggtggtggagtgtatagttttgttgaacctagttaaattctgaatatcttcccactaaaagcacaacaaatctatttacagtgcctgaagcctgggagagccacatgagtaaaaactcgtacgtggtttagatttgttccatttacatttttcttgggatttgttgtgcttaaacctttgcagttcccacagatctgaaaagaaagcatttttcactgtaatacattaagagagagagaaaaaagtcatattgactattttacttgtttgaatcgctgtttttattacaatgacatgaaatacaacgtgtaaaagtctttaacctgtgttgggtaagggtaggactgtttcaccaccctgaatttgaaatttgaaaaagtcttaaagtggtagggtacttaaatttttaaaaaaatgaccatgggagcagtttttctctgttaaatcctggtaaacttcgggtttttgaagactttaaaagatgaaaatgaccttgagcatctttattcctttcctctgccccttaatgttgggatggggttcaggatgaaagggaggtgggattctaattcatgtg

SEQ ID NO: 80961 - DNA, 1050 bp, Homo sapiens
tgcctgttttaagcatagcatttatgggtgatgttaggaaacacaaaaattatgtgtgtgtatttgctttcttccgcacccccaccatcctcatctgattggttattttacacacacttttttttttttttgagagggagtctcactctgtcgcccagggtgggatctcggctcactgcaagctccacctcccgggttcatgccattctcctgcctcagcctccctagtagctgggactgcaggtgcccgccaccacgcctggctaatttttttttttttttttttgtatttttagtagagacggggtttcaccgtgttagccaggatggtcttgatctcctgacctcgtgatccacccgcctcggcctcccaagtgctggggttacaggcgtgagccaccgcgccctaacttttttttttttttttttttttaaagctggcatggggatttaaaatatttggcagtttggaacagctaattttaacagaaacacctgtttttccgaatgaatgtgactatggtaacatgcagatcaggcagaggatttgaaaaatgactgccaaaattctttctgagctttgctgagtgaacgtggaaggatttagagaagaaatccttaaagatttagtagcattttcacctgggactgttccctgggctgccttgtggtttgcatcaactggaagaggctttaaggagaccatctctgagtttccagtgtgggcacaggtatttgtgttcctccctggcaaattcttgtctttacttaattttttttttttttttttggtaggagtatgtatgcaattaattgctccattttgactaagcagggttttactttagggttctttaggtaggtgagttgtctgcttcgacttcagtggcagaaggctttaagatttaactgtccgggtattataaggaaaaagtgtgatactagtgtctatgattggggtcaatttaatttaactgtggaccccttaaggttaagggctatagtgcccaacatatgtgtaatttttttttaaatgaatctgtatataag

SEQ ID NO: 80962 - DNA, 1018 bp, Homo sapiens
gcaggtattaccgtggatgtcatctaaacatttgtgccttgcctttcccattataaaaattaaatgaattcacatgaaatgtaagcccttgtgatgagctttaagatcttgtgatgagctttgtaagacaagtacctgccaggcatggttgcttaggcctgtaatcccagcactttgggaagctgagatgggtggattgcttaagcccaggagatcgagacccacctgggcaacatggcaagactctgtctttcaaaaaaaaaaacaaaatgttagccaggcatgatggcatgtgcccgtagtcccagctacttgggaggccgaggtgggaggatcacttgagcctgggaagtcgaggctgcagtgagccatcatctcaggacagcactctagcctagaggatagagcaagaccctgtccccccataaaatttaaaaaaagactagttctgtcttcttcataaagtaaacaaaagtatgatctaaaaaaactatgttaaagtcagtttcccttaataaccttgcctttacccttccagtaatttgacacagcaagtatactataacatcctcaaggacggcccagatgatgagcatagctctgttttctcagtctacctctgggaaggattctgtgtggtttcaaacctcctatccagattctctaaaacattgggtgtcttataattttaaaaccatgtcagtcaaacattttagacttcaggtaagatttgaatgctaattaagatttgttagcataatttaaaagtgaatccatttactgattttaaactttataattcatagtttgattggcaagtctgtttaaatgtcgaagataacatgtatccagattttgctgaagtagacatagagaggaaattttttaaatccaatgtttcaggaagggaaatatatatgctgtgcattcaagtttaatgaacatactgacctgaaaaactgctgaaattatagggcatcacctaagctttaatagcttctgattttgttctaatttt

SEQ ID NO: 80963 - DNA, 1123 bp, Homo sapiens
accaagaactgaactgggctcctgaagatgcacctggcctggagagtgcacctgtctggctgatagactgggagcttttcaaggcaatctgttgtgtctttttcatctgtcatccctagaaggtgaccaggatgctaaattgtttgtttaatgaaagaaaatcaatagctggcatttttttgagctcctgatgtatacgctagaaactttacattgtgtttctcagtccttaaagcaacccctttgaggtatgaagagtcgttctcattttacagatgaggatgctgaattgaaaccacttgcctagggtcaaagaaactagtaagtagggggataaaggtaagaatcaaggtcttgtgacagagacagcattcttagccacttggctatagtgaatgaatgatttttaggatagtgtccctctgcccattgaggcgaaatgctcttcaactctgttaaatttttaatctttccaatgacagttcctatgggtttcttcctaagcctcacttaagcctttggtctgagctcctcttggaccatttgtggagggccctggatgcccacaggccccttgtaaagactcgggcagagttgattccatggacagatggctttccacctgcttcatgatcctggtatcctaagggatgcttgaagaagataaacctctggtttgtcaaggaacttccacttggatttctaaattgcagctgcctttgctcttcacctacttggaacacttccatggttctcccgtggactttaggataaaaggcaaactcctcactgaggcatttctagcaggtctggtctctcacagtctacccataattatactttttagaggtccttccagtgtcatgctgtcttcttgcctccaagctgttgcacaagctgtcccttggaacactcaccccacatcctgcttctccttaacccgcttccgcagtcctcagcctgggtggcaccctctcctgcaggtccctgtagtaccctgcactttccctatgttagtatttatcaagttactgtaattctctgtttacctatccatgttcctagtatggatcatcatcaggtggtggcatcatctttttatctccagtgattaacgcagtta

SEQ ID NO: 80964 - DNA, 1086 bp, Homo sapiens
cattcagggttggccttatgggcacgtgccccttgaaaggagctggagaggaaaaaaatgttctgaactgttttcattcatgcttaggctgggaacacatgctggtcaccattgaatacaaaacctcctctggctcccagacgtagatcactcaaacacccaacctgatcttgaacttcaaaatgcaaaaaaagtaaactcggcagggagaaaactgcccactgactaccaaagatgacacagcatgaatatttcctccagctacacaatggagaagctgagtaatatgcagaattcactaaatgacggggactaagatcacaggggttttaaggtcagctgaaactcgattgccgtagttttccttcctcttgggtaaaagcttctctgagcaaaccacattttttcagagaatcaaggctagagtccctggtgaggcagttcgttcctggccttctgtcctgggccacgtgcttctcagcccttccctgttgggctgcgggagggttcaagatggaatgaggtaatgctggcaggacagctgcccagggagcgaacgaaactctgccctggttgcagcctaagcaggacaggaagcaaattagcagaagcaagcagtaatttgactgccaacaataggagtcaaaactgcatttctgaccctgcaccgttgatcctcctcacaacaatagtcatccacaagccataaaaaggccgatgaaacactatttgagattgcaaatgctggagtcaaaagagtcctgggtccaaattctggctctgccacccatccgctgtacgacctcggacaacttgcctaaggtctgttagactctgattcttaaatgtgcatatttcatcaaggtactgtatgaaatgaggatgtatgtaaagtgtgtagtacatagcaagagcccaataaatagacagtatgttctatgggcttttgtgaacccctgccatcttgagtttattaaccctccatgcgtaaaaactccctcacattttttgcttccttacgttcttttttttttttttgagatggagttttgctcttgttgcccaggctggagtgtaatggcgcaa

SEQ ID NO: 80965 - DNA, 1045 bp, Homo sapiens
tttcagtttcctggaggccatctgtggagtttccagggaacctgtaagtgcatgcctcgttcaaagattaccagaggtgccgcacccttcctggtatctttatgggcctgcctcctaaaatattcaaatcaaccctataacctgtgatcacttgtcctccagaaaagccttactgtttttaatgaaatcatttccagcaaactgtattcttgtgaaagcttactgtccatttctgcaggcctgaagggaggcggggctagtgactttcagccccttctctgcaagtctgtcctaaagagtagtgacagacatggcatggtccaccttctagtccttagatacaatctcaagataacaagtttgattgatgcgttggggtcaaattccttttcgtgctccaggtaccgaggagaaggcattgtatatgggacactagaggaggtgtgggactgtgtgaagccagctgttggaggcctacgagtgaagtgggatgagaatgtgaccggttttgaaattatccaaagcatcactgacgtaagtctttccaagcatgttatctctagatagtgtctgggccaggctatagtaaccccctcccatttcttctggaaggggtccgtgataccttttgttaagggggtgtgtcctgcaagcacaggctgcccactgcttgcagcattggaggcctgcctcagcccagtttcccggtgggaaacctcatgactcagagagggagagaagccccaaacagagtctctgcggggagcatacctgttccttgtgtggggctgctgcactaggcaacacaggatcctcagcccctggcacccacttccctgaagcctgggccagtagcagctccacgtacctgcatgaccccagttaccctctggtatgagggtcttcacgctttttgcttacatgcatccaacagatttttgagaaattatgcatcatcctcacacatccagttgatgtctattaataacatttagtttacaactaaattttcataagttgcaaagcatgtcatttttgacatgta

SEQ ID NO: 80966 - DNA, 1044 bp, Homo sapiens
accctcatttttaacatttgtattcctcctctactgcccagagcctttctactctgtgttctccaattcatcctaaaatcaagaccaaggtagaattctcgaacttggcctattctgaaaaaaatggacatggctgggacagagagcttgtgtgaatattcccaattggtaaggaatgagtttgcacactcatttattctgccatcaagcatttactggctgtctggtttgtgcctgaccctatgcacttccttagggaatggaataaaaaaaaatacatgatcttctccttaaagcaacttgatgcttgatagaatgacagacaaagcaagaattgaaacagagtgaggtgactgctgtgatgggtgaatgcttagagctagggaggggtagaagaggagagagaaggagtattgcttagtttgggtcttgaaagataagttactgttcttaaactacagtagtatactgttgaggggcacagatggaccattcaagacagaaagctgcaatggcctgtggggacaggcggaaactgccaccctcctccagtcactcaggccctaaaccatagctgtgacagtctatcaacttacattccaacctcacctgcaggacacaagggagagagttgccaaagaggtggctgtaggtaatggggtatatacatttggatactggacacagagaagacacagatccaaagtctcattgggataaggaagttaggagagcttgagtttccttgttcttattaaaatatatgaacactccttcattgattatcaataccatcctgtctgaatgcagacatctggtagtggtctcatgtcttcagcaggaactcccttcttttctatcctagcctcctgtccacatcccaataggcttagtgagtcttttgggtagaaaaaaatcttagagccttttattccaaatccctcctgataagtgaaagaagccagtcttaaacagctacatactgagccaggcatggtggctcatgcctgtaattgcagcactttgggaggctgaggcgggtgg

SEQ ID NO: 80967 - DNA, 1067 bp, Homo sapiens
attttatattttttgatgttgcataataatttttatagccacttaaaagaaggattccttttcatagcataaaattatcagaccagactttgtttttgaaatactttaatgggttttcttaataaactaggtcatttttaatactagttgtagacattttatctctaaatcttcagggccctggcatagctggtcaaatctaattggcctagactttggggaaaatgtgactggataattcactgtctgtttaatttcaacagataataatatatgagttagtttaggagagttatatcatctattggtttatttgaaaactttgataacataggaaaaactagcacttcgatttatagcatttgtaaataacatcattcaaactgccagatgtgctataaaatgtatacttagatcagcacattttgcatttaatagagaaaagaggcataacccagaaaaagttggagaaaaagttgcactttctgcagtctgttgggccctgacagatgtgccagtgtgggggaagtgacatgtcgagttgatagattgtctgtcttccttctccatgtttgagagaggtaataatgagcaggaaagtggccacaaagaggcagaccaagggatagagccaatctaccatctaaataatctaccttattgtgtaattcatgacgagacctcagtcattgaaaccctgtccccttctgtgacagcatagtaagactacgtttgtactgtgcccaatgccatgtccaaaccctagcctctgtttgttgaattcagtagaagccaagcaaaatgttgtcagtccacaagtagaagtgagagtgttcctgttcttacagaggggctggctttgtacactcatttatagataggcttcagagacagtgaggaaggctaggttgaggaagccacaaaaccacggctctcactcctggagaattatttgtattgaggtccagaggcagctatccttctgctcaggggacaggcataggcaacaccaacataatgccttttcccagacatcctggagtcggtgggtgaggggaggagaggct

SEQ ID NO: 80968 - DNA, 1193 bp, Homo sapiens
cgtttcttttttgtttttttttttttggtttttttttttggagaccgagtctcactctattgcccaggttggagtgcagtggcacgatctcagctcactgcaatctccacctcccaagttctcctccaagcgattctcctgcctcagcctctggagtagctgggattataggcacacagcaccatgcccaactaatttttgtagtgttagtggcgatgtggagaccatattggccaggctggtcttgaactcttgacctcaagtgatctgcctgccttggcctcccagagtgctgggattataggcgtgagccaccgctctcctggcccttaaaacatttctgcgaatgagataggggagtaaagattactagttcacacatgttaggtgttatggtaagatttcttttctatatatctcagacaaataatatataactaaaagggatcactaatgaaaataataatcattctgctgttttgggaccttttcagactatacttgaagtattgtttttcatttccgggtaccaaataccaagagggatgtaaataaatcatagtagttcaagtaggagagtggccacgataaaacaggaaatacaggtctagtcacagcaagattggcctggaaaagtgaacatgagacagctgtctttgagtagcttacagggtaatttgtgggagagggattaaacttgtcccatgtgataaaaactaggactgatggtcagaaacttcaggggaacatatttgggactcaagaattgtcagctgttacagttatccaaagatggaatgggctaccctgggagaaaatgagttttagagtatacaaggagagcttaaacagctactttagtagaacttcttgaccctcaagtttccttttaccccactgttgtgtgattctgtaactatgaggtttctggtatgaatgacgggggaaatagttggaatggggagaatggaattgccttttgaagtagataatatattcttagacatgttaaatttgaaaggaagttggcttccacagcagagatgccctggcatccattgtaaagtggtattggagatccaaggagaggcctggcttagagatggccttaggagtcccaagcataaaattagttaatttaaaccacacaaattataaattagttgtctcgctgagtggagagtttgttcaaa

SEQ ID NO: 80969 - DNA, 1081 bp, Homo sapiens
atcccaggagacatgaagccctggcacttagtagctctttggacttttcactggtattagttcactgagacttagtttctttacataggtaaagaaaggggataataattcatacagattgtgaagattaaaataacacaatttttttaaatacagtgcccagaacagcacctggcacacagtagttctcttattctctcaagatcatggaactgtttcagtagtgaagagaatataaaggaggattgagccctggatgagagaatcggccaaattattaagtttcctctaaccctgaggccctttgagtcaatatgtggttaattacattctttttaggaaggttcttttgctgattaattcctgaaagcagaaatctaagtttgtttgttttttttcccaaaagaaatttaggcttccatcacattaaggtttttgtgagactgagcgtcattagcagcatttgaaaaatagctgggttaaggccagtatgcattgtgaatcaaatctccaaatacagcatgtcatatacagtgcttttcaaccttatttgaatatagcatgcctattaacagccatggaatttgtagatttgtttgggaaacaccaatctagactattctcagatgctatttttcattttcattgagaactttcttaaggcggaagtaagagttaaaatcaaatcttaatccctcaaatctttgaagaagacctaagagcttttctccagcctctcctaccccgacaaatgcttataccaccactatttgaatacttctattgatggccagtgcacagccagcttcgtgatttaatggtgtttttttctatattgagcaaaatgtctgtcacctgctagtttccaatcatctgtaccaccattcatctctcttccatgcaacaactcttttatgtatttgaaataaatcattagttttctagttttatatccaggagaaaaactccaaatccttcacctgtttttctgttaggatttctgtatcctttcaccatttcagttgctgtcttttggacataatttatttggtcagcatccctcttaaagcaactatatttg

SEQ ID NO: 80970 - DNA, 1026 bp, Homo sapiens
tagccactattgacattttggaatatatcctccagctctttttttctgtgcatatatatgttttcttatatattttatttatgcatttaaagttgtaattttaaagtacacacattttaagagaggaaagatatacttttttacaaacaagttaattatagaatatttgcaaattacagaaataaaaagataaaaaccaggagctgactgaaacaatcattcactttttaaaactttaaagtatttcagacaatagataatataatgaacgttcatgtacctgccatccagactcaactaattttcatgtttttctttaattgtacaactttctttatacctggtgaaatgttagctatctaagtcccttatcccatcaataactcccatattcctcagcagtaccacttcttgaaacttgctgtgtaagtttgtcttccaatgctttaaaacttgtttgtaatttcagtaggtgtcagcaatatattttttttaatttttaaactttgcataatagtatcatattgttcatgaccttctgtaacatgctattattgtactgttttatgttttacagattttttttctatgttgattccattgtatgaattcattataatttattttttcaatctcctgttggtggatattgaagggtgctttcgattttttgctgtgacaaacacattaccgtgaatacttttgaacatttttttccttgtgcacatagatgagtttttctagggggtacttcttaaccctgtcaaactctaccttcttttcataacaaatattctgacatcacttttactacccaggaatgaaattcaaagataaaataatctgcctgcctgcataatttcaaaaatatcagtataatactttaatgtaagggataaataaaagtgaagtgatttacaataaaataacatgcattttagtatataaatgttccagtttgactacatgagttaagtcagatatttgtagtcaccatgtttctgtgacagtcacagatgaagcttg

SEQ ID NO: 80971 - DNA, 1027 bp, Homo sapiens
cactttaaccaaacagcttaaggataaattacgcctattttacaatatttgttttcgctattagaaagaagtgaaactgaagctccaggcatatgtcacaatgttggcctctttgctcattgacaagtgccgcctctgtaggaaagcactacagtagcactagtgcttatcatcccctgcaaacttcctttgtaagatgatgtataataaagaacattttttcaattactctttaaaatggataaaaatagcttctgtaagaaggtataacaaaatatccaaagggcatggtaatgtctactcagagttcaaggaaatgacaaacaacatacctctagaaattagtctaaaatcactacaggctgaggttccagtgagggagtgctcaaaaggctacctaagaagcgcctgaattattgaggcgctgagatgtcagttccaggggacctgcaatttagagcaaaacaagcctcgatcatcaaagaggactcaagtactgtgaaggttctagactagaaacagatacaggaacaagaccaacactgagtcatgtgggactagaacctccaaaagggtggaatagaacactcaggtctggaaatggaaaaggaaaactgtcggctcataagagcagattgctaaattttcaggaaatttgttaaccagttgttaaacttggccattattaaagattaaatcacataaatttataatcgagttaattatgttaaaaataaaggcaatgaatgcttaaatggagcaaaaaaaagtggctagcctttctgacaatatcaaaacacagtgaaactggaacacctggtatttggaaatgattcagtttgtgagagagtgtttaactgccagagcatccattcttttgccgttttctatggttaagagatgtgctttttaggttgggctttactaaagagccagacaatatagtactttaggctagaagatttttgtgttatgttaatggcctttcccccttattgctttttgaccttaccccttgcatattata

SEQ ID NO: 80972 - DNA, 1049 bp, Homo sapiens
ctttgtcagaaagaccacacacacctcttgaaaagttactttcagatttgatcacataatttccaagtgtcttccaagaaagtgagcatgatggccctgagtgaaaaactgtggcacttgaccaaaacctcagtttgtttctaatcatgtatggatagagtgtaatttgattaaagctgactggcctgaaatgatcccagtaagatgctgaactggatctggatgaaagcactcactggatgagtgcttgccctcatccaagcactaaggaatcactgaaatgaatgagtttgggatttcatgtcgaaatccatttttaatactaccaccttatgttttcatagtaccgtatgcttttcaaaatgcttttatctatagtatttgatccgtgcagtctgcttttagcttctatatttcaaaggccagtaatggttaggttggaagtaatacctatcagaatagtgactttgaaactttgaaatcatttccaggtgttttagataggctacatttgagtgatgaaactttaaactttcttttttataaaagaaaactttacgcttgaagtaacctttttagaaattagtagccccaaagatttcagggtgtgttgtattgttcttttttacagtgaatgggtgtaacttactgcaatgtgaataatgcatagtatttgtagggaaaagtagggaagtagccaaggagaaaagatgggacaaagaaaactgtgagttttctttaaatatctgaggagatggaaaggaattttaagcaattacttgacaaaataaactccccccccttttttttttattacagtagggataccaataagatggaaaaacaaaaatcaaggaaagttggagaataaaataatacctgcacagtatatatattttggtggcattgttgaggctgtacttgtgatctaatatccatttttaagtgttttgtagatattaaagttaatttgcatacatacgtatgtatctgtatatatacacatataataaatccagatatacatgtattatatatctatggataat

SEQ ID NO: 80973 - DNA, 1043 bp, Homo sapiens
ccagcttattaggaaacttgagtttctaggatgtggccaccagcttgtgtacatcttcgttgattctcatgttcactgtgttccccaagaattaatttctcccaagggcctacatcagtttagagtaggcaacgaggttgggtgtgtgtttttcattagtagatatattaatctgcccagacatgagatacactagcacggtttacagcctgaaaacacagctctaagagtttgtgggtaacagaacattagtcttacttaggtctttctaaatatcttcactcctcagagtaactttgagtgttttctggatttgagtttggctcattaaagtctgatttctacataattcagatacatccagagttttttggataatacatttgaaaaatttccccttatgaggttagacaagtttataaccgaaaccaagttcattaaacctatgctaaaatataaaattgtctttaagaaaagcccaaacaggtagaaagtgacagtttattagtaaaattataacaataatttgaatgtattgatattgaacgctacgtgatataaaaatacattatttcccaaggtcacaagtcattaccaagtttaagtttattttaaaatatagcagatccatagttttgttctttgtattcatcatagaatctttctgtgtatcctattttgttttctttgcctcattgattacaagattccgaaaacattgactactagattttgtggaaaagtagagaagctgagcatttgaacccactaacttcatctatctttttgagtaaagcaagctatttattttcataactagggaggccttacaacgtgggttgctgaggacatcctgtttatgcctgtcatcttggagaagttattaatagtgtcgcctttcaccgtttaaaatcgtagctcggatgataagttctatgtggtcacccttattatcactgatatattctgtccttgattattttatgctttgattttaataattctgtaagtgcatttttgactatacttttctgcatttttaa

SEQ ID NO: 80974 - DNA, 1498 bp, Homo sapiens
cctcttccaactactaaaggcattgtttcaactgtatatattttctctatttttgttttctcttcatcttggaaattgagttatgacacctttggttgtttctagttggaaaaaagcattattatgaaaatatatgctgtttagtgagcaatgaagcagaatataaaatatcactaatatcctgaacccccatgcaattagaagcacattgtcactagttttgttttatgtttcccagatgactgttaatttagcagttcagcacataattgcattgatgatcatatttctaaggatttgagtctattgattcaagtgtagaattgaagtaaaagttgttattccttcactgttgtatctgaatttgttttattatttgactctataatgactggaagaaatcagatatgcttggaaatcaaaggtaaattttctgtcccctgggaataggggtggaaaggaaagaggaacattttttttagctctaaacaaaatgagcaattagtagatttattgtataatagttgtttttcttcaaaaccacaagccttcaattttctaaaatgacaatagtaaattttcactttctaaacagtttacataatcagtttcactatatttgcatatattttgttaactgatactaacaatgatgccacaattttttttttttttttttaagttggagttttgctctgtcgcccaagctggagtgcaatggtgcaatctcggctcactgcaatctctgactcctgggttgaaacgattctcctgcctcagccttctgagtagctgggattataggcacccaccaccatgcccggctaatttttgtatttttagtagagacagggtttcactatgttggccaggctggtctcgaactcctgacctcgtgatccgcccgccttggcctcccaaagtgctgggattacaggcgagagccaccgctcccggccgaagccacaattattaatgcacttgaaagatatatcaaattagatttaaccaacgtttatttagtaccaactgcatgccaggtgttcactgagtcagttttgtttgttttcttacttaagccttgaaacaaactttagtggtaaatttctcttcattttgcatattaaaaaactgaaaggattttgacttgctcagcaaattacactatcccagccattgcttattagctataattttattttctgtgtagttgtatagctgagattatttgaaacactgttactgattcttctcacttactatgattattaaaaatgaaaatatgctctaatgatttttgatactctgcatatagaacccttgagtttcataggttctgtaggccctttctcctataaataatctgagactcacagagaggctgggtctcctccaagcttgggcagctgatagtttgagagttgatctagaacccgggtctttccctttgtaaggggcaaaaccactggaaaggacaggcagagaaatagctgggctc

SEQ ID NO: 80975 - DNA, 1104 bp, Homo sapiens
atcctctggttggagaaacagcactggattttaccagtgggacctctggcaagttggccactttgtgggaatttccagacctgaaactgcatctgcatagaaggaagttgaggtagatgaatctctatggccttcctttctctcctggttggttttccaggacccttcctcaccttttccactgtccatgtcttgggttttcctgtatttcttagttacgttgctgttttcagtaccctctgtgccctcttctctatctgtgggttgctttaagtgacattcagacagccagaggtccagaggccatttgacatagaggaattccatccttccaaagatctcttctcataagcaggagttttttgttttttaaacaaaacaaaatagttatcctgattggatccatgaggactagctcacttggctgtgcctcgggagaggtccagaatggctttcttggacttgaacgagctcagaagcattggcactttctcgtttacactggccttgattttgggtagagactgagcaggccgaagtcccctctctgaagccatcatgggatgatggtaaaaggcatctgcaatgttccagctctagcagggtcacaactgcactgagatgaacacaagggggcagcctttcccacagattttcatcaaatcacagagaaacagagtgcaatttcaatgtcagcgcatgcatgagcctgtgctctgtccacaccagtgcccatgtgtaaaacgtgtagcctgtaactgtttataaagggccttagggttaacggcatatgaatgctcagtagattttgtgctttactgtgctacagtttcgttaacacaacccaggacttctcattgtaggttatagactatatccccctgcctagcccagagtcttacacatggcaggcaggcaggttggcaggcagggcaggcagcaggtaggcaggcaggcaggcactttttattactggaggcttagagatgactgaatcattaatatagaggagttgaaattgatttagcctgctgtttcaacctgaagaatgacttcaaagcaggcatttaaatttattttggccctttttttcattctcttgcc

SEQ ID NO: 80976 - DNA, 1111 bp, Homo sapiens
ctttagaagtgaatacattggcttttcagtataaatctactggaattttaggtgaaagcaaaatactttcttggtctgaacatttcttattaaagaatatcagagtagtgatgttttaatgtgttcggattattcaactcccagagccaagatgatgttatcactggggattttttgtttagctcagatagtacactgaaactaactggttcttcctgccctcactgtgttctgggaggctcccaggtatgtcctggactgaaaaaggtgaggccatttgatgttaagagaagcagaaatattctgagtatctttctgttcttttctctgtgccatggtccagtcaacaggaggggagaacattgtcccaggcttttgtaaagccaagattaccccccagaagctgcttggagccggtttccagtctcctgagctaaggttgctgccaagggaaggcaagactcaattgcctctgcctaaagttgttattttgtatagtattctcataggtgtgctgtatagacttaagctccactactgctttccctcttttttaaaaaaattctcttattttctaccatttattttggcatttgtactcttccttgtgtttttctttgaatgttttacgttctataactctcatgtgcctggctaagcctttctagggcatgacccaggtaatgcataagcttgggtattcaggtttgtttttttcccgatgcataggtgttgtgccagcacagtatatcaaataaacttgcccctgcccctgcttccttccccgctgtttcactaccacgtttcccatacaactgtagtttgtttctggatgctgttttctattctgctgtatttgcaagcctgtattgtttgattttgagggtatcaataattcatttttgaatctggttctgtcacttttagctttaataattgggggctatttttaaacatttattctatataaacttgaaatgattttatctcctgcgatacattaaatgtctatgttaagacatcttatttacagaagtaaattatgaccactcttttactgtaaaggtaattatatagaaaaagctaagcaagttgccttcctagggctgat

SEQ ID NO: 80977 - DNA, 1038 bp, Homo sapiens
aagaatttaagtaggctactaaaaaaaataggaaaagagtacttttctgggggaaaagtactcttttgttctagtgaagttgatctgaaagacgtcgtccagcaatatatgtagaaaagaaatcagattcactgtctgttgctgaaactctgactttccctctccattcttattcagtgttgcaaagattcaaaactttttgatagcttttaagaggaagtttgaaatagcagaggtgatagagggaattagtttttctgagaaccaaggcaaaaggagtgaatccttaaaactcctgaattgtcaacattgatgttggagccccactccagattcgggttggagtgtgactccgcaagtagacattttggagaaggaggagtggctgatgcagaacctgtggcttaaagtaggaggagggagagagttttctactgggaggcatatgtattaatacaagcttacagacaaagtggagaaggaaacagtagtaaccatattgtcccagattcttctctgacaagccatatgcctgttcaacaaagccattagctgtgtggggtagattcagagtgaaagtttgagttctttttttttttttttttttttgcaagaagttattaactataaaaatgggcatatgttcttctaaaatgatattctgacaaaataatggttcacaaatacaaagcagcccacacaattgcagtataatttgttttattaaaataaaaggatatatttattcttttaagatatcgtttacaaggaaaatcctcaactgaacctccagaattatgttaagagcagtaggggttgcaagcacgtagattcttccctggaacacaatatattatggtcttttaaaaaacacttggcctttttctggttttatacatagagtgaggagagttagttatctttgcttagggaagaaagtccccctctcctttgtagatgagcacagagcttttaccttcctaacacccagacctgctgatttagagaggactaactgcaaattccctaaggactggg

SEQ ID NO: 80978 - DNA, 1042 bp, Homo sapiens
ctttatgctcataggtaatcagattgactatccagtttatttgtaatggagaccagtgttaatactgattatattcatgacaataattaacatcagttagagcttactatgtgctagaaattatactaaatattcggaagtgattatcttctttattccctgccaaatgagatacatacatttcacagatgggaaaattgacacaaagattaagtaactttccttgatcccataataatatttattaagatgggatatttacttctgtatctgtagttatttaatatgtttccatattacttgagtttttttccttttctcttgatgtcttattgatgacttgttacattgtatctttccttctgcccttaaataacccattctttatatactacaattcttctaatatattatgtatcatctttaagtcttggttcctgcttatcatagatgactttatattttaattttctaattgagatttggtttgtttttttctcaaaggaaatcatttatggtctgaatcttagtataatttggaatgaatttcttttatttgatatgctatattctctttatcatatttttatgtgtactctaattcaatgctttgcgactagtggattacagttgccttttacagatgtgacaagccactgatttctttagctcttgaagctgctgagcaggttatgggaaggtgggagtccccttgtctatcacccagatcagattgttagcatacaggttgataaaatgcttattttacaacttaagatgtgtctgttaattctcattttcactgtctgaagtaactggcaatgactatataagttcttttgaacacatagattaatacagcttcataatctaataactgtttatctactaataagcccattgctgccatagatattgtataagaacaaaggattatttgatgggaattctcttcccctccatcttcaaagagtatattcctcttttactcttaaatgacatttaacaatgtagaggccagataattagggaagatgaaatg

SEQ ID NO: 80979 - DNA, 1047 bp, Homo sapiens
gcgagactccacctcagaaaaaagaaaaaaattaggaacaggtaaaataactcctgccctgcattggcaggagaaaggtcagtggtatttgcagacataagtgagcttgtagattgggatgtggggcacttgaaggaaatctgagtaataggttccattttctctctgaggtaggacataagattactgcctatttgggagtgaaagtagagttgaggattaggagttgggaagagggcctgaagagggtagtgcacatttcagacagccgatgtgagagatgggcaaggcagtggactaaggttacaaactaggattgtggggttggaaatcatgagtactttgtgatactaggcctcagcactgagaaacaaattaaggatatgacacattaacatttacattaaactaataataataatcacaaaataaccttccaaaaaccttataatttagttatgctgagtttaggaagaatggatacatctaagttattcactgattatgaatgtcacctccattcatgtatgcttaatgagcccaaactgactaatgattctagccctaacacaggttaaacagtgtttctcctgccgtgagcatgctgagcatctgaatgacgctctgccatttcaccatctctcctagattaatgcgctcacagggactctttttacttctaaagtcctagaagaaagagcagagagggagactgaatcccaagtgaatccaaattctgaacaaggagagcaagtatatgactggagcactggcttggaggacacagatgattctcacctttacttctctccagaacagggaaatgtggtgtttaccagtgcaatagatgggtggggctttgggtaagtctgtttgcatctgattaaatctctttgcagattttatatgcagttgattgtttttagtgaaacttttattttgagataattatagattcacctatagttgtaagagataatgcagagagttctctggtgccctttacccagtaactgcctcctatccatgataacatcttgtagaact

SEQ ID NO: 80980 - DNA, 1950 bp, Homo sapiens
tgattgagcagattcatacactgctctttgacaaactgtagggaagaacttggccaactgctttgttggccctttgaacagctcttactgtcaggcccttaggcattgatttctttcagtttcaatttcctaacctgtaaaaggagaatagtaatatgtatctcatagggatattgtaaggattcaataatatgtgattagcacattaaaagtgagtatcatagtggctggctcccaataagctcttaagtggtaactattagaataataaagtcctttaacattttatatagatgctatttggaatcagtagtcccatcagtgggaaaagttggaatggtagctctggattgagctttcaactcctttagctttgttcagttttttcttagaagctttcagctttcttattctagaacgcctgaggaagaacattgtgtacctggacaactgaaaatgtgtgtttacaaattgtattttaggtaatgaggagtacctgatcaatctgatagactctccaggacacgtggacttttcctcagaagtatcaaccgctgttcgcatttgtgatggatgcatcattgtggtagatgctgtggaaggagtctgtccacaggtaatggattgtgatgagaaaatacttaaatggttaagggtgaggaaagagggggaactgactgactttaggcatttcactgacaatcacaacattggttttatatttcacatttggtaacgttccagtctgtgaaggagttaaatcaccagagttctgaagggatcttagagatgatgactttaatttaacatactttgtttttgtttttgtttgttttgagacagagtcttgctctgtcacccaggctttagtgcagtggcatgatcttggcttactgcaacctccgcctcctgggttcaagtgattttcatgcttcaacctccagagtaactgggattacaggcatgtgccaccatgcctggctaatttctgtacttttaatacagacgggattttgccatgttggccaggctagtcttgaattcctggcctcaagcagtccacctgcctcagcctcccagagtgctgagatacaggtgtgacccaccatgcccggccttatttatccttcttaactgtcagttgcataaaggcaacaatgatttcttatgtgtagttctttgctactccgctgtatacatagtttgtgaatgcctaatgaatacctttgtctgactggcatagtctagagtggttattaatcacgattttctaatgtgctctaattatttcaaatcatgagttttacatttttctttctgtttttatcagacacaggcagttctgcgacaagcttggcttgaaaacatccgtccggttttagtgattaataagattgatcgcttgatagtggaactgaaattcaccccacaagaggcctattctcacctcaagaatattttagaacaggtattttaatttttagtatttaaaaaatttagccacgaagaagagttgtaaggaagttactgagctgggtatgagccgttgctacagaaaagggaacttttccacttcagattcatacgtgttgctgttattctacaagagaggcaatagaaaaagcatgttctcagtagtcttttccatctcttggaatcacccatcatataaagcttggacaataggctctcttgtttaaaactgtatcttggttccaaagtgaagccatattaggattttattacctgtctgtagtattttattacctgtcgttacaggaaattttacccaagcattcattcatttatttattcagcaaatatttcatagatatatgttgaataaatgaattatcaaatgtccattgtgcactagggattgtgaatataagatgaacaggtcagaatccctattttcaaggagctcacagtatagtaggggagacaaag

SEQ ID NO: 80981 - DNA, 1078 bp, Homo sapiens
gcagatgcatgccaccgtgcccggctaatttttgtatttttagtagaggcggggtttcaccatgttggccaggctggtcttgaactcctgaccgcaggtgatccgcccgcctcggtgtcccaaagtgctgggattacagtcgggagccaccgcgcccagccaggtatgctttcttgattgcatagaccagagacttaagctagcttgggttggggtgggatagattattgaaagcatatgtgtgaaatgatattggaaataatattcatgaaaacggaaaaacaggagtcttattggagtgatgtctcataaaaattggagccagatttttattctggatccaagatagctctagagaccgtatcagtaaaagtttatggatccttcctctggaactccactgttgtccttggatttgggtgtctgtttgtatttccactattatcctgtatgtcttttctctgtctcatagcttttgcctactgtcatgtcttcatctttgtacattcaccttgccctgacttcttaccctattatcctgtctgttttcaccttatttctgttgcctactgcttcaatctcttgtgtttctgagcacacaggctcaagagcaggatgcggctctgcttatcttttcatgccagcccatcacagaggttgcacctatggattggctgcgcttgggttggttagtcacctcctaatccaatcagtggtgatcggagtggagtcacaaagtgtcaaacatgtttcttgtgagcatgggattactgcctagaagggaatttgggccgagcagtcatcacacttgacagtgcagagccttatggggatagaagttaggaatgttgactgggacatatcctctcagagcacttgagagatgagatatgtttttatctgtatcttagtactgattctccagaatggggtatttcctgttctgaaggtgggacgtctgaaggggaacctagatgggagaaaaagagggaaacctgatgattgaagaaactccacaggtgacttttatttataccatgccttcccctccttctcacccacttcgaatgccctctta

SEQ ID NO: 80982 - DNA, 1035 bp, Homo sapiens
cagctaacaaatacaaagagtgaaccctaatgtaaactatggactttaattaatcataatgcatcaatattggttcatcagttgtaacaaaggtatcacaccatatgctaatacaagatagatataataggggaaactgtgtgggtgggaggagagagtatgtgggaaccttcagtcaatttttctgtaaacttaaaggtgctctaaaaatataaagttattaatttaaacaattactagcaatatagacaatttttgattctcttgactaggaaacttttttgttttgtttttcattgacattgttgaggaacatttgacacttttgacctggtaatgttcctaatgtggctcactgtactttggacatatagaaagcatagtatatataaataaatatttttgaatgaatgactttaaagaagagtaacacaactgacaaaacaccagcaagatgatcaagaagaaaagagaggaggcagaaatatgtgatacccagaaagaaaaatgctgcagaagttaataaggtaataataggatataatgaacaactctgtgccagtaaacttaaaagtgctaaaatggaaaaatgtctggaaaacataacttgctaaaatggagtcaagaagaaataggaaacttgaattattctatagtcatttaagaaattgaattggctggcaaaaatctttccataaagtaaagacccagatggtttaactctctagttctgccaaacattcaaagaataatttcagtcctacttaaaccatttcaaaatatagcagagaaaaacccaacaatcggcagtattctccaaatcatatgaagatagcataactttgataccaaaagtctgttaaggatagtacaatataggagaattatataccaaccttatgattatggatgcaaaaattatcatcctcattaacaaacaattcagcatagtataaaaagatgattattcatatccaaatcgagtttatcccaaggaattcaagattggtttaacatgtaatttcactatattaa

SEQ ID NO: 80983 - DNA, 1035 bp, Homo sapiens
gggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaaaaaaaaaaaaaaaagatttttgttcaagcacaatatagctagactagtgtcatatactcaatgaaacaaatatttaccaagcatttattgagtggaagataaaaagcacaaagcataattataaaatattttcccctgccaccataaagaaattgaacaggcttacagaatatagcataagacaacatgaccaaagcaaaaatagtaaggactaaagaggggaggaaggggaaatatcaacatgaactgaatatgacccagaagagccttcatggatggtcagacatgtaaagacaaattgggtagggttaaggggtggagttcagggcacattctatagggaaacagcagctgatacagaagcctgaaaggaaaagcaggcagagcacctggacagggctcttcaggaacgagcacgcacctgtgtgaaaaacaacttaatgaggtcccattcacccaaacattagagaaaccgcataaaaatgcttcttggtaagcaagaagaaggcagtgcctggcttg

SEQ ID NO: 80984 - DNA, 1073 bp, Homo sapiens
gctgtttccctatagaatgtgccctgaactccaccccttaaccctacccaatttgtctttacatgtctgaccatccatgaaggctcttctgggtcatattcagttcatgttgatatttccccttcctcccctctttagtccttactatttttgctttggtcatgttgtcttatgctatattctgtaagcctgttcaatttctttatggtggcaggggaaaatattttataattatgctttgtgctttttatcttccactcaataaatgcttggtaaatatttgtttcattgagtatatgacactagtctagctatattgtgcttgaacaaaaatcttttttttttttttttccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatgtatttttcacccaagaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcagtagacgcagcaaagaaagcgaacaaaaatcttaactg

SEQ ID NO: 80985 - DNA, 1030 bp, Homo sapiens
aactttctgcaatacacagtacagctgcctataacaaagaatgtccagcccaggatgtctacgttgccaagattgagaaacggtgttttagagtgattgataggaaggggttgtgaaaacagatacaaatggcatggtacattgggtaaaagtcatagagttgtaaatggggataccacatggtcaggtgtgtgttgaaggaagatcactctggaaaagtgggaggcattgagaaccctgttggctcttaaagggtccttcaggtcgcctctggacccccttgagagtgctgtggctctaggggcctgtgttttcttctggggtccactcacagatctcaccagtaactgctcactgaatccattttctcgttccaggacttcggcagtctgtccaaccttcaggtcactcagcctacagttgggatgaatttcaaaacgcctcggggacctgtttgaattttttctgtagtgctgtattattttcaataaatctgggacaacagccttgcctgtgtcatctttgcagttgtgtgtgggtagaggaaaggcaggagctctcgaggcaacagatcagctggcacttgtctgggattcaggtgctgctgcatctggtttatggggagtgggttcaccagagtttagtaaaggagcaagggcaagcctgaacgtgttgagagtggtctgcagtatgagcctggaaagctgctttggcagctccaccctgcttccctgggtcttcagcccctgctgggtacatacaatttgggccaacttgcccatgttcagaaggtagcaacaggattatcgtgtatcagaggttgactttctttcagtgggagttaggatgaatggtgtctttgtgtccaatgttgagcccaatgcctagaacataggagatctcaacaaatgtgaataaatgtgtatgggaggattgatactgggatgcttcagcctaaccggaggcagagctcaccagctgcaacctgggtagactaccctggactctgagctttatttaggctctctgt

SEQ ID NO: 80986 - DNA, 1738 bp, Homo sapiens
ccggcgcccggcactgtttagccgggccctctccggctcagcgcagccggcggtccccaaccacaccggccggggctcggcgccgcactcttcccagaaggttgcgctggctcgtgagtgatcctgtcctctccacccgcagggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcagggtgagtcgggccttcctcggcctccggggctccgcgatctgtttgtgtgctctgccgccctccgactcgggaagagacggtgccttggtggtttcgttagcctgagactccctggtgtcccggagaagggctagagctctgcgtgtgcaggatttctgttgtgaacttaggcctgtgtcatgactggccgcggtgaccctgggtcgaaggtagccaccgtcagacctcttgctttgaagctacgttgcttttagttgtcaacttttttctttcttttttttcttttttttttgagacggaatcttgccctggcgcccaggctagagtgcagtggcgccatctcggctcactgcaacctccgtctcccgggttcaagcgattgtcatgcctcagccttcccagtagctgggattagaggcacgtgctaccacactcggctaatttttgtatttttagtagacaacagggtttcacaatgttgaccaggctggtctcgaacacctgacctcaagcgatccgcccgcctcggcctcccaaattgctgggattacaggcgtgagccacctcgcccggctggatgtcaacttctaatgcttacttcacagttgcagttactgttcgagagatttataggcatatggcctggaagaatagtgccaaagtcaacgtattaattgccaagttatgtgaatttgaaattggaagaaaatgaaggctgtgaagggtcgtgaaactgcggggcggggcggggcgagttgggggtggggcgcttgatcatcatgaaggagagtttgaatagagagtgagaaaccaaggggaaggaatgctcaggccagtggaggttctatgtgtaggaggtcccaggatagtgagtcctcttccttctcactgtggaaaagaactaaagcgggtatttatatatgcacatgtgctcagtaccaggtgggagttgatttgtcttctcactgttctctttggctgtgtgtgctttgtagttatgtcacgcatctgatgaagcgaattcagagaggcccagtaagaggtatctccatcaagctgcaggaggaggagagagaaaggagagacaattatgttcctgaggtaaactttctggatatttgggcttctggctaatcctcaaatgataaagctatgggttcttggcttccaaagggacctcagctgaatctgagacctttaatccatacattccataaccagctgtgggtgcccataggccccctaccagtttcttagcctccattctgctcttctggaaccagttaagtctattccatatttcatgagagcccttaatgttgatttgatgactgctgtcgtggctcgattgtttgcccctaatatagtattctttggtgtaaacacagacttcaagtgttctgaatactgaatgagggcatgggaaggtaaggccagaagaaca

SEQ ID NO: 80987 - DNA, 2751 bp, Homo sapiens
tcctcctttacatctgaacttctggacgactttgatatttgcatctgggctgtacccacaggtgtcagcgacaggcagaaagcagcgaggtggctttctattgaatgttcctgggtgatggaatgtggatctggatgtgtttggcagtgcttctcaaaccttaattacagacacatcacctgaggatcttagattctgattcagtgggtttggggcggaccctgagattccatgtgtccaacaagtatccaagtggtgtcaatgctgctagtcagtatcatcctttgacaggtgttaggggaagtttgggacctcttaggacaccagcagcagtccttccatgcttagtgggtgctttttaaattttgtttaaaaatttgttgcagtgatgccattgatcagatttggagtctctgaatatggttaaactgaggctctcaagtgagagtttgaagttaagtttgaattgttagttaaagcctgagaccaagtatctctctgatcagcctcatctacgaggcttttatggatctggatctttcacagataatctccatagtcagataattgctcagagattagtggcttgcctgacgttacacagcaaccaagagatgggactagactgagaaacccagtcacctctcctcacttaatgggaagaaagcaggatgttgcctagcattagaatttttagtcagtatccttatacattctccacgttagcagccatgtgatacaactactctgtaggaggtgagaagggcaggggaataggagagcagctgtcatggttagaggggataagagaaactagcatggtctctgcacacactacgagcccaacatgtttaagtaaggggacctgtaacaaggatggtgggtttgccatagttaatcaggcttctgtgttggggtgagagcattcctagggaccatttcttctaacccacagaggccatcgggagtctcccacccttctccaaacagaacaagcagctcgtgcaacagctcctgtgtctggtgctgacacaggcatggcatcctcctttttgttcccccaacccaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaagaaaaaaaaaattttttgttttatttgaaactggaccggataaacggtgtttgagcggctgctgtatatagttttaaatggtttattgcacctccttaagttgcacttatgtgggggggtggggttgatagaagtttttaatcacaaagtcacaggacttttttcttttgtaactgagctaaaaagggctgcttttcggtgggggcagatgaaggctcacaggagccctttctcttagagggggcaagtacccttcccttatatctttaatttgaggaatgtatgagataacagttgcagttgactgaaatgccactggaatttgaaaacttgacttttttttctttcctttttttttttttttttttttttaaaaagaaacaaaaaacccacaaaaactacttgcccctcctagggaagctgtgtgccaaagaaccagtgtcataacccctccctcctgctgagctgacgttgcattgttgcatatcccagctactctgtgggttttgtgaagctgtgtgtgaagtctctacctcattgtagtatatgcaggcaagactgcactctcctacagatgtgtggagtaagctgtggtgtagtttttttggcacataataaacacgttgcagcagagttctggttttgtctctgtgtttgaggtctgggagcaaggggctaacgggagggagtaagggggtaatggcacagccacagcttgtttccttggatttctgtgatggagatcctggcccaggataatggtgggaccatgtgggagacctgccctgtgagtacttcttggtcccttccatc

SEQ ID NO: 80988 - DNA, 1125 bp, Homo sapiens
ggtgagttggctggtttatgcccttactctggggtatatgagaggggtttgggcagttactacccagggcaggcctgagacctgaagctgtttgtgctgggtgtgtttagggaagtgagccaaattcctgagaattaacattgaggttagggtttgggagtgggcttggtctttgtacgcccaggaggaagggaactgggactgttgagcctcttcagtgtgtagggtgccttccctcactgtggtatttctttggcattgctcagtagcctgacttcctattttccaaccttttgggaatcctccgaacacttgcctatactgctaattgatagagggctgaggtacagtttgcctagaagaccaggcattaaggtgtgtggttgcctgaatcccagaggcatccagcctgactgtgcatggtgtatgagtctgtcctctagaactcctttctgtacttcaggcccataattctctccaagcctcctttaaaacaggcaaatatcctgcattccaatatcccgcattcctgtgtgtggccaataatgtgcccttcttctatcgcctatcgagcctcctggtaagaagagccacttcatcatcttattttgcctttgtgcaggttcagattgacccctacctagaagattctctgtgtcatatctgcagttctcagcctggtcctttcttctgtcgagatcaggtgggtccgatgtctatgaagtccctgccctctattaaaaattgttggctgggcgcggtggttcacacctgtaatcccagcactttgggatgccaaggtgggcggatcaggaggaccagcctggccaacatggtgaaaccccgtctctattaaaaatacaacaattagcctggcgtggtggcaggcgcctgtaatcccagctacttgggaggctgaggcaggcgaatagcttgaacccaggaggcggaggttgcagtgagtcgagatcacgccactgcacttcagcctgggacagagcgagactccgtgtcaaaaaaaaaaaattgttatgccaagttcatgacattgaatgttggagttctgaggtaccctgtggtgtctgagagcatagaggaggcagcagtaatgtttgctgaaggtca

SEQ ID NO: 80989 - DNA, 1029 bp, Homo sapiens
aaagatccccaggtggttctagtgggtagtgtttgagaaccacttgtcaaagcaagttttgagctcaggaatcagtgcggtggtaaaatcggatttgagagcacacaacttttgtgacattggactagatatttaatatctctgaaactttgtttcctcttctcttctataagatgggaaactaaaatgcctattttagtaaaaaagatcagtggttgccaggggtttagcaggaagggatgaagagacatagcacagaggatttttagggcagtgaaactattctgtatatggtggatacatgtcattatactttggtccaaacccatagaaggtaaaagaaacaccaggattgaactctgatgcaaaccatggactttcggtggggatgatgggtcagtataaaaaaatgttccactctcatgcgggatcctgatagtggggaagtcacgcaagtgtgggggcagagagtatttggagaatccctgtactttctgctcagatttactgtaaaccttaaagcttctctaaaaaaatctatagggtaagaggagaaatgcctattttattgggatggtcacattagatttaaaataaatccatgtaacaaagctggctcttgttctgtgttagagagagggcaggctcatcctctggctgcccacagtgacccacagcttccctaccttctctgcttctttattctctggagcttgtgtagtcttcccaccttagtatgttctaggacttaattaacatgctcctttttcctcccctcctgctttcacaaccagagatggccatatgcatatcacagagcccttccccttcctcctcagtgcccctgtagacaccatcctgtctcccattccctcccatcaccttacagggatttaatctttctttgattcactggctataggctgatgcagttctccttcctctctacttttctttttcctttgtgttcctctccccgccagcaccaacatagccaatatagccaatctttgactcccttcttctttt

SEQ ID NO: 80990 - DNA, 1037 bp, Homo sapiens
ccatctactcttgcaaggtgtttctaggaggtgttccttgggatattacagaaggtgagctgtctctaagacctgctttaagagttgaagggtggggcatgtctttcaggagcatgaaacttggaattgaggccaggggctgaatgccctgcctgagctcagggtattacatgagtgtctgaggggagaggtgcatttcatagacccccatagtgctccttatgtcgggagcttacaccggagatcagcattcgtttctgagttgtttgtcagtggggatgagccagggaggagaatgctggtgattctgtgtttgtgtctttactgggaaagatggttcctcagcttctgccattcttttctgtctctttgcagctggattagttaacaccttccgtgtttttggctctttgagtgtggagtggcctggtaaggatggcaagcatccccggtgtcctcccaaaggtaatatgcctaaaggtaataaagacatggtaggagcttttttttcccttccctagtacataactgcacctaggggtgctgggatgtcacagctgcatgttggtaacatggtgggcactccagggcacagacctgccatctgtcagcactttctcttcaacctaacatgtccctctgtttcttctgagctaatgttccatctgtccagacttacacagcagtgggagttgcctctgaaaccccttccttgtacacttctctctaaacctgaacccaagcagcacctttcctctcaaaataaggcgtttgaaaagctttcccttgcctgcctgtcctgcccagttacgttgttgcctgacctaattctgaagtccctttggagttggcaggaatgaggaccaagcatctgattcctcactggtctgaaatgagatcccttccctgtagaaaggagcaggtgctattttcaccctgccccatcttcattgaactgaactaatggtttaagtaggtgtttaaagcaatacctgccatctttcctgccaccaggaaagcctggctctgctgacctg

SEQ ID NO: 80991 - DNA, 1032 bp, Homo sapiens
ctgtggcctccaccctgtttggcgcaggtctttttttagaatgctttgcagagcctgggcccgttgtgtctgttaggcattttaatgcccagttgttttggtaaaaccccatttaggagaggggtattgaaattgttttatgtggatgtggatggggagagctttaccttaagtaactatctctgggttaagatagggtttcttgaagtactggccttctgctgactcaggtttttccagaaaggtcagcaactaccctgttcccctgggcaaggaagtatggtatcactgtttggtattctatgcctggagaccacggtactttgttttgtgtgttcttgacgccaaccttgggggcctatgaagccagcctcccctgtcctcacttccaccgtatctgagcaaaagatagaagaactcacacaggagatgggcacctgtctgtgggtgatcagtgtttgaccaaggcactgtctttcattggcatcaggttgaagtatagcccttctttggctctcattctctaagctacaatgctctttctgaaatacattataacattgggcccatagaaatgcaggtgtgccccactgggggcttggagagcttggtctgaaagttactatgaaattgagctattaaaagtagcttggatctagtcataatatccacagcttctccaccacctgaaaggcctgtgcttgtagctgtttgtctctgaaatagaaatggtttttcttttccactttccatcccaagcactttagtgataaatattacatgattttgtcgaccagggagggactgcagcctgagcctcagaattcataaggaccagaaccagagttgccccagcagtatgatctggctgtgtaggcaggttagtgtgggtatgttttcctttctgagggttgaggacacacccatccctaatcgtcatgttgcctttggttttggagctgtggtgacagccattgctcttctttccctgggctctgggccttcttggaaagcccacatgagggtactacc

SEQ ID NO: 80992 - DNA, 1047 bp, Homo sapiens
taaccccactgtagttgaggaacatctgtatattaattttgtgggtatcactttttagcgctgttgagtcttccagtacatgaacatggtttatgatttttttttttttttttttttttttttttgagaccgagtctagctctgttgcccaggctggagtgcagtggcacgatcttggctcactgcaacctctccccttcctgggctcaagcaattctcctgcctcagcctcctaagtagctgggactgcaggcgtgtgccactgtgcctggctaatgttttttgtatttttagtagagacaggttttcaccacgttggccagactggtcttgagctcctgacctcaagcgatctgcctgcctcagcctcccaaagtgctgggattacagacttgagccactgcacctggcctcaaatattttctttaatcctcacaaaacacctaaaagatggctactgttgcatctttaaagaagaaaagattctcagaaagacacagtggcagacctggtgagcagagcaaggtctgtcagtcatctaaagctgttgatttttccagcctgccacactaatggttttaacaggtatggcctgcattgagttggagctagtgaagaaatcctacaatggtagtgaaaatctttatctagaagaaacaacagattgaggaatgtctggataaggaggaaggtgaggtctgtggtgggggttgtaggggtgagggtagaattatactgtgtgtagaactccaagctcctggatgcatgtagccatttggtcttaaatgggtttaacagacctgttgctcaggcctggggtctttcagcttggggtgggaagattgtgttagttgtacacatcagtactgttcaaacttttgagatgggaactactttgtcgcccaggctggagtacagtggtgcagtcatggctttcactgctgccttgaactcctgggctcaagcaatcttcccaaagttctgggattataggcatgagccaccacacccgactgctcaaactttttttgcatacatatatattaa

SEQ ID NO: 80993 - DNA, 1041 bp, Homo sapiens
attttttaacctatcatattggcagaacttaaagttgaatagtaccagtgttggtaacagtgttcacaaatgcataggaaatggtacaaaaggaatatctcaaactgttcattcagagaagagagtaggattgaggacaaggaacgctgccgagatgtgaaagtgatcatcttttacttattacttgcatgctattttaaaaaacaaaatggaattttacaatataattgtataaagggcatggtgggggaagggctcgggttttgaatgagatgagtgcttagcttggtcaaattgcttcacctgttttgtgccatggctttaatgcttgtaaaagggatataatgcctgtcttctccatggggttgttttgaggaatgtggtgatagttgtaagttgcctagttcttcctggacttcaaaaataagttttctgctctttttctcccttgaaaagtgagaatgtgatgtttcatttaaattttgaaagtcttattctgcatggtaccacccccatctgctggaatgtccagactttgccgctgaaagcttaactgttggttgtgtcttgatcacagtctgtattacttccactttggagaatgtggtctagtttccaaacgtagatatgttgcatcattttgtctggagaataaatgagtacatttatgggggtagagggaactatgcagagatcagcacttaaggcttctggaattagtactggggggagggtcttcctactgtgaaataaagggcttccgctaaatgccctccaaagtcactcttatttttaatgttttgtggcttatttaaatttatgatcctaatatcattttgtcattgaactcctgatgtcaaatttgaaatctaatatgggcttttatctgcaaaaactactcaagtttatttaggggatgttgtcaccttacccagtttaatagcttgcattttttttcttgttacaatgtgttcactgtaaaaaaaaaaaaaaaaaaaagcaaattaggaaaaaaaaattatgtcatcttactactgagaa

SEQ ID NO: 80994 - DNA, 1061 bp, Homo sapiens
cttgtccagaccttcttgttgtacaaccaaaagactggcagctggtgtttaccttttcccttaaggcccagaggttagcagctttatagataaaggcaatcctaatcataaacctgactatatttgtagaaaactagtagagttagcctacccctttttgccttaaatcctggtgcttgattctcttccttaatagtatcctttgtggaaatttttccacaaattggccaagaatattttggtatttttttcttacagttccgagtacttagctcatagtaaacactcattaagtgttttaatgtataaagaagatacttaagtccttcctactttatctaattcgtaatgtggagagaaagggggtcataaaggagtgtagaaaacctaaatatctttttttttctgtgtctaggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccaggtgatttaggtttgaaaacttgaacgtggtaggcatctgtacagatctgcttctaagtagtgcatgtaagaggtcttccttggaaagcttgtgaagaacaatgttgagttgctggcaatacttgcctttttgtggtttagtttatggattgaatccctctctgggtgaagactgcctttgattaggatgtgtaaacctactttatgatacacagaaaggttggggaaaaaagaaaaggtcacagattacacaagtatttatataaagagatataatgtggatcacatatgttacagattttctggtagccatgttaaaattaagatacagatgaaattaatattttatttaacccaatatattataatatgacaacatttaatatgaaaactattaatgagattttttttattagtactacgacttcaaaatccagtgtggattttacaagcatatctcaacatggacatt

SEQ ID NO: 80995 - DNA, 1053 bp, Homo sapiens
ccacactggaccacttttgataatgcctctctactctcttgtgttctttagaacttcctctttacccccatttccaggcacattctgtccctccaggccaccttggcttggaggacaatgtacatttacagcacgttgtagtctgtgttgtggatgtttacaggatcgggtcttagttctttttctttctttttttttttgagacagggtcttgctctgtcacccatgctggagtgtggtggcacaatctctgctcactgcaacctctgcctcctgggttcaagcattcctcctacctcagcttcctgagtagctgggactacaggcatgtaccaccatacctgtctaatgttttgtattttttgtagaaacagggtttcgccatgttgcccaggctggttttgagctcctgcctgccaaaagttcttttccagacttcaaaactttattttggtttagtctgtgtctaatctgctgccccttggggtgctcactatagagagcaggcagtcggctaatgtttattaggcagtgaagaatgaagcatgtagccttaagataatgcagattgtgctaggcaatggcacgtgcctgtagtctcagctactcaggaggccaaggtgggaggagcacttgagcccaggagtttcaagttcagcctgggcaacacagcgagacctcctctctgcaggttataaatctttgcatcttagccttcatgaagttgccttcctgaaattgagaatcagcttagaaatctacagttgtgaaaagggccttgtgtgtcactggatttaacagttctcaatggcaccactctagagagcttgggaaaacaaccttgtaggattgtgtattttggtcgtcttcacagtttgcagagggtaccaatcttcaagaacttgaggctgacgtgaggctcaagtttgtccctttaaggtcatcctgcagagttggtaaaactgtaaatgctcttggtcattctcatgctcacttggattttagtaggccaaacaaaatgacattgggcctcttcttgttttgttttgatgt

SEQ ID NO: 80996 - DNA, 1018 bp, Homo sapiens
ccagcactttgggaggcccaggcgggcagatcacctgaggtcagaagttcaagaccagcctggccaacaaggtgaattcccgtctctcctaaaaatacaaaaattagccgggcatggtggtgggcgcctataatcgaagctacttgggaggctgaggcaggagaatcgcttaaacccaggaagtggaagttgcagtgagccgagatcagccactgcactccagcctgaacgacagagcgagacttcgtctcaaaaaacaaaacaaaacttggtttcccccctccgaaccgtttgtcttgtaaacaactccctggtctaggctcccatgtgtgggagggaggttgtgccagcctgtgcagcacatcagaggttggagagctgatgcctgtggtgaataatcatggaaccgtttgcagtttgggttaggccataggcgtttgatacaggaatggttctatgtgcttttctttcgctgtagtgcacaaaccagtgcccatgaagtaaaaagtggaggaggaagataaagtagtaagactccaggctcagcaccaaacttaactagtgaccaaatgataatagctgccttaataagcattttcactgagcacaaccattagttttattcttagtctttaaaatgggttgcaaactcaaaccctataggggccagaggtaacataaatgagcaaaggaggaggaaagaaaggtaatggcttctgaactacagagtatgtgcctctttgaaaggagcagccactagctgattgttgctcagcaaaaatgtgggcccagagtcggtggatctttgacttgcttctaaactggctatctctattttgatggatctcctgacttttaaatgtagcattaaaaaaattttaaacactatagaccaaatgtaacatgtctttaatgttggattcaacctgaaggctagtttggaatctgtcttaaaacatccgttttggatttccccgctgttttgcagaaaaggaaacaggctttagaaatcaagtca

SEQ ID NO: 80997 - DNA, 1017 bp, Homo sapiens
gatcacagagaaactcatgctgccagacacctgtcggagtgaccacattgtggtgcagaaagtgactgccactgccaacctgggtcgtgttccttgtgggacatctgatgagtacaggtactaggccaccagtagaggggaaatgatgagcatgggggccctggtttgaaggaggagccccagctgctgatccccttccaaacacagtcacccttagcagctcttcctcaccccttctattcccacctcaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctcccatctatacctccccatgacacctaggctgtcagtctctctcatctttctctctctctctcatcatcctcctcatgccagatagcattcagggtgtcctctctccctctggaggaccaagccctcccctaatgccctccccatggattccttagtgatctgtgcagagagagatggcagccactcccttcagtcctcccagatttctgtagctatttatgtagcaggctcaataaaatgtcttctctctagctgctggctcacctttccttctaggggtttgtcaggaacaactcttgttgaatccccaaggtaaccatctctgggtcaggatgcctaggagtctgcaggcatctctgtggaagagacatctgggctggggtggcaaggcagagctggaagagcaccttggtcctttttatagcctctgcaaaaacaagtcctcttcaatggctggcagacccccttagttcttcttacggtcccttgggaaggaaggactcataacatggggacttccccaaacacaggtgctcagttcaacatatgtcaactactccagttagggggcctggaggccccacctg

SEQ ID NO: 80998 - DNA, 2192 bp, Homo sapiens
agcccagaacaagggcaggtggggagggacagctgggtggaagcgccggtcctaagcagggagaggagacgttctgcctgaaagtgtcggcttaaagaatctgtttctgagcctcctgtgtccccatccccccgtcagctgacccacctcttcctgttcctccagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaaggtgggagctgaaatcaagggtaaccttcctaggggaatggaaaggaactggccagagtctctgccccagaccttcctgaggcccctagccaggcaccaggcttctgtggacagtcctgctccctggctcactccttttgtccctcctgtggcaccaggaattactctttcaccctcccataaccactgccagcatcatctcacctgagggtctgccttcctggccaggatggacttgtgcctcctctcctctcaggctcccttttccatctccctccctgagcagacactaggctttggaatacataccaagatcttaaataccaaggacccaggaaggcagaaagcaaaacaacacacaaaggagaggtgtatatttttataaaggtcctgagaaagcagttgcctgcattctgtgagcttagtcactacagtcagtccaaatcccaggccccagggcttcagccttgcctctgttcctgggcttggcccttaaggcctcttttcccaagacaacggccttgagatgggcctgggagggaagggtcctcccgctgcttctccgggccccaggagtggaagccaggaacctacacagaagagagcctccttcacaaagctcagttcttctgggtatcttttcgttctttttctcttccctggacctcacgaatggggagattctgagggtgggcacagctttgaaattctcccaggaagaaggcaacagtccctttctccccgacaccatcctcactcacaggcctgtgctgccctcctccagcagtgcctcaactctgatccagacttctacacactcatgctctgactgttcatccctccctgctgagtccagagcctgactagacgtgcatgctgagcagacaggtcggcagcatctgtgggcccagagtctcctcctgcccacctctgtaggctgcctttccctggccctcagtccctgctctggcctggccagacagccttttcttccagcatgtgggcctaaaggtgcagtcagggtggaagagccattagggcacacatccatctccttcccctacccacctgggaagtcccaaccagaatcaccacccagccccacctggaaaacagctcccagagctttccctcactgctgctacctgcctgacctctaaacctatccctagaccgggaccacttccagctgggctcactgtcccacctgcttaatgccaaggccacaggctaccaggagctcccagactggccggaggaagccccagacccatctgtgcgcaacgtggaggtcagcggggtggagggttgaagtgtgtgtgtgtgtgtgtgtgtgtgtgtgtgtgtgtgtgtgtgtgtgtgtgtgtgtgttggtgggggcagacagtagggagccctggcagtgccggcccagccctcctaacaccctcccccacacacacaggaagaagatctctcccttattgagactcacgtgggcctgttgggcgaatacactgaggtcccaccttcgtgtgacgtgtgctctctcccctgccctgtctgtgtccctcttcttcccctgtgtgttgtgctcctgggccttcccatactctgtttccaccttggtttggcagtgctcctctgtgagcagcattccctcccctccatggacagtgcccctttcttcctcctctgttattccctttgtgggacagaccaggtagggcctcacaaagaggtggaataaagggtaagggcttgtgcctgcctgccttctccccaaccatgatgaaatgaccctgcaccctacccccatctccaggtacctgaatggaccaagtgctcaaatcgggagaaga

SEQ ID NO: 80999 - DNA, 1329 bp, Homo sapiens
tccaggagattctcctaaaatgaagcataatgtgctgagcttttcaaggtgtcagggacatcaaacaccatgacgatttccacactctcccactcagttaagcaggacagggattggcaaactactgcccataggctgaatttggcctattcctgtttttgtaataaagttttgttggaacacagccctgctcattcatttacaaattacctatggctgcttttgtgctacaacagcagggttaactagttgcaacagactgtattgcccacaaagcctagaatagttattctctggcccttttataaaaagactctgccaatccttgaagcaaaacctctggctaggtggctggggtctacagatttatagcagggatatcccctggagactgtagcatccctgccatgtccactgtgcgtgggagtctttggatggtggcacttatctttttcagtggcttctttgatccattgtggccagagtgagccccagaggctcaaggtgaggtaggcagggccaccaagtgctgtgactgtaatcaggagtcaaaggacagcagcaacatgtggaggcaactgagtctgtataattaaatatgctagccttatcaaaagtaacttccaaaccttaggtcttcaggtggaaggaggagagacactggaccatgtgaccctgagcttgttatcagtgttgtgggcaaagcagattggagagagagaagttagagggggagagagagaagttagagggagaaagagcaccatggggaagcgttcaatcgttgaaaaaatatttgtatacttcctttgttcaggtgggaggaaggagcaagtgggaggaatgtttgaaaagatgaagcagcctgggtggggagccacccaggtaggtgggagtcttgacatgctcagcaatgagccagagtcctaaaccccaggatggtgaggttggcatgttttcataagcctgggcctgtccacatgtcatttcccccaagttgtcactgtgagctacatgtgcatttgttcatttatttaacatatatgtaggtgggagtctgacatgctcagcactgagccagagtcctaaaccccaggatggtgaggttggcatgttttcataagcctgggcctgtccacatgtcatttcccccaagttgttactgtgagctacatgtgcatttgttcatttatttaacatgtaggcctactatttgcctggtactgtgctgcgtcctgaggatatgacaatgagtgagacacatttacaggtctccagatactcacagccaagtaggagaaacaggacaaaaataaacattttaaacac

SEQ ID NO: 81000 - DNA, 1032 bp, Homo sapiens
agcttaagattcctacagatttgaaagagttaaatgttttttctggtgatgaatttttttttttttttttttttttttttttttgagacagggtctccctttgtcagccaggctggagtgcagtggcatgatcttggctcactgcaacctcctccaggttcaagcgactcttctgtctcagcatcctgagtagctgggattacaggtgtgtaccaccacgcccagctaactttttttgtatttttagtagagacggggtttcaccatgttggccaggctggtcttgaactcctgacctcaagcgagctacccatctcagcctcccaaagtgctgggattacaagcatgagccactgcacccagcctgatgaattgtttttgatgtgatatttatttgcttcagcttgttttcctctaaggacttacgcagatttcttaaaataagatgaaaatttaaatagcaggaccctagattgtaattcagtaacttaaattttagtaaatgctgttatcactcttgcttcattgagccatcagacaaccctgtgacatcattcagaaaaggcatgcttattccagtgttacaaatgaatctagagtccagaggagttaaacagcttgccttgggtctcaacaacagaaatcagaagacacctaagatgtctcttggtttctgccccctgcaccgggccatctttccacatataatctcatgacccttgccagatgattgtattataaaaatagtatcacatttagatgagagtcataccactctaacctgtggataaagttgttctgttcattattttgaaagtctattatttggaaagtctacttcttgcatacatttttcctttcttctttttttttgagatagagttttgctcttgttacctaggctggagtgcagtggcgcagtctcagctcatcgcaacctctgcctcctggattcaagcaattctcttgcctcagcctcccgagtagctgggattacaggcatgtgccaccacgcccagctaattttgtatt

SEQ ID NO: 81001 - DNA, 1249 bp, Homo sapiens
cactgaaggcctctgagaagtggcgcttgccccaatatctgaagggtaaatggaagttgagagaaaataaaaagtgaggagtattccgggcagaaggaatagcactgccaaaagtcccctgccttgagggaagttggcaaattaggagcttaaagaaaacctgcggggctggatcgcagagagtgcaggacagtgtggtatgagggaaaatgctggccagacaggcaggggtcagaccatgcaggggcttgtgggctgggtgaaggacttttttttagtcttaaataattgttgataaaaacaccaagtaggaaacaacttaacgtctgtcagtttgttaagttatggtaccttcataaaacagaaaactacgtagctgttaagcatgattcttgatttttttttatgagtggcaagagtttctgatacattgtgcagaatcaacaagatagaaagcagaatgatgatcctggttttgtggtcaaactatccatatgagcctgtctgtctagctagacatagaaacaatatggaagcaagtgtgccaaaatataagaagcagttgcctcaactaggtgagatcatgacttactgtctttttaaaaatggaatacctaaaattttatatcaatgaacatgtattatttttatcataataaaaaagttaataaaatttcttttaaaaaggatattctgcaggtagtatggaggcaataaaaaaaggattagctcatgataaatgtttccctttttaatgaggtgtaattatattttatttttataatccaacaggaatgcagaaagaaatggaacaggatgcgaagagatttggtcaggctgcctgggccacagcaattcccaggttggaaaaacttcagctaatgctagctcgagagactctgcaactcatgagagcgaaagagttgtgtttaaatcacaaaagagctgaaattcagggaaaggtaagacaaagataaacataactttgttttaaaaatacacttttatttttaaaacattttgtataaataaaggatacaagtgcagtttttgttccatggatatattgtgtagtggtgaagtttgggcttttagtgtaatcatcacctgtataatgtaattgtacctattaaatatttctcatcccccctcccaccctcttactcttctgagtctccagtgtgtattattccacactgtgtatacacattacttagctcccacttataagtgagaccatgtggtaaag

SEQ ID NO: 81002 - DNA, 1402 bp, Homo sapiens
cactccagcctgggcaacaagagcgaaactcagtctcaaaaaaaaaaaaaagatgatagtggcaataatacaaatttcatgtgaggataaagtatcataaggcatgaaaagtacttggcattgaggctgaaacctactcaataaatgttagtattatctgtattactgtattattttttacatagatgaaggattttatgtgcatatcgcatattatatattggtacagtgcgtggttaagcacaggtgaaacagttctaatttttcaggtatttgtaggttgctctgcttttgtaggtatgctcggaaatgtgatgagtattaataatgttatggggaaatgtgtttaaacagtcacattaaaacattgttgggacacatcccatttaagaatggcgactgcctatgtgtcctctcatggttggcggattgtttttcatctcttaaagcactctgctgggaacaaattatttccataagcagccaggcaaccctcatcatagactgcggaggagacagtaccattgggccgctccagaactaatattaatgaatgccttacactatagcccaaatgcagtgcttttttcttttaatcttttatgctataccagggtaatattaaaaaccatgtaggtgatttgtattattccaccaggatcagtgcaaagaaaatcatcggttcagattgcaacaggctgaagaaagcataagatactctcgtcagcatcacagtattcagatggtgagtctcctccgaaggaaaatgttctatgtttgtgtagcgtgacatgcaggcctagacttgtggaaactggagttgcgctgccctggacctgcagctgtcagccattagcctccaggtctgcagcctgggcgcagccttggggtggtaatgttggggtacagcctctttctttgctgagacatttttattgtatgccaagacattttttgtaatgttgagcaatttacaaatatacatttgtttaaatatagaaaagagacaagataaaagaagaggagcaaaagaaaaaagaatggatcaaccaagaacgtcaaaaaacactccaacgattgagatcatttaaagatgtaagttctataaacaatcacctcatctacacttctggggaaataactgaagaccaccctaaaaaagatgaaagtatgaagtattaagaacaggtcattcagaacgtgaaacatttaaaaaataccattatttctggtatatcaataaaaaacaacaaaaatagaatatcagtgattcaaaacccatgatacaaaataactgctgtttttgacatcacaacacgcttgggttcctgctctgcactcctcactgagtagtcctaactggcactggtggtttagattggcagggaaaactgaaaactgt

SEQ ID NO: 81003 - DNA, 1006 bp, Homo sapiens
tccagtgtcttaactaactggtacacagcagcctgaggggcctcagttggcacagctgggaggggcgtgagtccctttcagcagctgcagcctgggtctccctctgtggcatggccactgccaggtttcccagccactgccaggttgcccacgggtctgtcatgtgtgctaccttttcagaatgcaaatccaactcctgtgtatgaatgaatgtgcctcactgtgctggcccaggcctgatgggccaagccctgactctgcactggcccctgtacctgccgctcccacccaggttcccaggggtgttccagtgggggacgcaacctgcgggctactcgctgggcatcaggtccagatcccagagacaggtccagtggctgtggcccaggcctccttccccaccacagacaggccaggctcagcatcaaacttcctagggaaagaatttggaattgaaaaagtagcaaaatcacaactttgtgggacttttcttatgcatattttgcagtttggcattgtttgtaattacgtatttataatttcagtattttgagataccagcgagcttaatcaggctaaaataattctcagaatttgctttctaagggctgccaaacacaagaggcctttgaaaaaaggatccttttcaaaagaacgttctcacaataaaaattcctggcccaattgtgtcttctgtgcatcaacgcttcctttcctcctctggaaccttctctccttcctttctcccttttcctgctttttccagccaagccttgaagtcaatccagactttggcttcagggaattcagagccaaggaagtggggacaagtgtctcctattgcccagcttcagagctctccagtcggcctccaaagcactgccagtcttcacctctccctggctttccagcccacacaggaagggcagcccctcagcctggcagacaaaaccctcagagacttggttgcctcccctgggcagcccctgcccctgccacaggtttt

SEQ ID NO: 81004 - DNA, 1029 bp, Homo sapiens
ttataaataatttataatttcagatttgactttattttttactggagttttttgaaattatacttttaaatttccaggtagtttattttgttgttgttttttagcatttcttacaaacttctagttttattgccttgtcaaagagagtatggcctgtacaatttgtgtgcattttggagatcatggatgttttcttgagacctgatttttagttttaatacatatctccaggaaactgaagaagaaagcatattctctgaagggaacaaaattcaatcagatgtattcatttgaccttacaaagtataatattatggacctttaattttaatttacttgattcattaaggctaagaaagatatgttcgtctcctattattgtatttctgtctgtttcttttgtttctaacagtttttgctttgtttctttttgatgttatttggcaaatgatctttttatatttaagggaaaaaatattttcctttaaaggcttgtatacctttgtgaattttacctgattttgttgtaatagtttctgtagaaatacatagttcagtaaaatatttgtgtctgtttttaagtcaacagaaatctttcagaaatcctttgtatcttgacaagatactttggaagttcttgatctccctaagtaggctaatgtccttgcaggctactcctgaaccaaagcataagtggaagtgggggctggggcatattaggcttgggattttttgagtgtgccaatgtttctggttcttgctttggggcaaccccatgcttagggatgtttaggggatgcctgcccttcatctggtcatattctgcctcagtagggcccacacaaaggcaacctatgaggcacttttcttctgtggggactagccttctgagaaggcaggagaatgtagctttatatgcctggctattggggtaaaagctaatctcagagactcattccaccagataagattttggttttttttttctgtagagtcagagtcccgccatgttttccaggctggtcctga

SEQ ID NO: 81005 - DNA, 1031 bp, Homo sapiens
tgtaccttggatacttaggttgtttccaatttttttactgttgtagtcaaggacataatgaagttcttctaacatccttgcgaacttttcagaatattgacttagggtaattttctgaagttatcactggctcaaaagtacgcgcctccctatctgcggctcctttccttctgaggcatacaggacttcaccctccatcccccttgtactcattcagggtcctatgactaattctggccaatgaaatgtgagcacaggtgacacatgaagctccagacagacactgaaatgcccatgagcagttccgcagtgtctgccttcccttccctcagcaaatgctgatgtcccagggacagagcctctgtcaagcctggatccctgagtgactacgtggagcagcccccttctcccttcatgttaccctcacctgccaccctgcatggacgggtagcatgaataaaaaaaataaaccttaggtgttaaacactggggtttcagggttaattggttaactgcagcataacatatcctgttgcaacaataaaaaagaatgcacatttttaggacttgtaatatgtattgcctcaaattgccttccagaaagacagacccaattatactcccacccacagtgtgtgagtgtgtactgcttcctctttaacactggagttaccctggggacagagagctaaaaaaaatatttttttggttaaaatgtaaccctttaaggtgttcagcagtatcattgatttctaagaggtttatttcataaacattgtaaaacaaaattttaagttgcacgtatggctttttaaaaacgtttagacatttaaaaaaacaccttttagtcaagtttatctgttacttttttttttttttttaatggttgctacctatgccgtcatgcttatgcaggtctttccaattcttttttttttttttttttttttttttttttgagacggggtccaccctggcccccaggctggagtgcagtggcgtgatctcagctcactgcaacctgcgcctcc

SEQ ID NO: 81006 - DNA, 1043 bp, Homo sapiens
ctggacagctgggaagaaatcacaggcatttcggggggagagagcagctcagctgacaagccttggccctcatgacagaggtgttccacccagctctgcgtcctgcctttttcagtttctcctagggaagggactgcagccataaacctctcctctctcacagagctgctcagtggggccagcgggcctgtgggtgctgttggcatcctgccctgggagattgcccgtgtgtggcaataatggcttgaatccctggccccacacatctctaaatgccttgagcaggggggaggctttggtgccccctcacccctttgagaaccacctaagaggactactccttctagaaaccttctcccatggacgtggttagactttctccctgctgaatttggattaatgagcaaacaacccgaggaaggagggagatggggtccgaacccaggtgccctgggccccaaggtgaacacgagtcctcctgctctccttcccttcccctcacggagacgcctctctgagctggggagtcttgtttgggatgtggatggaagggaaggctgggcatctggagcaccaaggcacttttagaggagctcccgcaaggtgagtgggggctttggttgagtacatagggcttttggcagacaggaagtggaaagcgtggccagccatctttgtgattcggggtagtctgctgctggcccttccctttccccagagctccagacggctctcaggacagttggtagcagctccctcctggctgcaccaggagaccagagagccgagctggctatgagtcagccccgtggcccagcagcgggataaggggattctcaagccagcctggtctgcccagcagcaggctgggtgtgtggctgcctgggagcagtggacactgggttccaaacaccttccgctggggtcttcagatgacctctgcctttatcaggtgacttatgaatctagaaagagcccgcttgactgacaagagaatgctcaggtgacatgcatagaatagttactgaagccacttgtacatt

SEQ ID NO: 81007 - DNA, 1051 bp, Homo sapiens
aggaggaggtcactgaagtgcctgctgcttcccttctgatgtcttggtcacaggcttgtgtgctggggtagcatgtctctaggcagcttaagccctggcccaggccctcagattggatggagaatggttggttcagctgtagcaggttttgaaggatgactctcgtcactcagttttctagacccttctcccttttgcttggccaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgg

SEQ ID NO: 81008 - DNA, 1031 bp, Homo sapiens
catgccgagcagacagccggctgctttgcctgtgcctggtcaggaagctctgccatcttctcggctccctgtgccttcccctccatctctccactttgctttcctcacttcctccctcctgtaggcctcagggacagagagtgcttgcggaaggctactgctgggccaccacaggccgcactcatctccaccctccttcctgaccagaacagctctgcctccccttgccccttgcccccatcctttgcatccagagaccctgttcttggtccccctgttgccccacctccagccccctctacagctgtgggagaactttctggagtctccctgtgtcattcagtcaccagtgttgttctggagtagagatgctggctctaggggccacttctttttttcttttttagatcatctgattatatctaatgtgaatgtctccccagcttccttgaaagtaaaaatcacctggagttcttaaaaatggagccccttgggcccttccttggagagccaggttcaaggggggctaggatggggcctgggaacatgtatttttagtaagtgtaccagctaattcctgtcatggagatttagggaacacccgtctaagcatgcccaaaccgagacccaatccctcttttctgatgtagggaataggagggaagatctgaaagtctgggtcccttcccagaaaggccttctctaacccgtgggcccccagcccagcccatttagtgctctgacaatgaggcataatttgattcttcaacaaatgttctgtagttgctgccctttaaattgctccttcctttcacgtatgtaggagaatactgtgtgtggaagtgttttcctttatggtgttgtacttagatgattagcaaaatatggtgctgggctgagagtggcacagctgggtgatccagactgcagactggattatatcacatggatggggtatgagggcttgcactgatatgcacacactccctgtcgtctggcctctcttgacagcagatgcgggaaattacagt

SEQ ID NO: 81009 - DNA, 1138 bp, Homo sapiens
ttctttttgaagacagtcttgctgtgttgcccaggctggagtgcagtggcacaatctcagctcactgcaacctccaccttctgggctcaagtgattctcctgcctcagcctcctgagtagctgggattacaggtgtgtgccaacacgcccagctaatttttgtatttttagtagagacgaggtttcaccatgttggccaggctggtctcaaactcctaagctcagatgatctgcctgcctcggcctccaaaagtgctgggattacaagtgtaagccaccccacctggtcgaaattaaatttcaacatgagttttggaggggacagacaaactaaagcggtccttataaaagaggcctgagagagctgccttgctgcttccatcacatgaggatacagtgagagtatgccatctgtgagtcagaaagtgtgccctcaccagacaccaaatctactggcaccttgactttggacctctcatcagaactgtgagaaataaatttctgttgtttataagctatacgcagcctctcgtattttgtgatagcagcccgtgtggactgggacagtgtgtgtcagtgtcagggagtgggatatatgacatgaagattatagatgggttggacttactggtaatgaaaggttatgacagggagttggagaggcaagagaagagaaggtcaagaactgagcccagctggaagaaccatctatgtgtgtattgaaatcacaaagaatcaagacaagattagtgtaggagagagggactgtgatctagagctaaaatcattgagaaatgagggggagtatcatgggggttggtggttgacagagtctgatgataggagattcagggctggggaattttagggagggggaagagaattatctagaaggggcaatgaggagcctagtggtccagctgtgaaaatgttctgaaggagaattatggggtgccatgaaagcaaataataggtatctaacctggtatggaggggctgggaaggcttccctgaggaagtgacatttgagagggtggtgggttgggctagaggaggtcaaagggaagaaggaactcttaagggttacacagccaaagggaaatttctctgaacagttctgggggctgaatgtggacaa

SEQ ID NO: 81010 - DNA, 1085 bp, Homo sapiens
gtatttttagtagagacggggtttcatcgtgttagccaggatgatctcaatctcctgacctcatgattcgcctgccccggcctcccaaagtgctgggattacaggcatcagccaccatgcccggccacacccagctaattcttttgtatttttagtagagatggggttttaccatgttggcctggctggtcttgaacccttggcctcaaatgatctgcccacctcagcctcccaaagtgctgggccccagccctacctttgtttcctataattgctcaccacagcatgccagtaagcatgcaggtgttatttacttatttataatccgtcttcccccagtagcatcccaaaaggataggaccttatctttttcaccagtgtattccaacacctagcacagtgcctggcaccaaataggcctccagtaaataatttttaattgagttaatgcttgaatgttgtgggcagccttgcttggatgctggcctggaagctgtgataatttttgggttaacttttatatagcttgcttaattgggagttgcaagggccaagagagaaagagatcacatttggatgcagctttcttttaacattaaagcaagccatttagctttcattgtgatgtgggttaattttcgggccgtctgctgtcatttgagtactggagttgtaaattacctttttactctcctgcaaaagactaacagaaaagccagcttgtctactgttgtgacttttagctgattttgtcagtgtttacaaataagatctactgtattactgtttggcttcattttacactcacttattttgttcagccaagattaccttgccatgtacaggtgccacaatcttggttatctaacacctcaggctgccttttggtactctataccgatttactttcttttgatgttcattcattccttctttaattttccattccctctgaatcacaccagactctgtagttccaacaaattatagggctgttctttggggtttgagttgactgcaatagatacagtctttcagatatgttgaggtgagtttgtcttctcttggtcctgtgggtttgttaa

SEQ ID NO: 81011 - DNA, 1070 bp, Homo sapiens
catgaacagcaactgtgggtgattttacccagaggcacccaagttggcaggccgtatttctgtaacatttccagtgagtcctcagtggactgtgaaaaggctgatctttgagcagtgagagcctttgaggttctcagatttcatactttaaaaaaatgtacagggaaaaaggagttggcaaatgtaaggtctcagaatggaagataaaagggatccggtaattttaactctctttctggccctccctccccctggccaacacaaaaccaatccaccgtacttgtgtgatcaaaaacaagtactgaaactctgtggttgagatcaaatagttctgtggaaatgaaaatgtttactcactcataaaaccttaaagaaaatgtcaaaaaataatttttgtttgtggagaagcagggaggagacgcttggggattttgtttaaacacagaatatgtctttcatgtaattttaacatcattcgataaatgtatatattactcacttctcgtagataaaggctggtttgtaactcctacctacctctgccatttttaatagatccatgtcttctattatttatgtgaaaatacaagccatggtcgtaaattgagatgcagctaagggctggggaagcaattcagacaggagggtggagggagccgttttaactgaaaatagaaccaatgtcatcctttctgagagttgtgtaggatggagggggaagaactttttgaaagggcagctagtagaaaaccttgctgcgatcctacagcttcgtcatggctctgctgtgtagacaggactaggatttaagggaaaaaaaaacaaactatctgagtttacctccccccaacttgagatgcttctcctccctcaaatgttcactaccattttccacttctcttctgcgaagtgttctgtgttaagtgtggcctctccagtgagtttgtgttcttactccctaaggcaactatttcatacctattcccctttccagacctctccccttcctaggcacaccccgtggcttccctttcaattgacaagataggcacctttgaccaagggaatgt

SEQ ID NO: 81012 - DNA, 1095 bp, Homo sapiens
cagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgttaccatgagaaaagtttgggtgtcttctgttggtcatagttttacatctgattttacagaatggattattgattttttggaagttgagactttaaaaaaaatagatcttacttgcgaaatgcgatggttgctgggaatacctgaaactgtggattatattgcttgacttctacctcagaatcttctttgtttcatgacttaatagtgctttaagtttggtatattatttgacctctaggaattctttgttttacacagaaataaaaattttaaaatagaaaatgcttttactttgtaaggtaagagagtatccatatgcttagatgtgctcgtttctaaaattctagaggttgatataatcagctcatgaatgcacagctatgctttttgtgatagattgtacataacatcagcagttgaaaggtaaaacaattgcttttttttttttttgcatttgttaagtgactatggtactttgtgattccttaatctatagatgagtcagctccacacttgagtctctttttagagggaaatcagtaataaagctgtaaaataaggaaggaatcattgtcagtttgtgtcttgatctggtggtggttgggataagggtacacatcattttatacaaacactaaagctttttgctaacaacatagcaggtcaaaattcacacataagaaagtttaactctgtactgttcacactttttaatcctgtaaataatgctgcattttgatggttcttacttttttggtatttaatgtgggctgattttacaatgttatattcacttccagatgcatacctctgctgctttctctcctataaatagtgatgctataaacttcctttcacagagatcattctatttcaaatc

SEQ ID NO: 81013 - DNA, 1029 bp, Homo sapiens
ttactatcagactgtacccctgcccctgatctgcttaaaaccaggaagaaataaaaggtacagtttctgcttcataagacagaaaataacatgaaaaaaagcttaaagataatttaagagtgagagcaaataaaatagtgtcaaatagaattaatttcaagtagtctgttgtaataacatatggcattaggtataaggaatcctagcttccagttctgtgcttaaaacatatgtgaccgtgagaaaatcatgtaaacactgagcttattggctcagctgtaaaaatggggacaatacccaccctgccaccctcacagaattataaaaataaataatcaaaggaagaacttgagaatatagagttgtgaccattaaatccctagtaggacacaataggtgctgcataaacatttgttgaatcaacgggagggaagtatttggtaaattgtaaagcgtagtgttgacataaaggatgtagagtaacgggcagaagatgaggtagggcagaagacgttgagaattaaggatttgtgattgtttccttatgttaattcatatgtgaattagcaaaggaaagcaagttatctcattcagaaaataaacacttcaaatgtggaagatggtttgtataaaagttgagctaaaattagtagcatttggccaggctcagtggctcatgctagtaatctcagcactttgggtggccaaggaggtggaccatctgaggtcaggagttcgagaccagcctagccaacatggcaaaaaccccgtctctatgaaaaatacaaaaattagccaagcatggtggtgcagtcccagctactagggaggctgaggctggagaatcgcttgaacctgggaggtggaggttacagtgagccgagattgtgccactgcactccagcctaagtgacagggcaagactccatctcaaaaataaataaatacataaattaaaataaaattactaacatttgccatttggaaattagtagtgaatttagaatgtcaaatgttaattactgaaca

SEQ ID NO: 81014 - DNA, 1027 bp, Homo sapiens
tgcagtggcgcgatctcagctcactgcagcctctgcctcctgggttccagcgattttcctgcctcagtctcctgagtagctgggattacaggcacatgccaccatgcccggctaattttttgtatttttagtacagacggggtttcaccatgttggtcaggctggtcttgaactcctgacctcgtgatctacccaccttggcctcctaaagtgctgggattacaggcgtgagccaccgcgcctggcccatttttgagattttaatgtccagcttttattatagaaattgatgtatgaaggtaaaaaccctggagagttgttagtactaacaaatgtttagtaacaaatggtagtaaggaagaatctaagagatagtctttggttagaccagaagtaaccaagagaaagccatcaggagagcccattatacaacggaggtctgctatctctaatagcattagaatgtgctaaacagtaaagtatgctttttctcttttggtccagggtggtaaatctcgtgaaaaggtggtgaagcttttggcttctacaactccagaagagatcttggagaaattaaaaaaggaagccaaaaaaacataaaagcaagaaatgaggccgggcgcagtggctcatgcctgtaatcccagcactttgggaggccgtggtgggcggatcacctgaggtcaggagttcgagaccagcctgaccaacatggtgaaaccccatctctacgaaaaatacaaaattagccagatgtgatggcgcatgcctgtaatcccagttactcaggaggctgaggcaggagaatcacttgaacctggggggcggaggttgcagtaagccgagatcgcgccgttgcactccagcctgggcaacaagagtgaaactctctccccccgaaaaaaaagaaataaaaaatacatccttgagaaacttttttattgctaatggtgaagaggctgttaaatagaaaaatatactacatgcacagaagaacatgggggacatatatatatgtatatattcg

SEQ ID NO: 81015 - DNA, 1064 bp, Homo sapiens
gttggagtattatgtttcattagatctaaaatgggaggctggatgccatggctcatttgtaaaatggagataataatggtactaatatcttcataaagttattataaggattaaagaagttagtatttgtaaagcctttaacacatttgtgtgtgcttaaaattggtgtatagtaagtgctctgtaaatatttgttaagtaaacattattaaattttaaaaacactcaagatatgtgtcacataagaggtgaacctagtccggggctctcattttcctgttgaggaaaccctgcacaaccttgtacaatctagtaagctgccctgtccatacacttcttcagtgacattgatgaggctgaaggccatctatgactccctgcctggggctcttcacataccaagggcaatttccagttgcctaaatccaggatattccccagggctctgtaagcccatcttggtcggcaagattgggtcaataacttttcttctctggatttatttcctgtaatggtagggccatttttatcatgttcatgttccttaaatgtgattagtttaatcattcatttcttcattcaacagtttttaattgaaaatctgtgtgccaggcaaatgcaaaaactcttttacaaaatgtccttgcttcatgaagaaaaagaactccttaaggataaagtccacactattttcattccagatttgacagcagaggctgtaaatgtagctattgcagcacctccatcagagggagaggctaatgctgagctctgtcggtatctttccaaggtcctagaactcaggaagagtgatgtggttttggataaggtaggtctcgctctcttttttttttttttgagacaaaatcttgctctgtcgcccaagctggagtgcagtggcgtagtcttggctcactgcaacctccacctcctgggttcaagctattctcctgcctcagcttcctgagtagctgggattataggcgcatgccaccatgcctggctaatttttgtatttttaatagagacggagtttcaccatgttggtcaggctggtcttgaac

SEQ ID NO: 81016 - DNA, 1064 bp, Homo sapiens
ttgtgggatccgctgcgcctggcacaaggtaggtgcgccatcgatacgtggaagattcacaagggccaagccgccacgaggctctatatcgacttgatggccacaggcagcgcgtgggactctgcatctgctgcttggctgtgggagcgagaagacacctggccctgtgcactccttgccgcgctctccaattctgagaagtgacaatacctttctttccccgattaggaaagaggtgacacaccttcctatcagctgagcagggtgggccaagacacggtgaggcctcagctccgcagctccacttcctggggctcggcccgttccagaacaaaagagactcgcgcatgttctgcggccacgagactcgctcccgccggccttaaggtgtcgccctctggccagagcggatgcgccgggcggtggggccgctcctgccggctacctgcgcaagcgcagagggctcttccggcgccttcccaggcggggatgctgcggctccgcagcgggctgaggcaccttcgggcaacacccaatactcggggctccgctcggcttctttgcgccgagatgcctaagaaggctggtgcgacgaccaaggccagtagcaggtcccgtggcggcagaggggtgggcctcaggggtacttgttgaagagcgcgggagaagcggggcccgggagtgagtggaggcactgccagcggcttgccgtctctcagttccggggctcaggacagccgccgccacccccagagctgcggcctgctgccgtcgccccgcctcagtaggctgcgctgccgtccacctggtgatttctgagcgctgggcccggcggcagccgagctctccttgggctgcgtgtgctgacctttggcctcctacccgcactcccagtccagcaattcatgttcccgcagcggcatgacctgcgtttccccaggaggctgtattctgctttctcctcccttgctttggctgatcgcaccccttctgtcaagaatacagcactcccatttccaccatctttgtttggccaaccccagtccgtttctcagactcagctc

SEQ ID NO: 81017 - DNA, 2049 bp, Homo sapiens
acaccagcactttgggaggctgaggtgggcagatcgcttgagaccaagagttggagatcagcctggccaacatgatgaaaccctgtctctactaaaaatacaaaaaaattagccaggtgtggtcgcgcacatctgtaatcccagctactcaggaggctgaggcacgaaaattgcttcagcttgggaagtggaggtttcagtgagccgagaccccaacactgcaccccaggctaggcaacagagtgagagagtctgtctcaaaaacacacacacacacacacccaccaacagagtgagagagtctgtctcaaacacacacacacacacaccaccccccacccccccacccccaaggctaggcaacagagtgagagtctgtctcaaaacacacacgcacacattgctaagggctttatattattttctatagtttgctttatttggtttaacttaaatgtaacttgtctcttaaaaattacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaagtaagagtcatgcactatgttccagatggtttcctcttgaatgttgcagaatgtgtgttttagaagctgagagtcactgacagctgagccatttataaagaggggggaaaagaagctgggagctaaaatattccactgccttccgaaaagaagtacttctccccacagctctgttctgaaagaaatagctcttcttaagaagtagccctttgtttcagtaagcagttgaatgtttggcagaaaataaaagttatttttgtaaaatcttttcactattctctaatagctgggctgtacattcagtatttttattcattaattagttttttggtaaaaacttcatttttctctaaatgacagcataaaattttatataggaatgatagtgaaatataatggaacattaatctaattaaaacaccacattaaactgagtgcttattaaatgaaaattactaaggaaccttttgttctcatttagggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccactatacctgtctctctgtgtgggggacactgctgatgattcccaagattgaga

SEQ ID NO: 81018 - DNA, 2069 bp, Homo sapiens
tcaagagatcgagaccatcctggctaacacggtgaaaccccgtctctactaagaatacaaaaaattagccgggcgtggtggtgggcacctgtagtcccagctactcgggaggctgagacaggagaattgcgtgaacccgggaggcggagctggcagtgagccaagaccacgccactgcactccaggctgggtgacagagtgagactccatctcaaaaaaaaagaaaaaatggttaaaatggtacataactttaccacaaaaaaattataatgtaaaagaatttagttataattgagtaaatatcattaaatattttgagtattatgttactattacaatatgttactgtattgtagtaattttatatatcactatatatgttgaatattactgtagtattgtgaataatcccattcataacagtaacataatattaagtagtaggattaaacccagtaagaactataaagtacattagctttatgaagaactggaaaagtttgagtagaatcagactttaataaggacagtgtcttccaaattaacctatgtatgttagagaatttctttcagaagtcacatactattttaaggtagtggagaatggcttggcaaaattctttttttttttttttttttttttgtgatggagtcttgttttgttgcccaggctggagtgcaatggtgagatctgggctcactgcaacctccgcctcctgagttcaagtaattattctccctgcctcagcctcccgagtagctgggattacaggcgtctgccaccatgcctggctagtttttgtatttttaatagagactgggtttcaccatgttggtcaggctggtcatgaactcctgacctcaggtgatctgcccacctccagcctctcaaagtactgggattacaggtgtgagcaaccacacccggctggcaaaattcttaacagttaatttggaagagtatatgtttctcttttaataagagtaatacagatgacaagacaaagtattgtaaagctataggaagttagtgttgtatggaacagactatagatgtcagaaactaacctaacataaatgaacatttagaaaatgatatggccaggtgtactggctcacgcctgtaatcccagcactttgggaggctgaagtgggtggctcacttgagcccaggggtttgagagcagcctgcacaacatggtgaaactccatctctacaaaaaaattcaaaaattcagcatggtggcatgcacctgtaatctcagctacttaagaggctgaggaaggaggctgtgatctcaccactgcactccagcctgggcaacagagcaaaaccctgtctcaaaaacaaaaaagaatatgataaaggtgagggaaggattaaccactgggaaaattaagttagatccttactgatcccatgtacctgtattgatgtaaattaaaattttaacattaaacaaaactgaaaccatgaaagtgctggaacaggtgaatgtttatgtactatgaggatgaggtagacctctctaaacttggcatgtatcataattttgaaaacagataattgaaaagttttaagtacaaaatcaccataaagttaaaagatgagtgacaaatgggaaacttattacagtggatattaccaacaaagcataaataactatcatctctatataatgtgatcttttgaatctacattaaaaagacaaacacatctgtagagaaaaatgagaaaagaacatgagttgggtatttcattagagagaaaatccagtgggcagtaagcatatgagcaaatgttttacctcattaataatcaaataaataggctgggcatggtgagtcacacctgaaatccacgcactttgggaggctgaggcgggtggatctgttgcgctcaggagttccagaccagcctgggcaacatggtgaaacccccatctctacaaaaaaatataaaaattagctgagcatggtagcgtgtgcctgtagtcccagctacttgtgggggctgagttgggaggatcgcttgaacctgggaggttgaggctgcaatgagccgagat

SEQ ID NO: 81019 - DNA, 1081 bp, Homo sapiens
tcctacagaggtggagaaggggaggggcagtgcagtggagtgcaagaaactctggctcttgggcaggttgaatggggcttgaaggccagctctggcacctcttagtggggcagcctcagacaagtcacttaacacttccaaactctgttttctcttttgtggaataaagaaaatagaatatactaggacgaggtgtttgtttgtttgttttgagatagagtttcgctcttgttgcccaggctggagtgcagtggtgcgatcccggctcactgcaacgtccacctcccaggttcaagcgattctcctgcctcaggctcccaggtagctgggattacaggcatgtgccaccacacctggctaattttgtatttttaatagagacggggtttcaccatgttggccaggctggtcccgaactcctgacctcaggtgattcaccagcattggcctcccaaagtgctgggttacaggtgtgacccaccacgcctggctggatgaattgtttttaggacttaagattataatctatgcgaggcgtgtatatgtgtgtatatgtagacatacatacatacacacacacacacacacacacacgtatttcccctaggagcagtggtttagtatttgctaattctgtatattaaatataacttccacagataatgagaattgactgtatattccttctgtttatatggtagttgcctcttgtaaaagtctgaatattaaaattgcactaaaaggctgggcacagtggctcatgcctgtaatccccacactttgggaggccgaggcgggcggatcacctcaggtcgggagctcgagaccagtctgaccaacatggagaaaccccgtctctactaaaaatacaaaattagccaggtgtgggggcacatgcctgtaataccagctacttgggaggctgaggcaggagaattgcttgaacctgggaggtggaggttgtggtgagccaatattgcaccattgcactccagcctgggcaacaagagcaaaactccgtctcaaaaaaaaaaaaaaaaaaaaaagcactaaaaaatctggtttataaacaaaatggaat

SEQ ID NO: 81020 - DNA, 1224 bp, Homo sapiens
aataatacactgcttataatatactgaaggacggggagtaaatcagattcctccccagcacctgcatgtggtgtctgttgagtactggatatttgagagccctaaacactgcccaagttgttaatgaaacattgcttaatcctaagatttcctccctgttagggtagctgtcagatgcttcatttgttcttcagtgtgttctcatttgaagcattactgcctgcatctgggtaacttacaccttataaattgctcttaaattatgcatgccgttggagcctgggaatcttgaagtatgtgccttgtacagggtagaagccaataaatatttggtcatttgatttgactcacagttgtttatttgaaaactcagtattgtgttaatatttatgaaacaatctgctgtgtttttctgatctttatttggttctcagctttaacttcgtactttaacacatctgccagtagaagacctatgtgtttgtctttctaccccatagactagtttgtttcaaatgtacttgttaaaaattggtaattaattaaaaaacattttttatcagttattattattatttttgttttttttggtagagacggggtttcgccatgttgcctaggtaggtctcgaactcctgtgctcaagccatctgcccgcctcagcctcccaaagtgctgggattacaggtgtgaactattatgcctagccccaaaaattggtaattcaagagaagactgggagctgaaagaaagggctggcttcaggagctttttatagctgtcttatattctcaggatgttttttctcctccgggatttgaatatgtgttctggaggaagagatactgtttcttacagccttttgctaaaggaagaagataatttatcatgttgatagaacaaaatgaatttacaccaagggtagtatgatgtgcttttttttttagtaataaagtttatgtgtttatctctgcggaagttattagcataccaagtggagacatgtaggttcaaagtcttctggttttccatcaaatggttgtgtcatattgattgcatttaatttacttatgaaagggcttcgtggtgccatagtttatactcatctgctcagctacaataagagatactaaagtttgatttttaaaaaaaattatgtgtaaccagtttatttttaacatggtattaagcctctcctgtgttcttgggactatgatacctttg

SEQ ID NO: 81021 - DNA, 1608 bp, Homo sapiens
aaaccttttccacatcttcctaagtcaaagcccgcatttatagattctcatagaaccatgtataggtttgcggcacttgtcctgttaagtgtgaatctaatcaagggcaaatggtgataaaggcctcacattgctgctctgttttacaactctagtaatttttacctgacaaaaatacatcaaggcaggcatgtaaagacttctagactgctaccttgtccttcaaacaaaaatttctttttttttttaattaaaaaaaaatttttttaagtctcactttgttggccgggctagagtgcagtgttgcgatctccgctccctgcagcctccacctcccagattcaagtgagtctcctgcctcaacctcccagatagctgggatgacaggcatgagccaccgtgcctggcctaaaacaaaaatttcatagttttctagtttaagaagggaattgagcatgctgttagcattctctctctctcaattaaaatgactattaagaaatttttaaaaaatagtaagtccattacaatgaagagaaaaagagaggttggaagggccaacagagtagaaagggacagagaagttggaagctgattgatggatgaactagagtagatgaatctggagcccagaatccagagctttcaaagccgcagcggagctggagcgcctttcctggcagaaccccaacaaagttcttggctagcagttggaagtaaggagggtggaaatgagaaggtagtgctaaaacatggaaattaatttaaagcctgtgtatagaccatccccttagccagctgtccatgacaatggacaggctttttgagataaattgaacaaactgcctgagaagaactgggactgctgggtatggctttgggaccccagggttaagctctcttccaatggctttgaggggtccctgccctagggctggcttcccactctaatgccaggtgccagtcagcaagcctcccacatacacagagctcccagccaacatttctgttttggagatagtattatcttgaaaacagaccagctgcttagaatagtgaagttggagacggagtttaatcatctgacatataaggaaaagcagaacgtgaatgacagagaccaagagaaacacaacagcggatcctcaaggaaacagacgagaacttttaaaactttggttaatgtcatcttggagacttcagaaagtttttgcgttcataaaaccagcacatggtgctgtggagaaaaaaggaacgatcaagaaagaagcaagcattcttagaaatttaaatgtgattgctgtagagaaaaataggaaggcaccagaagataatggcaaggaaatcttccaaaatgcagagggaaataatgataaaaaatatgagacaacatacagataaatagctaatatttactgaggcaattttttttgtcaggcgttattcaaaatgctttgtgttttaatttatgttaatcctcacaaccacattatgaagtaggtgctcttattctcatctttttagagaggcaggcattgataataagtcacatggctagcaagtgacaaaacaagctcaaacccaagcagtctatttcctcttggcctt

SEQ ID NO: 81022 - DNA, 1361 bp, Homo sapiens
atattggtatatggtcatataattcccctgaatcttttaatgacttctttttacctacaggatgtttaaacactttagcaggtacatgaaacctttgtgatttgatctctctttcttcatctcctctccatccactcagtgtttcaaccctaattactaatggcctttttcttgttttagtgcctgcttctaaggcctccttacctttgtactcctcagtctttctgccagggctccacacttaattactactcttcagataatcttcaggctttacttcctctgtaaaaattccacccacaggcaaaattgcacactggctcatctaattaatctctcacagcatgttttggttatctgttgctgtggaacaaatcactggaatgcgtagtgacttaaacaacttttattatcttttacagttgtgtgggttgactggaatcacttaggtggtttgtcgtctatgtagctgtagtcagatagcaggtggggttggactcatctggaggtttaactcacagtctgggatggctgagccttaagtctcaggtcctcttcaagaggcttcttcagctggtctctccagcagggtagcttgacttcgtggctcatgactccgaggaacacaaaagcaggagctgccaggcatccttaaggtgtaggtctcagactggtgcaatgtcactctgccacaatctgttggttcaaggggctcacacagggacaacccagattcatcatgggacagatctatgtaaggacatgaacacaagaaagtatgatttcttggggccatcattagagattagttattagatatgagtgcctaatatatacttctgttattaggacattactttttaatcatttcagtaccagactatagttgcgtgctgcataatggcattttggtgaacagtggactgcaaataagatggtggacccataagattataatacggtatttttactgtgcattttccatgtttagatacacaatactcaccattgttttaaagttgcctatagtattcagtacagtaacatcctgtactggtttgtagccctgaagcaatagtctataccacatagcttaggtgcgtagtaggctataccattgagatttatgtgagtgcagtctatgatgtttgcatgatgatgaaattgccgaacaatgcctttcttagaatgtatctccatctttaagtaatgcatgactgactgtgtaaggtttttatgggcaaagctatcttacccatatttttatctctagcactattacagtgcctgctatatagtccctcaataaatgtttttgagtaaaatgaacagataagtagtgatacaaagtttcttacaca

SEQ ID NO: 81023 - DNA, 1146 bp, Homo sapiens
aaaataatcaagttatgagagaaggaacattctcagcaagggaacgcattgttttcggcactaagtatctcctgttggaggaacacaagagtgaaccagtgtgccttaagcacagtagagggaagtggtagaaaatgaggtcaaaaagataggccagacaggatggtgcagggctttagagactgagcgaagactttttcagctggtatttgatggaaagcctttggagagttttgaatgagattggggaggcggaggtggtggcaggaggttgtgatctgatttacattttaaaaaaacaaactctttctggcagtggttggagtaaaataggcagcaaggtgatagatgaagaggcttttgcagtagtccaggcaagaggcgatggtgaattgtaccttgtaccagggaggtagcaaaggacatgatgagacatggtcaaattctggatatatttttgaaggtacaaccaagaggacttccaagacatccaagtagtgtcatagagtagacagaaatatgaatttggaggtgagggaacagcttgctgaacataaatttgcaagttaagagtgaatggtatttaaatcgagagatcaagtgagattacctaggaaggcatgtagactgtgaagagaggtacaaggatgagctctggaatcttcaaatatgtagagatgtagcagagaaaaagcataaaatgaaactgagaagcagctgtcagtggaattagaagagaaagaaggagcattatattctgaaagtcaagtcaaaacatttcaagaaagaagaagtgggaaatgtcaactatggaaagtggaaagtggtcagttatgctcaatgctattgagagtcaggtataatgaagactttgagttgatttttaatcttgacaaggtggaagctatcgataaccctgccaagagtgatttcagctgattagagtaggttaggcagaaaatgggaagtgaggagctggagacagtataaacagtcctctcaggagttttgttgcaaaggggaacagagaatgacgtgatggctggaaggggcacgaggtaagtgttcttcagtattcagtcctcagctctcatcctttctcccatcaaccaaagtgagagctttacgcactcattcccccacatg

SEQ ID NO: 81024 - DNA, 1108 bp, Homo sapiens
tttggcattactagcttttaatcacagccatcctgttagggaggcgtaagaattgtttaccccaatttcacaaatgggactgaggcccagaagagtcaagtatcttgcccaaggtaacaaacagctaactcacactgaagaccatgtctgtttcattatactaagatggttttaaatagctgcctgagtagaacgtgttgttattaaaatggcagagtcttgggtagtactgaagcaaaaacaggcaggtcagtgggacagaattagatacaaaggttcacagttgaatcagaaagatgaacaagaaaatgaatgtaaagttcacacaactagaaacaaataataagattccattgacgaatggataaaggacaggatagataacttagagaaagaaaaaatacaactaattaacgaatgttttacctggctggtaattaggaagtgcaaattaaaagacagtggtattttttccttccattaatcccaccaaaaaatttaaaggtaacatctgaacagcattttctgacaaagatggtggtaaaaacccttttggaaaacagtttggtgctatagattttctttccacacgtaagaagcattcaagtattgcaaattgcatacaaaaatatttacagctttatttatagtagtgaggaagtagtcagctgtagggaatggttaaacagtggtaggttcacttgatgagatataatgcagtcactaaatatgacggatagcacttgaaactgcaccatggttacaacgtgaaaagacatggaacaaacatatacctagagaccgggataaaaggaaacataccaaaatgctaagcaaagtcacctggagtagtgagatgaaagtacctttttttcttctttattctttgtttctgatattttctgtaatttagttcagttacatttataaaggggggggacctcaaaagctaaaatccaggtcattttagtttaaagttcaccaggaggattgggtatagttcatttggattttctagactagaagtagttttcaaaatgatctgtgggccgtctgcattataatcttctggggtgcttatgaaatgtgtagatctcatcctcattat

SEQ ID NO: 81025 - DNA, 1079 bp, Homo sapiens
tcaggccctaccccagacctactgagtcagaatacccagggcactgagccagggggtgggtgcccgtaggcccggcagcacccagcctgcagaagctccacctccgggagcgctgagctaggaccagctccccacgcccctgccctggggctgccgggagtccagtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgaggtgagcggcagcgcgggccgggccgggccgggccgggccgggccgggccgggctgggagatccccggggcccggcctacccggactcccggatgaccttgggctgggctcttctgacccgcccggggcctcagtttcctcccgagccgttgatgctccggagggtcgaaatcgaaatctgtgaaccaggacggctcagtcgccaactaaacgttagtgtcttcattaggcaagcgtgcgttttaccattgaaaggcgtttcgcattccaattatggattgtcgctcagacttcagaattagacaagtggcaa

SEQ ID NO: 81026 - DNA, 1154 bp, Homo sapiens
cattgaacaatttggcagtcaagttatcagggattcctgtttttttagaaggatcttgagggagtgagtatggtgtttatggctatatttagtgtgcaaatatgttaactcctgacacactatgagaactccaaaaatgtacttggaaattacaagtacattattaatgtatgcaggaaatcaggatatataggtagatagatagatagatagatatagatatagggagatagatatatacaaacatatatagatacctatctagatgtattttttgagacaggatctcactctgttgcccaggctggcttgcagtggtacagccatagctcactgcagccttgatctcctgggctcaagcagattactgtagataggacatgcctgttaatacacatctagtattttaaattgacctttttaatttggcctcattaaaaatattgtctggcccatagcaaaattttagatgacctgagatggggaggtatcctaaatattacttgtgttagatatgcttttggtaacttctttctctttctctcttttaaatagggaagtatggaacacgaatttgccctgcttttttcttaagcataccatatacttgtcttcctgtctgggctggtttcagaatctataatcagccatcagaaaattataattacccctcaaaggtgattttattaagctttgatgtaccctgttctcaaactcatagggttctttcgcatccactggccactgaattgaaccatgcctctgtggactggagcatttggggcatccaaacagtgcgactgttttgattatgtagcattagcttacgtattaattaatgtaggcaagaaggtctgtttctgtctgaatacatctgcttctgttggcaaggccatactttggggagcttcctgtgccagtggtcacactggctctaactatcagattctgcattagtgtgtcaagtgaagtccatagtgtgtggttcatctaggattgttaatggcctggacgttgaacacctgggttcctctgtgacacctatgcatttactaccccaagaggacactggagggatactgctcctcaaggtagtctacacagccatacaatcttgactccagagatccaggcccatagagactggctacagg

SEQ ID NO: 81027 - DNA, 1043 bp, Homo sapiens
ccagtctgcattcactgttttgaattttttaatatgcacaggccatattctcttttgaatagtttcatttcatgctcactactgttggcactaaattgtaattttttacacttataattattttatatgtcaaacaatattgagatggatgatcaagtttattcacaaatgattttgaatatatttctttaaacaaactgtttctcaagaatttccattttccttcaaaaaaaatttacacaataccatatagctcacacatacagtgcagagcaagaatgtacatattcttaagtactcacgtatgagaagagagtgaaatgggacaaaatatcagtaccagtataacaaaagttagtaatttagaaaggaggaacatgaagtaatatttttattccactttttcttctgcctttgtttttatgaagaactctggtttgtagatacaacgataggccaagagctgaggaagaactccatatgctatgtttaatgctaaaaaaaggatttttgcttcttcagggactctgtagacataagcagttctagcatgaagagatgcaccaatgtgagaaaactgagcctgttgcatttaaaaaaaaaaaattgagtaagcatgaaacgtgttcagttggatgcatgatgagttctgaatggttcattcaggctacgtttctgtgccctcaaaaccagtctcacctgcaggcaaaataccttcaaacaatccagagtctttaatgtcagagtctttcattaaatttagtccttgattaaatttagggccattcttgatatgactgttcaaataaagtagatattatttagtgtagttttatcatgccagttgtgttttttaaccatcaagtgccccttaccgaacattagtggctcaatctaatagaaaaatctgaataaaatctcaaatttttttctgatttgcgttctggagatcctgcatacagactcagttgtggttcacaaattgcgttccaataaaaatgaagaaagcgcagagttttaaaaaacaaatatttttagcataa

SEQ ID NO: 81028 - DNA, 1027 bp, Homo sapiens
actcaattttttttttttaaatgcaacaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctcttataaagacaaatcttattaaatttgaaacatttcatatatacacataaaacgcttttaaagaaaatttgtgagttgtatattccaattcaaaatgccatctacattccccttatgtttca

SEQ ID NO: 81029 - DNA, 1072 bp, Homo sapiens
atggatccttgaagaccaaagattggtacaggtttcactataattggtctgtcacatgattgaatacctggataaattacttctatttaaattctggtgtttagtgactgaatacacttaggaaactctaaaaacaagtacctagagtttattagattatcagcatttattttggcagtatataaaatcttacccaactggcatacaggcagaattgtgtgaatgcagcattgtttcctgtgtacctaatgaaaaacatgtgattgccttggatggggataaagtttgcaaatgacgacaaagtaattagaatttttcttgtcagactttatcttccattgtaattacttttttaagctgaatttcttttagcattttggacttcatttaaacacctacttgaattgattttacttaatttgtgattgcctgctgagcttccacctaatgtgttgtgcaaccctaaattatctaagctacctaatgttgcctaggcatttaatagtgtggatatgtggcttttaaatgccattattttattgcttgttacaaagaccaaaagtaatggggctccacctgggtggacttaaaatttaaagcagagaaagggtaaagacacacttagcttactaatgtttatctattttaaattaagggatcatttcctttgctttccttgaagattacaacttcatgatcatttaatagccttttggctggtcacaatggctcatacctataatcccaacactttgagtggctgagacaagtggatctcttgagcccaggagtttgagaccagcctgggcaacatagtgagacctcatctccacaaataataaaattagccaggagtgattgctcacacctgtagtccagctacttgggaggctgaggtggaaggattgcatgagcccaggagtccaggcgagtactgagccatgatcatgccacggccctccagcctgggaaacagagtgagaccctgtctcaaaaggggggaaaaaaaagaatagctttttatttttaatatcaatgaaataacctagcataatggttctcaaactgttac

SEQ ID NO: 81030 - DNA, 1044 bp, Homo sapiens
cacaatatcgttaacagtaataatacttattattacttataggttaagttcatattttttaaagtcttaatttttggaatattttctgcctgcttcttgtgagatttgactagatggatggtcattgttcttaacttccgaagagattttctagaatagaagtgtcagcttagacatttaccttgttgtttgcttgcatctacattactaatattatttttgtgtaggaatctttcttttttttagccacctgttcatttggtgagagctagttcagttagaagtagatattccataatcctgctcaaccgggcacacaccaaatggcagtaaatcacagtatactcaacgtgaataaacataaccatctgaataagaatactattaatagtgtcaacttgcatataaaatactagtaaaatttactttttagctaaaagagtaagaaactgaaatcaaaattctgttttcttcccataccccacccaaaccttccgctgagatgtgagcactctgcttatgttaccccctactctaaaaggtcagaaaacaatgtaaacgaaaagcctcaaaattattgtgctttaactaaagcacttttttacacttaaaaactttatatgagaattatcaaatattgctagtagagtgtattgatagttacttaagaaaactgacttaatctacatatgcttaccttgtgacctagcagtctcttctaggcatatacccaagagaaatgagtgtttatattcaccaaaatactgtacaagaatgctcatacataacaactttcttcatgatagaacaggaaacaacccaaatgtccatcagcaggagaatgagtaaacaaatttgtagtatattcacatagtggagtactatttgacaataaaaaggaataaattactgatacagtggtcactggtttgtagtgggtagaaaggagttattgaataggagaaggcactggaaatgttccctgtcttgatctggatggtgttacatggatgtgtacatatgtaaaaatgtatcaagctgtac

SEQ ID NO: 81031 - DNA, 1037 bp, Homo sapiens
ttcttgtgcctttccacctccatatttgttttaggtagaatctcaaaccttattcttggcctcctgctacagtccacaatagctctctcttcctacataacaaggttgtcgttgggctctttttctagaaagcgtctgcatgtaatacatagcattcacaatttttattaagctctttgaggaagacacacaacactgccatgtgtgctttgtgttttagaagaaatcctttttatttttatttttgtatggttggcagttgattgcttgaaataagaaatcttgtgaaaaggagggtcaaggcattctagagattatattggtattctttaggaacggaaacagtcatggagaaaattggcataaatatagtgtgagctctaaaatgttgtattgtagtcaagtgaagatagcaagatcaagaaaaaaaaatacacccattcacaaaaggaagtgacatcacgagtggccagactgaaatttagtgaagttgaagtaatggatggacataatcactttttaaatatttggtttggcatgattgtcaaatggaaagaacactaggccaggaattgggggacctggtgtctggttcaggctctgttatggactaatcatttcaactgtctgcatatccattgctgcaactataaaatcatctctaggatcctttccaacactaacaacctcagatatcaagaggaaaaaacagtcttattcaggttccagtagactgaaaatagcttcgcatctgaactgtagattgtccttaagataaggcaaagtttttaaggtagaataactggttattttttatgctgtaatacagtattgcttagagaggcaagatttgtgactttaggagtccctgaatatatttgtgacttcagaaaatccccgaatctgtttgccaagtaagaaatgtatagctttagggccatatgtgtataaacacagtcaaagccaattaaaggttaccgttactagttggtcatttcctagtaccataatggctttttaaaatcttccctttgaaa

SEQ ID NO: 81032 - DNA, 1234 bp, Homo sapiens
tttgaaatttctctcccactatgtatggcttgaggaagactcttgtgaagtatgctaaatatgccactgctatcactttcacatttgcacactctaagaagaatggagtgtttgggaatgcttattcttaagaaaagcgatttccatctcccatacatattattataggattgtaataaaggacttttgcttaagttatattctgctgttgcgttggaaagttctaaataattaagtggtaggtttctccttataaatctggctcttctttctaaaccctcaagcttcaagaaaactgaggagctttttaaaaattactttttattgctggtgacatctataatatgggtcctactttgaggtgggggaggggatcttttttgtttgttttgctttaaatgtgtgtatttgatcccagctcagctttacatttaaacattttaaaagtgcatgcactcccaattgtgtggaatgccaggaaacgagttcattctgcgaggaatgagctttcagctctgtcctttgtgacagattccagagcgtctctaccttaaggcaggcgggtcaccgggccgcttcagtgacccccccctaacctgtaccaggctgccggcaagcactcctgtcagctctgtttactctggcaagactgatggcatccaggtggatttcccaacccccgtgcctcctcattctccgcccccacttctcctctccagcccacgaccacggctgcatttgccaatggaatagttaggcagtgagttgctgtgcaaaactcccatctgtgaaagcggcttttctcctgagttaaatcacttgctttgcatttaatgtgtgtagggcctccatctgattccctcctatccccatccccaccctgaagtgtcctctgagctttaggaaaatgtgtcctggtgcttgttactgctcctgcatttccctagatgaagtcactcgcctgggagggctgtgctgttaggcagataatcctgttaagcatctggagggcctggtcaggagatgttcagctcaagaatgtcagaagtagatagaatggtgctggaggtgggctccaggggcagtgctgagggtaaacaggctgcttccctgctggacatcagccttgggtctgccagcttcccattgccagcgacaagctgctgaccataaggaatcgtgattagtggatgactgttacatgttaagctagcccctcggatgtggcactaag

SEQ ID NO: 81033 - DNA, 1657 bp, Homo sapiens
ctgacctgcagctcagggggtgaggctggtactggagctacagatttttggtgatttccagcctaagcggagatttaaaaatgtatgtgtagacaaaagtgagaaaaggcacagcgagttaaaggcagactctagacagcacccccatttagggacaatgtttagcccagtaattgttgagcagtgaccactcaataaatatttattgaatagatgaaattttggggtggcacaacacaggaaagaaagaactcgtagatgacaggagagagaagaccatcatggaagggggacatttaaaggcaggagcaatcaacaagtgcttcagtgagctaggtattgtggagtgtcctcagctggtacagccaggaggccgagtgctgctgtgagcagagcagagcagagcagtgccagagtaatcgctggctgtacttgttacattggcttccttagcactggcaggaaatgaacctcctcttttgaaaacttttcctttattgggtatggacttcacaggggcaaatctcaaagataagcaaatctcagagataacgtaagcccttgggtgatttaagttggtttctgacagtaaccagaatgaatggttgaaatccttggaagttattggcactggagaaatattttgctagtcatgggtagtttggtttaactacctgtaatcagtacattaaaaatgaaatgaacagaacgtcttatttagtctttttttttttttttttcgcatgagcggaaataatttatgactttacctgaaaggagaggcatcacagattctctctgggcttcatagccatgttttgtggttaaaagtactcagtagatatgttttaatatgttctagaagtctttctaaaaaatcttgcaatgcaacaatttggtggagaaatcagaccggtttaatataatatgagggagctcaataataaaaaatgccagatgtttttctcagacaacattttaacagcaggttttaattcatacagaacttacctggggcaggggaagggagccccagatgatgtcaatggctaaaataatttccagggatctaggtctggctcagccactgaccagctctgtaaccttgggaacataacttaacccatctggaccttggtttctatctgtatgatgactcagggaatttagaagctatgtttctgttataaaaatgattgtggcaatggtttcacaactctgtgaatatgctgaaaaccactgaattgtacactttaagagaattgtatggtatgtgaaatatatctcaataaagtgatacgaatatgtctctgtgtctctgggtgtgtgtgtatgtatacatctcagtgctgaaattcttaagtaagttaagcatttcagagtaagacaaagatgataaagtggaccttttacagagaagggatccaggaccatggcaaactgagatagttttctgaaagataagcgaggtaaaattagctataacccggttaactgttccttttttcctgataccttccctatctctgggaaaaaacccctactttacagagaatgaagactcgtaaaccctggggattatgcatcattttggcagcacatggagaccaacaggaaagaggaagaaatatgctaaaatgagaagaatataagttaa

SEQ ID NO: 81034 - DNA, 1019 bp, Homo sapiens
cagaaaatatattaaagctaaaacattcttgctccttttcacatagattgcttgataaactaattgataaatccttttttttaaagtcagggtgtgaagatagatgtttaaaatggattgattttgattttttaaaatatcttaaggatataatacaatccatatatttcttaccactgaggactttttgttctataaagtaaatgtaactcatggtatcacttggaatttgatttaaaaatgcatttgaaagcagggatttttttccctattgctttagtttaatttttcagctttattaacaaacggaatgtaaattaatttcccaaagttaagtgtgtgtgtgggtatctcatgtgtatttggggaagctattactggcatgctttgcccagaagatagaactgtcagtaaacaactgacacactgttcggctaaatagtgaacatattctggagaatctttagcagcaaaatgtggacagttagattttgcttttcaacagaaacctgggaaagtgttgagctgaggggagagtctgagagaagtactattgatgagatcagggaggcattgtttccagttctaactattctagttctttgaaatgctttcccaatgggaattccttcccaatttccagggtcatcccaatgtttttaccacacacagcaccagcagccagtggccttcctgagccaggtgttgttccttctgacttccaaatccagtggataatggtgtcttttccccgtccctggctacatcttcctcagacagtaatgctactaagtactttgcctgttcaaatcatccatccgtggtagaggctgctgatatttcaggctggataacttgagtcctccctagtgaatctgatatccgagtcaaatcttctcatccttgtccacctttctttcttctgggccacaaatcaaaactctggagggtcttgtgagctcatatgtagtgcttcagtgcttctccagtgcaacagtggaagacacacctggctagtc

SEQ ID NO: 81035 - DNA, 1004 bp, Homo sapiens
agttttcaaccactgtttctttgagtgctttaccagtcctgccttcttttcccttctcttattggaacgctgatgacatgaatgttaggtcctttgttatggtccctcatgtccctgcagctttgttctttgtcttatttttttcctgcagtttattttctctctgttgttcagattgggtaattttcattgttctatcttccagttcacattttttttctctgtttctgcattctgtgggtgagatataggctaatttttaatttcagttattttatttttcagttctaaaatttccatttagctcttcttcatatgttccatttctttgctaagactttctatttttcactgcttctagcatcttcacagtggcttcttggcttctttagaatctttgtcagataattttaatggttctgtgatcttggtgttggcatctactgattgtcttttctcattcaactagaaatcttcctgggtcttggcatgattattgttttattaaaatctgggcatttggggctatgatattatgagactctggatcttaattacattgtctggttttgcttgttttctttgacattgctctggtaggggacatggggggcactgccttgttacttccaggtgggggaagtctcctctcagacttcactgacactcaaggtggggtctcattattgctgagggggagcgagagttccggccattaggcctccactgataacaaagcactcctacccttctctggttgggaggggtatgagtgccttgttactgctctgcacttggcctcaactgacaccatggcgggggcagcctcattaccaccaggtagttctgactctccactaggcatcctctgacatcaccccagtggggaggagcaagggcacctcatttctgctgatggaggcgaaagttcaggctccccacatgctgtccactaccaccaaaggtgggtgggggggtgggtgggtgttgttactgccttatgg

SEQ ID NO: 81036 - DNA, 1017 bp, Homo sapiens
ctgttctttgcctagatcctcttgatttttttggagggaggatgctaaaaatccagattttatatgaaatgtcctacttttgaaatattggcaattaatttaattttttaaaaagctgtgcaggccaaagaaatgtgtgtgattaattattatgatccactgccaaatggctggcactttttttttttcagagtcttaggtaagcgtatattgcttggatagttcatctgcaggttgcctttttctcagtttttgaatagtggaaggatgttacctgctcacccatagcttggccagtatttgctcaggagctgcatatggtctctgtagagataactcctggctttttgtctgaggatgttcctgtaaaccttattgggaggcagattgggtagtaatgaactgagcgcttgcccatgtgctgttgtgttaatccgttgaaggagcttggctggcagaatgtgagagctctggcatgatcggggataaggacagaaagctgtcaagtcatgatacagatttgacgatgctgggtgggcagagcagcagaaggcaggctttgaaatgggtgggcagcctcacaagtgggctgagcaaaggctggcaagaaatgaggtggagggagtgctttgcttgtagtgacctatttaggaatcttttgagaacaggatgcaagaataggtattctctcgaatgttataaggcagatataatccccttcttggtggtctcattgagccttagctcaatgtaaaagtgatgcatcttaaaacctattttaataaattttatataaatataactatatataaaaaactataattttatataaaaattcgttttaaaaaagttaactaggctgggcacagtggctcacgcctgtaatccaagcactttgggaggccaaggcaggcagatcacatgaggccaggagttcgagaccagcttcgccaacatagtaaaaccctgtctctactaaaaatataaaaaattaaccgggcggggtgttgcgtgcct

SEQ ID NO: 81037 - DNA, 2110 bp, Homo sapiens
tactcatgtgcaagtatttgcatcatattttcaattatttggggtatataccctgagtggaattgctgggttattcttaaatgttttaatcttgaagaatttttaaccggtttacctgttttttttttttttttatctttcttgttccttcttgttcttttcctgcaatgacatcaatttgataacatgactagttcagtcgtcccatcttttggcttggcctgattgtttcctcttgttcttcttcagtatgttcctctgtgccttgcatgtcttataatttgggtaccatgtttttattttctctgcagtctcttttttccgtctgtttactgtttgatatatttgcctcttctgtttggtatgtggactattttgggggaatgtgcccttattttctgttgtgaacccaaagaagtttctatactttcctgcaataaatctatgtgcaagaatgtttttgctcttttttttgaggaacggtttctgtcctcttgtgcttcaaattctggtcataggcatcagactgttgtgtttctccttccttatctgtgaatagacctagtgttggcacacagatgtgatacactggccatttgcagtgtaccactgaccctggcacaatgccttctcatatctgaggccaggggctgagctggtggcaccaccaatgggacattcctagtctgtggccccatcccaggaagctctttttggctgacatagtttttctcttctctcactatccatttttttttctttctttttttaattttcttttctttttcttttctttttttttttttcctgagacggagtcttgctctgtcgcctggctggagtgcagtggcgcgatctcagctcactgcaaccttcgcctcctgggttcaagtgattcccctgcctcagcctcccgagtagctgggattacaggcacatgccaccaagcccgtctaatttttttttgtattttagtagagatgggtttcaccatgttggccaatatggtctcgatctcctgacctcgtgatccgcctgcctcggcctcccagagtgctgggattacaggtgtgagccactgtgcccagcctcttctctcactatccgtttctgacaaatgaaaaaaatggatgtgggtcctgcagaacctgaggccagctctaaccagtctttcatggatgcatacacctgcctgcaggcgctgctcccaggtgaggaggttgcatgcctcagaatgcagttagcctgggcatctgtgcaccaggctgagttcttgcctaggagctgcagatgtgtgatgaatgcagaactaaagttattgaggagaccaagagacttgacctgggagtgcttatgtggtttggatgggattccttgaggcttttgtggaggagcagtccgtggagtcagggtgtccgtgggtcactgttagcccacatggtgctctttgtatgagttagaaaaatacgcctcttcctcgacacactttactttcatgcgggggaaaactctcctatcctgaattggttagagctggtgatttgacagccgcctgctggaaaattgtatgataagtacacaaatctgcttcaggagggtgtgctcccttccatgtggcacagttgtcaccccctgcccagctgcctctgcagccactttgggttttgtggctgatgttcactagccactgactatacatctgaatctcttcctgtcagtagaagatccttctgatttgggcatatggtcaactttttatttttcataactcttgctacccctttcctccatttttattagttttcatggggacttaagtgagcatccaggcaccgttgctgatctgtctccctgacccagaagaccatgttggcttttggacaaagatcctggatagttctgaagctatgatgctgtgcatcagggttgaatgggggtcctgagagtccagcattgcttgtgctagcagctcatagcagcttaacttgtgtagcagaatgggtgccttgtaatagatagccatctgcttttcagtttatggaaggcttcgtttcttctgacggcattctgacgggcaggtgttacatcttttgtgactcccaggttatga

SEQ ID NO: 81038 - DNA, 1262 bp, Homo sapiens
tcattgatctgcttttcctaatcatgtcagtgaatacctacacgtgaagaaaactcaagctgcaccataaagctaaaggaagaaggtaaaaaccacctcaaatttccgtgatacaggaaaaactgctgtgaccctccacttctccatcctggtcccatttcctgtttccaccctcatccagtttgcttttccagaatctttactgcttcctttgatgggggtaacgactctccctaaccaccccacctcccgtgggaactgttaccccatccatagccagcatttgacagcccaagggcaggtttatgtatttgcaaacgacattattctcctataactaaaaatgtaaagatcctttcgtattaaatagtccagtgtccctagggcacagtgcttttggatttcagcctgcttctgctttgtgatcttgggaaagtcactaacccctctgggcctctatctctatttaaaaggaagaggctgaaccaaaatgccctttccaggtgaaagcaagtggggaagttagacctatttagggaatagagaacagcctgtgggacaggtttgtgcttattgttggtgcagtttagtaggaattgtcagaagccgatagatagatagatagatagatagatagatagatagatagatagatagataatagatagatagataatagatagatgattgatagatgatagatagatgacagatagatgatagattataaattgatgtttgatagatcaatagatagataaaagggaaccaaatactgtctctgtggcctgggcatttttgccaggcagggggaatcacatcgttggtgacagagttgtatggcccacagaggccagctaagagattgggagaaggttgttgaccttgtgtgggaaccaacctcagggggatggatgaggttggggccccttaggggtctccgctcttggcgtctggactccccttctctgtgggtctaagctggcttctttctgctgtgggattgtgttaacactgcccctttagtgattttgcgttttttttttttttttttccgctgaccctcattagcagaggttttgctcttacacactgcattgtcccagtgacttcttatatgccagtcactggtgggtaaatgccagagggacactgagggctcatcaggaggactcagcctcctctcagagaggaagccaaggtggccagattacaatttgttttttctggtaaatgtcatgggtaggaaatgttatttgtga

SEQ ID NO: 81039 - DNA, 1038 bp, Homo sapiens
gagtgatgattgacaaagacctaaggtctaatgtctaatgtgtgctggggagagtccgagaatcctgtgggtacagagaaaagtaagacattagaagtccttatgtgtgttttggagacagagtccctaagctcacctggtcagtaagtgtctcttgcatgagtgaattggacagtgcggactccattctgcaaaaagcttgattggaggcaagtggaaaggaccttggaaaattaaccaaaatgcaatgaagctctttcctaaataccaatggctaaagaacttcaacatgtcagtgttgtatgaaatacttcattggactgaattgtcctctgaatttaatgttagcattccctcaagagtcttggctttctttttttgcctgcactgtctgcattacagtgcagtaaggcagacttttcttgtgaagtggtatggataagatttagaggatctgaacacctctctgctttggaattcgtggtagctaaagtgtaaatagattcacacatctgacattcaaagtcagaaattcacgtggtcttgcactgttctggtgtgcaagttggtttcagaaggggcttggtgtttgaaaggtgctgtaaggagtggaagaatcgatgccatcttcagatgtttgttccaagtcacaagcaaaccctgcttcaaatctgctggcaaggcctttgagtcacacagagcctgacttgttcactttgtgtttgtccagcttccatggcatgtggaagaagttggtcggcttgggaatatgctgaatcaagcaacataaccaaccaatgagagggggcttaagcttctttcaagccgggcaaacctttagttgttagaagcccatacttcctatgtggtggtataggaaggacacagacttacctgtaggtttcttgccaaaaaatagaattgcgatctgatcaatcttccaactatttatagaaagtacaggccaggcttggtggctcacgcctgtaaccccagcactttgggaggcctaggccggcagatcacgaggtcaggaga

SEQ ID NO: 81040 - DNA, 1066 bp, Homo sapiens
gagggaactgaggcacaaaataatatacctaaagtgaaaaataagtattgcagctgggattccagtcctggaaacttgatttcacatttgtgttcccaactagaacaatgtataattagtgattctgtgctactgtctttggcaatttcctagggaaaaaaagtaatcctgaaataaagttgctgagtcagcactggatattttaaggacttttgttatgcatcgccaagttatgttccagataatttctccctcaaatagtgtaagaaaaggcgcatttccccatgtctttattaacactaggctgaatatagtattttaaaatcactattttaattgtcatttctttaattgtgagatgaaatgttacattcttatccaccttttaattcttttatgaatcactgtttatttccattgtggtgtttgtcttttactggtttctaagaactctttatacattttacatatgattgtcgaattgctgcaaataattttcctgttagtcatttgaaatttaaataggtttttctttttacgtttttattgtggaatctgacataccttggaacagtgcatagaatataaatgtacagcttatcaaatgattatgaagttaacaactgtacaaccaccagttgaagcaatggaatcttgccagtttcccagaagttccctgtgtgttccttcctgatacaatctatgcccaactttctagaagaagccacaattgtggtagccagcttcacagatggcccccagtgattctctccttctggtcttcatacccacccaggattgttccaaggtgggccagtgcgaccaatagaatatacagaaacagtgcgatgttgtattccagattgggttataaaagactgtggctcccatcttgggcttgctcactctctcatggatgaatcactctgggggaagccagttgccatgtcttgacgacactcaggcagccctgtggagaggccccggtatccaggaactgaggccctccttccaaaagcccttagagaactgaggcctgccaacaaccatgtgggtgagctgggag

SEQ ID NO: 81041 - DNA, 1086 bp, Homo sapiens
tttcccaaaagaaagctggccactcagatgttctcactcataggtgggaattgaacaatgagaacacttggacacagggtggggaacatcacacaccagggtctgttgtggggtggggagaggggggcgggatagcattaggagatatacctaatgtaaatgacaagttaatggttgcagcacaccaacatggcacatgtatacatatgtaacaaagctgcacgttgtgcacatgtaccctagaacttaaagtataataataataaaaaaaagaaagttggccaatcggaagaacggattaaataaaggaatgctgtaggtcctgggacccccatgatggtgccttaggcttttccctttgcagaaagtaccacctctggcaagtgacctgcaggactacaggcagaagtagggctggcagagtgcctggtgtgcagtcacagaaccctccagctccagatgtaaacttttggctttcttcaaagtgttcgctggttcttaacaaaatgagaaaaaataagaacaaataaggaaaaaaagtaaatttccttcaaatctgaatttacgtgacgtcagatattatgttcttcctataattttagtattaaaagttcctttttaaaatgaaaacagcagcaatagttcaaaaggttgtgtcctttcctggggaaatgaaaaaagttgaaaacactttgtatacggtaataataataatcactattactactactacgggtatttactgcttatgaaatctaaaagtctagaaactcctatttctcttgggctctacagcatctcagtcagctgctttgtctccaggatcacatttccaattttctctcttttctctctcccagtgtaccgcgcacctgctggttccctcacccagtacatcttggctcccaggaagccacacccttgacatttaccatgcttcctgggcatttcctgctaccatccccaccctggacagggctaggatggtatcaggacttagtgctgcacaagctttcaggataccgggtaagaggggagtttgacacttggaacaatactggacctaaaaggagccaggccttggat

SEQ ID NO: 81042 - DNA, 1036 bp, Homo sapiens
tctatctataggcataaatggtagtgcttggcagtttaggatccattcacacagaaactgcatttgaggcaggtgtttgtgagcaccttttgaccccttgacatttaagcaaaggagaagtgggttcctcttattcgcagctgtcataggtcagacttctgcttgttgggcgtgtcaggctgggaaattcccctcaccgccaagatgtccatgtcctaatccctaggacctgtgagtgataacttatatgagaaggcaatgcgaggatggaagcaagagattggagtgatgtgaaggagagatcagggtccaaggaatgcacatgacctctagaagctagaaaaggcaaggacacggatcctctctcctagagcctccagaaggaaccaaccctgccagccccttgattttagccctggaagactgattttagacttctgacctctagagctgtgagaaaataagtctgtattgttttgctactaagtttttggtaattttttatagcagccagaggaagcaaatctactgggtgagtggattctatgcccgagttcataagtgagagtgaggccaaggcatgagttctggattattgtcattagcatttcaaagaattgtcctctggctcaaatcagcggtgttcacactttgcttaattgcctgtgtcttattttgttctccagctttgatcacatgtatgacaaatggaatcggaatgaattgcagaactagcaggtcgagtgcttgacatcacctcacagagatgtcatggatgctttgggaagtgctttgcttgacagtgcctggatttatgtagcaagatattttgtcctggggtaaagggagcccatgcaggtggggggggaggggaagggaatgggagctgatgcctaggcaggtttctcaaacctgtgtgaattaaggacccctctccataagggacttttttggtgtattgacttaaatttagttttattatattgctacttaaatctgtataaacataaaactaagtgttaatttatgcttatag

SEQ ID NO: 81043 - DNA, 1739 bp, Homo sapiens
taaaattacaaacctaataaaattcaaattaacatcactgagttaatgtcatggataacgttttgctgattttaaattgatgttctcaatgtgttttcacacacactcgtgaagttatggaacattatctttgtttctgctggacttgtttaattcactgtaaaaatatcgttatgttgaaagaaacatatacatcacagtaataaattgatttatctagaacagttttcagactctaatgcaaatattcagttggtttcattcctggaaaaataaaaaacagaccaagataaatcatagtatttagtgatgtacacttaggggattaaagtcagtgtagtaataggctatgagaggaggggggagggatacatggggggcttctggattactggcaaggctcaatttcatgatgagcatgcctttcttgagtctctctttttctgtgaacataaaacataagtgtactgactgttggatttttataaagtgaacactaatgttaccccatcaaggacaagaactaggacattgctagcatcccagaagctcccatgtacccttttatagttacatactcctctttcccagcaaaataacgactatagtatgttttgtggcaatcacttattgcttttatctatagttttacaacctaagtaggtgtattaggccattcttgcattgctataaagaaatacctgagactgggtaatttataagaaaagagatttaattggctcatggttctgcaggctgtacaggaagcatggtgctggcatttgcttgggttctagggaggcttcgggaagataacaatcacagtggaaggcgaaggagcagcaggcacgtcacatggcaaagcagaacaagggtgggggaaggtgccatacacttttaaatgaccagatctcatgaaaactcactatgaccaagacagcaccaagtcatgaggggtgtgcctcatgatcaaacacctcccaccaggccccatttgcagcattggggattacaattgaacatgagatttgggtggggacaaatatccaaactgtatcaggaggcattcctaaatactgtgaattgaattttgcctatttttgaacttctaaaattagggccatatcgtatcttttgtgtttgactctttcagtcaacatttttttttttaaagatacatccatgttgttctgtatgactgtagttcatttttatggcagtatagaataccattgtataactataccatacttttttgagctattttcctgttggtagacttctggggtcttttcagtttttggctattacaaatattgctgctatgaacatacttatacatgtctcctagaagacttgtatctaaaaatagaattgatgtgtcatctggtgttcactgctagatgatgacacattgttttccatgtgactttctttcttttctttttcttttcttttctttttttttttttttttgagatggagtctggctctgtcgcccagtctggagtgcagtggcataatctctgctcactgcaaactccatctcccaggttcaagcagttcttctgtctcagccacccgagtagctgggattacaggcctccactaccatgcctggctaatttttgtattttttagtagagatgggatttcaccatgttggccaggctggtcttgaactcctgacctcaggtaatccacctgcctcaccctcccaaagtgctggaattacaggc

SEQ ID NO: 81044 - DNA, 1059 bp, Homo sapiens
atcagcaaagtccactctctttagagtgtgggtacagtcttcagcctggggacaaatgccccagttgcctgttgcttagttgataatattaatggctaatatttaatgagacttaacagtgtcagatactgttctaaatactttccatacagtaatacttacaaggcagatactgttataatccacattttgtagataaggaattggaagcacagagaagttcacagttgcagtggagcagagatttccaatcaaggtgctttaactaaagaatttgcctttgggtatagagatggcgtgtggggatgggggtggaggggctctgttgatccttattgctttccaccatacagttattttattaagtcccctgatgattccccaggctcactctgttctttttatttttacattgtttagacttggaatttctctgtatcaacttttatcttgggagcagttttctactatgcatatattggttggctttatcctcagctctctaatcccatctgctctctgtcttctaggaatttctcaccatttatgatctgtcactggcaccctttcttgtttttcagccctgttatagatgttatggatatgcctctctctctatagatatatctatatagatatatgtagagaggaatgtggtacacagagaagatgtgtgtatttggtccgccatcttgattcaatttctgtaatatttattatatgtgttttatcgatttacttcctggaagtgagattaattaattttttatcgtgctgctataatgattaaattttgaagtagcatttagcgtgcagggagtacagtcacaatgtaatagcccctgggatttttgttctcttgagtataggttattagactctgtatggctttgttgtgattctgctaaacagagacttccagatgcggattgtcagacatgaacattatttctactattcaaacagatagggacgaagtggtccagcattgcttgttaaacttccttctagaagaataaatcaggataaatgcaatcaatgtaaatattaaacacattg

SEQ ID NO: 81045 - DNA, 1064 bp, Homo sapiens
ttagatatttagccttctagcagcctctttgtgctggtttcttatcatctgccttgtgtattcagcttaggaaatgtcaaaagcctcaagaggaaattgaacatagcttgtcaggtttgcttctttatgtttccctttttcccagaaatttggcctcttatatcctggtttccttggttacagtgtattccaatttttctcttacacaacctagtaagactgctgcaagttccaggctggtgttttctgctcagactttatgtcctatgttgcaagacagaacatttcctaaagagaacagtcagctgtagatgtatcactcccctcaatgcatttcccttcctccagattttggcccctcagattgtggctgtcttggttgctccgatgacctcaagatctctttaaacttggaaatttgaaaaaattttagacttacagaaaaggaagttgcaaaactagtacagagagttcacatatacccttcactcgtctttccctaatgttaacaacttacatattacctttactattgatacttaaaattgtgttgccatgttctccaagctgataacaacagagcatgactgccaactggttgaaaggagaaaaaggaacctttcaaaagggtgacatttttggcacagggcttctcaaaatgtgttccttagaacaccagtccttggagattttcctattagacaacgtccacagcccagtaattgtaggaaatgccacatcttacatatatgtgcccctttggaaatccacagtgcccattaccattttattttatttattttttttgagatggagtcttgctctgtcacccaggctggagtgcagtggtgtgatttcaactcaccgcacctccacctcctgggttcaagtgattcttgtgcctcagcctcccgagtagctgggattacaggtgtgcaccaccatgcctggctaatttttgtatttttactagagatggggtttcaccatgttggccaggctggtctcaaactcctgacctcaagtgatctgcctgctgtggccttccaaagtgctgagattac

SEQ ID NO: 81046 - DNA, 1669 bp, Homo sapiens
cccgcatgaacctactcccagtgccgtgggctctcaaagtccattctgtgcatcactgaagtgactaccacttagttcatttacagtaatttgtctctagtactattattttttaatggttcttattgttcttttcttgttttttaattgaatgtttgtgtgttgactctttgggtgaactgtgtgttccttgatgacaagtatctctcttgtctatgtcctacagcacttaccatgtgttttacacatagtaggtgcataataaatatctgttgactgcatgagaaatgtatgtcttcctgtgcctttagatatggttaccccttccaacaattttcttaaaggagttagttcaaaaaatccaacaagttgaatccaagtttttttgtttctgtttttaataatttaggtaaaaaactgtgacaagaaatcattgtacaatgcaattatttatgtttatttctgcagctatttagtgaaaaaataagtggtgctgaaggaactaaactagacgatgaatttcttgacatggaaagggtaagagcattttaatatgtaaattgattagaaactgactttcattgtgatatgagatatactgctattgtaaaggatattcgagtggaaatctaggatgtttaaatataggtgtggattatgcaatctacaaggcagtactttcccacgtcccagcccaaatcagatcctccccctgtagccacatgcagtttgggcaggtcgagtaatgagatcgatgtggctaactggtaccctctagtggccagaagtcagaatgtgcaaaagatgggcaatcttggcagttactgcaaggccaaagtaattggtagtatatgttttggagaatcaaaatgtatttctgggacaagattttttgaaatgcagaatgatttatttaccgtgtggaagacttgggctctgctcccatgtgttgcaggagctgcatagcaagtaacttttatcctggttctgcctgtagaaccagagtgtgaacttggataagtgaattcatctttttgaactgatacagagatgacaagtgtgccctgcttgtctcacatggattttgtgagaattatgcaaacattaacgtatttgaaataacttacaaaaaatatgacgggcttgagacagaaatgattgtaacatgctccaaagaaaaatggtatcatctctgtcccttaacatgtttcccagtcagctgtgtggagttgctcaggtggaggcagaactagaaccaccagtattaacaacatactgtttctttgctcattgtctgggccctttaaacatagccttgttttaataattagaccccccaccccagaggagagagggaggaaatgaagcaaggcatccaccctcaggtgtaacatcaaggctgcagatacagtaggtagcagagatgtcagcaggtgctggggaaggaagtccagccccaggctgcgcactgcctgggagagtatctccccaggataccttggctctggccagctcatcttccagggagttctctgttttctggatgagaactattaaatgtctagaaatgttaatgccttgagggagaaaagcttattttgtttttgcttttgaaagaaaacttaatttctgaaccttaaaaccatggaaacatgttcacaccattgac

SEQ ID NO: 81047 - DNA, 2202 bp, Homo sapiens
tttaaatgggagtttagaatattatgccacttttgtcaaacttcacatactctatgtcttttcatgttcagtttttaagtttttacggagtcagaattttggtctttttatttatgacatttgaatttcaggtcctggttagaagtttcttcccactccagtatttcaaaatactgttgtctgtatgttagtcgttttatagtctgatttttttaggttgatatttttaatcatgtatatagtatgaagactcactttactatcagcttgccaaattttaacaaaaaaaagaaaaaattgaaattatgatgggatttgaatgaattttgcatgttaatttgggaagaatgcatatctttacaaaattgagttttcccatctaagaatgtggtttttcaaataggtgttgtgaatttctcataatagttattcttcattattgcatttttattgcttttatgaatgagatctttttcttttgggctactgatggtataaataaagctattgcaacttgcattttaactttattgtttattcccatattaactctctggttaactaacaaccagaaagtccaggaatggttttgcagaaggaaagattcagtcttaaccagaaagggttaactttcagggaacgtttggggaaaactttgatgttaacatcttctgaccatagcacaaatgaatgtgtttattgtattataatataatactaatgattatgattcttttagtgttgattactgaggcagttgctaatatgaatcattactgtggcatccttatataagtatagaaattcaagttcacctagcagataaggagagtttggttcatatctagtgttagttttgagagacttccaagtatatctaataatctagtggagcataataacttttccagattttctaaatattaccttaatattcattttaatgtttaaagggaaagtaaagttctccaacatcacttgaaggaaatgatgttccaaaaatcagaaagtgagaaaatatcacctctcccaaaaatgttgaaaacgttcatttggattaaaatcatcataatcgtgttagaagaattaaattaatgaaaattcctcctctatttgctcttttgtgattttattgagtttgtcatttactaactttttttaaattttgcttttaagaaaatagatgttaccaataaagttgttgcagaaattctttcaaaaaccactgaatatcttcagccaaatccaggtaaagttgaaatattctcttgttcatttgctgtcacagactctaataacccatgtttacttggtgtttagttgacataatgtagaaacaatgtcgtctgtgtcccaataatgaaattcagtttttaaagctgagtctccagtgaccaaaggtagttgcattcggtcctactgatgagaaagagaacagctatttttgtgaatttcagttgacatcatccgaatggagtgctggtcatagcaacaagagagcactgagcaaaggttttatgagttgcttcagaaagccactaaacatttggcaaatattttcttccttatttcctctttataatttttttaaaaattctgcccttgtgtactatatacataaaggtatatgttaatttgaaaaagctttctctttgtggcttaaatgctggagaaacaagatgtggtgaatacgaaaggctgcttaaatccagtgtcacatcagcttctccactgaaggtctgggtttctaggtccccaagcagcatctattgatgagattttcccaggttgtaaattataggaaccaatagagggcgcccaagctttgagttctgtggatttctaaagccacctttcctttttaggaatttattatctgcgtagagttcctgtgattcccttgactgtaggaatcagcacaaacctaaccatttgaaaattgagaaagtaaaaatttaagaatataaattttatcaggtgtatccaggcaggtctaaagttctttacaattgtattgatgataatagctttgaaaaccataaaaatatatcttctcctccctggccacatcagtgattgaaatcagccacacaaatttcttttcctgatatatcagtcaacaaatatttaatatgtgctttctctgcactagaggatttcggggtgctggagtacactatgaaatcagacagatacttcacc

SEQ ID NO: 81048 - DNA, 1021 bp, Homo sapiens
gtttggttaacctggttagaaattatctggacattaagaaggctgaagtgagggatcgtataaagaacgttggaaaataatatctgagcatggctactgcatcattacattccataaagacactcattcattctatcaccgatctgtccattcattcattcattccacaaatattcctggagcacctgaagtgaggggagcctccatcaggtgctgaggtgctcccaacagcagtgtaaggtgggttcctgccctctggaatctaggccgagaaaaagcaatgaccattttaatagaaataattttttgtgccaggttttgaatgtagcacctctctgagggactccattctctttttttagcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtaagtatttaaaccaaataggagattttaatgtaaatgaatgaaacattgaatatatgactatgatcggcatgttgaaaaactctaaagcaggagtgtccaatcttttggcttccctgggccacacataaaatacactaatactaataatagctgatgagcttaaaaaaaaaatcataattttttttttttttgagacgctgtctcgctctgtcaccaggctggagtgcagtgtctcggctcactacaacctccgtctccttggttcaagtgattctcatgcctcagccttctgagtagctaggattacagccacgcaccaccacactcggctaatttttgtatttttagtagagatagggtttcaccatgttggccaggagggtctcgatctcctgatctcatgatctgcctgcctgggcctctcaaagtgctgggattaaaggtgtgagccaccacccccgtccaatctcataatgttttaagaaagtttatgagtt

SEQ ID NO: 81049 - DNA, 1043 bp, Homo sapiens
cccaggtttatagctgaggagactcagagatgattgtttaggcttcagaagcccatcttactctcttcttggggtcaacagcagttagatcagagggaatcacctgatccttttccatgtcagtgtgtctgtgccatagccaggtggtctgaccatcctctcctgttgaccagacaagctagagaaaaatctcctgctggtcactccttggacctgacatgccaatgccgatactgcctggtgcttggggataaacagagaatgtgactagttgggagaaagacaaaatgccaatacatggttgatggggcatacattgaacccttggccctgtgtttggcccatctccaacaaccaggccagagctggtggccttgtagcccatgggactctggtttcctgctccctgtgagtcacaacccgcacgtccaaccttggtcactcaacctcttgttgccatgttgcttcctttcctggtggggaagtcctgcatgaggagctgtgcttcgggatggctggggagggctggatttcctggcagaaactaaagatggctgggacctgttctaatcgccatgtcaaacacagtgggtctttgggtgctgctgcctgatggattggacggtgtttctacctgatctggtacctgctggagacaaggtgcacaaactgtcaaatgagtggctgcaagggaagcctggtggcaggcagcagaggccctgacacttcctccagacacaagtgggacatgcttctgttactgtggtgggaagtttggggatgtcagtcacagccattcaccctttgggttctgaccaatggaggaagtgacaaaaaagccggattggaatcaagggacatctctttaactgatgagaatgcttgaaaattgtaaaatacagacctcctggtcaactgtgctgaaggacatggcctgggcctaaagtcctgttggcactttcccctccttgcaccttcggtggatgacagccagctctaggggagagcccgcctgtcttaccacccagatacagcctgagacg

SEQ ID NO: 81050 - DNA, 1051 bp, Homo sapiens
ggtctccagatgtagtacttcctagggttttctggccaacaggccatttgcagggatttccagggtgtggttgttcactgtcctcacctctgcattctcccaactgagaaacaaacccagggagccacatgagatcacatgccagccccttgctcagagagcagggctctctagaaagccatgttggaaggggcagcttgggcctgggcccacagtagaagtccagtgagctattcctggcctgaagtctagaccttggagcccctgcagagagagcgggtgcagagaccacaaagccagatgacacacgatcttgtggccacttcacaaacccactttcttgagaaatccggagcccagagccaggcccctactgcctttccttgcagtgtctaggtaccctggttattagggccaagtgggtgccactcccgtaatctcaccagttagatgaatcaccaaaggaaggggaggtagagagacatgacatgctaactctaacattcctaagcagaagttttatctattttctcatctatttttggcagaactgggaatgggagaatgaagaagagtctccttcggccccacactgtagcctttggttgtcttgtgaatgggagctggattagagacattgagcatctcttcacatcttgcctgaggctgagcagtgtcgttattctataggcagtgatgcaagccaggaggtgttttggttctccaactttccagggatccaagaggggcagtcccatgactgatttctcaccaggccaagttgggcttggcagggtcctgagaagtaaccagggcagccctcctcttggaggaaagtgtgggaaagtcagcagactggttaccagccttcattgccgtatcttgggaacactatatcacccataggcttgttaacacactgtcacctcttctgtctttgcagagaagtttattcctcattattcctcacaacttactagtagcaaatgtaggtctttgacattagcagaaatcagagatattccatagaagatgcctatttcagtccagt

SEQ ID NO: 81051 - DNA, 1397 bp, Homo sapiens
ccatggtccccagcacacagctcaatgctcatgacctgggggacagctggaagcttcaattttctgaaatcaagaggaaaataatctatcgtagcacacctggtctttactgtcaacaagagacttacagcctagtagccagcccttcaggacttgtactgagcacctgctaggtgcaagcattgggcagtgctgccattgtttcccaaggtttaagggttttcaggattcatttccttcccaaagtcagccacccaatgagcagttacgaatgcatctctagattacatcaccttgtgttttagccacgacagggaggatagctggtaatccccttgcccccttcctgttccccaaccccaaatatgtttcaagaaatattaatttagctatctttcactatttctttaaaaattataaaatgcaagcattttttaaagtgggtaataagacagggcaaataaattttactaaaggcagagaggcatagcatagattttgccaagcacaccactctagcactgtaaggaagaaaaattgtttctgtaacaaattctactacgatcgtgctaggccatggccctggacttatttaaaagtacgtgtaaaagccaaagagatgaaatttaagaaatccttaggatttagtaggggccaggctgtctttgttttgtttattgggtttttggaaatttaaggctaggcttgttgcttttccagccacagagcatggtaaagtaaatgaaacccgacaggatttcattgttcggatgctgatcacagcttggcacacatggaattcaatgtgtctcttacatgcatattgagcccgtgtttaaaatagtataagtgagtaagaaaaatttaagtacaggcaactaaagaatgatttgcaactacaaatgaaagtagcttggatctttgaaggctaagtccatggttggttaggcagggtgagattgcataaatgaatcagcaggcagactttgccctaaagctgagtagaaaatgaagtatggaaatgatgcataggctttggggaagcctgggaagtgtaggattgattttgatttgtgtctttgtccagctctagagttgattggattcttgctgggggaggcccatcacctcaaccctctggagcttgcctctggggctttcagaaataagcttaattaatctctttcctgtagcagcccctcagacacgtgggggagcaggaaagctctcaggccttccttagattgcttttcctcaaattatacagccccatatcatccaggtttttccttatgagacacagctctaaaaaattcattgtaagttagtcattaatttcatgaatgtcttgatttgtgggaaacagagatgccagtgtctttatagttcattccctt

SEQ ID NO: 81052 - DNA, 1029 bp, Homo sapiens
cagttcacatgttgctccctggccccctttcttatctgtttcatttacagttcttaactgtttaatgtacttaatgtcttgatttggcttagctagaaagtgcgtgttgagacacttgacaaagtaggcagttcttttgctaaatgttggcttcgtttgtaactggaagagctttatctctctgttttcagatccatgagctttatagcatagaaaatctgctgagaaaaatcatcatctaattggaaaaacaggcattttattgagttaaatcaaattcataatcacaaataaatttgaacatgtttttccagcatttatagctccataccatgacctgtatgattattatacagagctcctacatgaaattaaatgaaatggaccaaggcagacactggtcttccctgcaaagctaggtctttgctgctggtctcctctctctctggacattacacaggctcgggcctccatggaataattttgcacttctgctgcaggtagaacaagtcagccagttggctgtgttcatagaggcagcattagactatcacagacagtccacagagattctgcaggagctgcagagcaagctacagatgcggtaagcacctccacgtttcttacaagccaagggctgcggaggtaacatctattgaaatccatctgtctgtctctccatctctccatctcccccttcccctgcctcattctgttttgaattttctttcactggctttcatggttggatgtgggatgggactgagataataagtactggctttggccagtaggatagaactgggaaaagggacctggcagcttttctcctttttcttttcattaaatcccttttttttgtgacccgtgtttagggcaactaaccaagttgctctcccacctgggacatcaacccctacagaactaccctggcttcattgctgatttgatgagagtttaactccccattcacaaagggatggaaaacatccagagctatggaaaaaagtgagatgctgtatggaaaat

SEQ ID NO: 81053 - DNA, 1215 bp, Homo sapiens
ttctcgtgtattttctaatccccacaaagaaactgtaagctcccagagagaaggaggtgggcctgtgattcctctgtcgctcccttagggctccaggtggagctgactggctgcttttgggagatgggctgggcacgacttctctgcctgggagtattgaaaagatagactctgggctcatggggttggcgcaggcagctgggagagctgaggcagccagagaccacaaacggcaccgtgagctgggtggagctggccttgtgggaaggaagcaaggcctgctgttaagggtctctctgagcttttccacatttccaatttcccatggataatccatcatgttcatctgtactttttgtctccatatcatgtggacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaaggccttggttatttttaatgttgaattgttgatttttaagcacagtcttccagctgcaaactcacaccccatggccaaccgaagtgtcacagcgcagatgcttagatgatgcctcctgatgggagccttcgctttccacctgattcaaacatgacacgaatcctccttccagctg

SEQ ID NO: 81054 - DNA, 1075 bp, Homo sapiens
attcctacaatatttttggcttttaccaaccctattatataatgagtaaacaatatcttttttggaatttttcatccaaaatattccctagctagagctttacttaggaaaatatgatttcctaagagatccttaagcctgataatttgaaccaaacaacacaaagtgcatactgcttctttggaagtgttttcatagctttccttttagtgttttccttttccctttaaaaaaaaagaacttttattgggtgttttattgtgcaaactatacatgtttgtcatataacattagaaattatagatgatcataaaagaagaaagtaaaaagtgtttgtaattccatcacaattagaaaacagaggtgagcacaaaataaggactcacatgtaacctatcatacggaagaaggtgatagggatacatgaggtgcttccagcttccagcagggttggtatgttcagtggaaagtctatcccagctctcctaaccaaggtacaaattgctcctgtttcagggtctccttcccctgggccccttgtgtctgttgctcttgacaaccaaaggttgccattgcctcaccacagcccttgtccctctcacctgatgctcattgatttgtgagctacttgagggccagatccacattgtattcacagggcactgagcacagagccttgaacttagcaagctcttggtatagtttgtgtgagaaaatgaacgaatgcatgtgagttcatgaacatcagtcagaaatgcgaattcctcatgaaagaagctagataaaatgaaatacttttgaaaagcagaagtgtagctctacttgcaatatagagggggaaaaaagtaaaagacttcatagagatatcgaaagaatgttgtggtcaagcagatcacagcagcagatgtatttgatccaagaggcgaaatgctaactgtgagtgatgatagctgggctgctgtatttgactggattcctggtcgtgaaaggaagtggagcatcagtggggaaaacacacagatgtccataaagaaaatgcaggctttgtctggggtaagacagaaagcgcttctgc

SEQ ID NO: 81055 - DNA, 1050 bp, Homo sapiens
ggtctcacaactggtgagtggtcaagatggttctgacctcagagttcatgtgcttaaccaccctcccaaagtgtcttccaaggacggcgagatgagcatgaggcgagaggtgcaccgaggcttagagtggtgggacagggaacaaagatagcacagaaatggagtcagaggggagcaaaggctgcctcagccaacccaccccttgtttccccttggcagagcccagccagctccatggttcctaacccagggtgcacatcaggagcacttggggaacttgtcccatgttctaatcctcaggccccaccctagaattttgaggggtaaatctgggcaattgcaggttgccaaacttcccaggtggccactggtgcatgcctttggttaacgcctctgcttttcagtgtctgatgccccactacagagtcagaaggcagatgactgttttatcctcaccagcctcctgatttcttagaggcagtattataaagggcagaaaatgagagttacactatgatgctcgagaacatctggacagatatttgttattagatgctgtgtgacatagtcccatctcctgcatgctgttccaaagctagccctgccaataagcacagaggcatacattattggtcagtctgcctgttaccatggtcttttgaggtaaaggcagtttaggccagtaaataaacatacgtcaggttgggagcagatgtttctgcataggagctaagggctgaagatactcatttgcagattgagcaatcagagactttagtaatgtggcctaacagctcaaggcatgctggtcagttttcagtttgcagccgattgttctcaacaaggcaaagctctgctgtgttccttccttcttttgtaaaaaatttgctgttaatttcctacatttgctttttctacttttgcttactggcatactgcatttttctcacccccatttgcaaagtagtgtatagacagtcctccagctgcagaatcagtgttgctacccattgacttttccttttttcgccttccaaaatcccccactgc

SEQ ID NO: 81056 - DNA, 1028 bp, Homo sapiens
ggtttttggggacttcctctttgtctcttggctcctaactgttctcaagcctgattcgtcagctcccttctactctgtcagttccctgacagtctttcagtaagtcccttttacttaagttagccagattagttcttaagcttttaaccaagaatgctttctggtggaacagagcctctctcacccttgtggtttggccaatggagaaaggactctcttgggggagcaaccttgaacttggctgtgtttccaggcttgcttcgatgtagcaggctggtcttagggtactggcttggctaccagggcccttctcagtaggatcattatgccatgaattggtcttaaatgtgactttctctctgtctcatgtaggatagttgacactggcaaggaccagcttcccagaatcagacacagaggagacagcttctttaggactctccagtgacaagctagtgccagttctgtggtcaagggttgacatgggttaggaacagaggtaaataaacgcttgagctgctggaaagttccatctgtgcatccccagcctcccctgcatcttttcctttttgtgtaaatttccattcctggtaaggatggacacatggagaaacccatcttttttaatacaatgtcatcccaaaaaaaatcacttggaggggtggtggcccagaattctgcatccaggggcttagtgcagacttctcaggctggcctggaggtggtgctatttgcatgtggtcagtctgggataataaagatgctaccagggtattggataagaatcactagctgaacttcactttgcatctctgtaattggattcaagaggttaattagtgaaaaacaggtgaatttcacataatctttggagtggtgcagaggactttctaacacaaaactcacaggctataaaaagataagattaacaaatttgactgcaaaaaaatttcaaatttctatatttaataaaccagcagaaaacaaacagcaaactgagaaagagtagcaactgctgtgacaaaggg

SEQ ID NO: 81057 - DNA, 1045 bp, Homo sapiens
agcggagtttggcaacaggatgtaggtttgattagggtagtgagaggctaggggcaggagagcagccaggaagctcccttgtcttcaggtgtgcagtgatgggggtctgccccagatggggcacgtgtgagaaagaactgatagtcaccatggctagcactttccaagctctttctgcaagccaggaaatatgcttagcatctaatatggaaaactcatgtaatcttcaccaccctggaagataagcaggattatcatcaccagagatcccttaagatcatgtgcctttgtaccaggcagaaccaagatttgaacttatgtgtgtgaggacatagcccatgtttttaagcgttgtcatatgtatgattctaagagacacttcctagtgggtgttggaagttggggatgcagatggaattaagacagtgactacagagcatctggcctggaggattcagaggactgggaagagaagagaaggaaactgaaggggatttggggcagagactatcacaaactccagggactgggtgaatgagtagagctgtcctctggagaaagggactgacgccgaaggtctgcagtgacccagccctgccctgggcaccttcatgcttgtctcactaagaatcctgtgagtggctggcattgtcatttcacagataggaaatataagtgcaggaaactcacatggctgttgagtggtggagccaggattcaaacccagacctgtctctttctgcatggagatctcagttttgcttgaagcaaagtgcttgattttctttggccctgaaaaaataactgcattttattccttctattaaaataagcaaacctgtctccctattttacagctgtagctgtcgttgcttcccttccggtggaggtgaccagtttgtaatgaacttctggatctccagtcagatactatggaggagagagtgatggagggctgaggagaggcctcaggttgttatttggttggggaggcacagagcagaggttcaggtctcagcaggtgtcagaggtgattacagccctt

SEQ ID NO: 81058 - DNA, 1058 bp, Homo sapiens
ttcaccgtttttctgaaattcgaatttaaccgggcggtcctgtattatttctggccttggagcattcattgcccctctcttgggctgcaaacacctggccctaaaacgggcgatcatttggtcctcaggtcctgcttggagctgacagcgggaaagtcccgatttcaggtcacttttcccggagctttcgcggagaaaacccgtaacccacccatgccgggccgcagctcagcctgttaaccccgcccctaacgggaggccctgcccacatctcgcgagagccgcgcggcccccgaaggctcgcaggcggaagtgagacgccggaagcggtcgttgccatggatcctggggacgactggctggtggaatccttgcgcttgtaaatcgtacggggctgggacatgggagctgggcctggagcttgcctggcgggcggatgggtgtgggtggaggcacgttggggatcctggtgcagagtgggccagctgtggcctcggggctcgccaccgtggaggactccgcctgggcctaggcccccatctctaggaaatggctccttcctgcgtgcgcgcgttgtgagattactagtaagagccgcgcttgtgaagacgcagtgcccagttagtttgcgccagcctctgagttcagctcagaacacagatgatctcattgattcctcacgtcaaccttgggaaatctgggtaccctgggacgtccacacatgaggaccgaggctcagggacatcaagggactggcctggtcccagaaacagggagtaaaatgggaagtaaactcagtcccacgtctgcctgactccagagtttgggccactgaaccatgcggctgccatcttggagttctttgagctgtgaagtgctgtgcatcgtgtgattctgtgtcccttttgtgcaggtaccaggatttctatgcattcgacctgtcaggagccactcgagtccttgaatggattgatgacaaaggtggtatacctttctagccctgaaggagagggaatctcactcctgagctgggtttcaggagctaagcctagagggac

SEQ ID NO: 81059 - DNA, 1067 bp, Homo sapiens
tctctacctgttcaggaaaagctgagggagcaggctttgccaccacccagacacctttgtggctccttggtgaggtggaagcaccaagaggaggaaggttaagtgtcttcccgctacaagaacggaaacgtgggagagatgaggaacttttcctctgaggtaggatcctggctgcttgacttccttgtgcctggacacctcctttccaggtcacttcatgggcaagaagagtctggagccttccagcccatccccattggggacagctccccacacctccctgagggaccagcgactgcagctgagtcatgatctgctcggaatcctcctgctaaagaaggctctgggcgtgagcctcagccgccccgcaccccaaatccaggtgagccgggcccctgctccaatgtcaggagggcccagctggggccatccccggatcctgcatgggaggaattaccacccagtactgtattagggtgtgactgtctgactaggacattatgggtgtggaccccagaaagccaggtttccaggcttttccctcttgaggcagagctcaaaggaggaacagtccaaagaaaggaagctgaccttcccagtagaccccatggggcaagaagtagggaaagaagttcccctgactcatcacccagtctaaagtaacagactgggatcatcagccttttggagcaggacctttctcccccagtctacacagtcttgtcccacccatgctgttccctgctgcattagtcaagtccacctttgctgtgtcctgtgtatgcttgtggccggaatgggaccctgaggcccagagagggaaagagaagtcagcagccaagacagagtctggaccttgttcacctggactggagctcttcccattctctcatctgcctcagtatccagtggtagggtttagcaacttcagtacatttgacgttctaggctgaatcactgtttcttgtgagggctgacgtgtgcatcatgggatgtttggcagcatccctggtctctacatactagatgccagtagcatctttcccccccatcaagttgtgacaact

SEQ ID NO: 81060 - DNA, 1056 bp, Homo sapiens
taagcaaacataaatgtattcttctggagcacagtgttttcctctgctcattatatgataccacttatccagaagttctttccaagaaagtccagacagctcctggggagaacaaagtgccaggtgtgagagggcaggtcctacagaattgttgcttccggccacagagtacttatgctaaaacatgtaaaagtattaaaattagggcagtgtggttattaccattttacagttgaagaaagtgaggttcagccgggtcacagcttgtacatggactcctgggtgcagtgcagtcctgggtgcagtgctctttccactttcttgacccagaggtctgcttcctgcccataagccaggccctccagctggatgcccgttcctcagaagcggccctttgtcccaccctccatcattctgcattcccattctgagcacctactgtgtgccagaacatttccagactgtgatgctggctgtgagagggcagagagcaaggtgaacacgggtcagattcccccaaagggcggaggtgatggggattagtttatggaagtcctttggtgcctagcacttggctggacactgtaaaaatgcctctgttagcctgggaaacctagcgacatccagtctcttggaaagaaaaaaaaaaaaagccaggcatgaaggcgtgtgcctgtggtcccagcttctggggaggctgaggcttgagcccagccctggaggttgagtttgcagtgagccgtgatcgcgccaccgcactccaacctgcgcgatactgccagatcctgtctcagaaaaaaaaaaaaaaaaaaaaaaaaaagcctgttacccgggaggagagctcctcgcccgacctctaccctcatgaagagaggctcagagggctgaagtgcctatttggccgaaagccgtggcagagtggcaaggcagggccaggggaagcggctccgccgccggggccgggcccctgtttggccggtgcccggtccttagcctgaaggtggcgggcttccgccagaagcccctggcggaagcggtgcccgcgtgcgggccaga

SEQ ID NO: 81061 - DNA, 2236 bp, Homo sapiens
aaaatttcattcacaaccagttgtgtaaaagtattatttttcctcctttgctgagtgtttccacttgtattatgtcatcttatttctgtttatctgagtcttaccgtcttcacaagttctgctgtcactcagcatttgcaccctcacactgtttgtttaaatttgtggatatggcctcgaggtccttggcagattgtaagctcctccaggacaggagccccatttcatagacactgttctgtctttcctcagtagcctgaaacagcatctattaaatgttcagtacgatcatgcattgtagtcagaggcagtagcttcagttagcattgttgttgagctgttatttggaggcagagcatatgaatcattaaagtgatctgtactttcctgttatttagtaagtacattttcttggtcttgccaaatttgaatctgaaaactttctctctccatggttccatttaaacagcatgtacccttcccagatttttaactgttaatcctgcttccttcttttttgtgtgtgtccttaggcttaggctgttgtgtcttctttcttgatgggagaagtattggcatgtatcatttttcttaaggaatcacaggcttccttcttagagacccagggcttggaatagagaaattctctgttatcctgagtacatttcttagtatttgcataagccttttaccaagtctagctaacctctcagaacgtggcatggaggctgatttcagaatctgagggctgggcctcttcttatgacattttccactgttaaacttcagagatgacccagctggttctagctaggtaaatggatgtctaccttcatcaagcagctctttcactcaggatggcctgttcaggttgttttgtagccaggtatatcttcaccactactgtctcttgctagaacagtaagtaatacaaggtaggctttcagaagtaaaatagcaaatatgacccttcacacacaactatggtgggtgtgaagccaccatagttattgccattcaattagcaaataaaacctctctggatatagaaagaatgctgtgtaaccaaaaagcattatcaaaactagaatgcgcagggcttaccaaaaaatggtgaagatgttgccttccatgtgtcattctaggtcctaaggatttttccagctgcactctcaccagacatcacattcttgcaccctggacgttggtcttacggtacagacattctgtctttgtttatgctggtcactctgcctggagtgcctggtcacttccctacctactgaaagctttctcattcatttagcagacatttattgagcatctgctctgtgccagattttgggctaggccctggggataccaagatgatggataagactatgtccctcctggtcagtaccttaacaggggcaatggacattaacagatttttccacataggatcttaagtataattatattcttcccacaatcacaaaaaaataagtaaataaataaaaataagtgcaatgatagagatgctcagggagctccagagaggagtgtttcttactccggatggagcttctgagcccatgtcatgcttcctgctctgcactgtcccgtactttgttcgtgctcctctcgaacattgccctcagagtggtttgccttatgtgtgtctctctcccccaccagagggtcggctcctggagggcattaagacagagtcagtctctgattcatcctttgatatctgctagtccctattgcagtgctttgcatattttaaacttatttatactctcttgttcataaagatacctccagtactatgtgatgaaatagaaaataattgaagaattcaggttgagagaaatgtgggaggagaaaaggatgaaatcagaggtgaggaggccgggcacagtggctcacgcctgtaatcccagcactttgggaggttgaggcaggcagaacacttgaggtcaggagttcaagaccatcctgggcaacatagtgaaatgccgtttctactaaaaatacaaaaattagccaggcgtagtagccatcacttgtaatcccagctacttgggaggctgaggcaggagaatcttttgaacctgggaggcggaagttgcagtgagccaagatcgcaccactgcactccagtgtgggcgacagagcaagagtccatctcaaaaaaaaaaaagaaaaagaaagtaaagaaagaaatcagaggtgaggttagtaccta

SEQ ID NO: 81062 - DNA, 1096 bp, Homo sapiens
ctgtaatcccagcactttgggaggctgaggcaggcagatcacctgaggtcaggagttcgagaacagcctggtcaatatgacaaaaccctgtctttactaaaaatacaaaaaaattagccaggaatggtggtacacacctgtaatcccagctactggggaggctgaggcacgagaattgcttgaatatgataggtggaggttgctgctgcactccagcctgggtgacaaagtgagactgtctcaaaaaaaaaaaaaaaagaaaattatttaaagaaatgtgatattttgcttagtattggaaacttttaaatggattatagttaaaagatgaaagaataattgggtagtttagcgatatattcacaaagaccaatttgttaattaactcttagaacctctgaacttttcaacgcttctctgacttgtggttctgtgtttattttctagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaccccttatccctgaattgtgtttgtcgggaaagcttctgaaatttgccttccttggctggttcttagtacccctgggggatataaaggcttggtgtgaacagtccttcagctaagaaggttgc

SEQ ID NO: 81063 - DNA, 1012 bp, Homo sapiens
gcttcctgagtagctgggattacagcttcctgagtagctgggattagccatgcccagctaattttttgtattttcagtagaaacagggtttcaccatgttagccaggcggtctcgaactcctgacatcaggtgatctgcccgcctcggcctcccaaagtgctgggattacagatgtgagccactgcactccgcctcctttatgcattaaaaaaaaaaaaaatttttttttttttgagacagagtttcactcttgttgcccatgcaacagcatgatcacggcaacccccacctcccaggttcaaacaattctcctgcctcagcctcccaattagctgggattacaggcatgtgccaccatgcccacctaattttttgtatttttagtagagatggagtttcaccatgttggccaggctggtctctctctttttttttaacagctgcacactaaaaaaattttatgttgaggcctaaggctctaaattaaaataatttaaaaaaacttttattgagatataattcacatatattagaatataaaattcaccatcttaaagagtacaattcagtgggtttcagtatattcacaagattgtgcaaccatcaccactatctaattccagaacatttctatcaccccaaaaataaaactcagtactcattagcagtcactccccatcctctacttcctgtagcctcggacagccactaatctgctttctgtctttgtgcatttccctattctggacttttcatataagcagaatcatacaatgcgtagtcttttgtgtccagcttctttcacctagcataatgtttttaaggcttattcatgtcgtagcatgtaataaaaacaattttagaaaatgaaactaatactgaaccaattaagtattaataaaggtgatttctttctaaactcaggaagttgaaaaattcaagagcacccattagttaagaaggaatagaaagcagcaggtgaaaagggtgaaagattggcagaggatcggg

SEQ ID NO: 81064 - DNA, 1011 bp, Homo sapiens
tgccaagcctgtttcatttatactcctgctagtacaactgagtgttcctttatctgggccttcttttttttttcttttcttttttttgaggcagagtcttgctcttttgcccaggctggagagtcttgctctgttgcccaggctggagtgcagtggagcaatctcagcttattgcaacctctgcctctcaggttcaaatgattctcatgtctcagccacccaagtagttgggattacaggtgtgtgccacaattcctggctaattttttatatttttagtagagatgggttttcgccatgttggccaggctggtctggaacccctggcttcaagtgacctgcctaccatggtctcctaaagtgctgggaccacaggcatgagccaccacatctggcctgggtcttgattcttaagtgtttattacagctctgtctgctcactctggcccattggttgggtaaaagatgcatcatcctacgaaaggttaggggagctttcactcaacttgtcttctggacaatttttgaaaaaattctgggctgggtgcggtggctaacgcctgcaatcccagcactttgggcggctgaggcgggcggatcacaaggtcaggagatcgagaccatcctggctaacacagtgaaactccgtctctactaaaaatacaaaaaaattagctgggcgtggtggcgggtgcctgtagtcccagtgactctggaggctgaggcaggagaatggcatgaacccgggaggtggagcttgcagtgagccgagatcacgccactgcactccagcctgagtgacagagcggcactctgtctaaaaaaaaaaaaaaaagaaaaagaaaagaaaaaattccacactatttaatgctatttttaaaatcccaacatagaaactatagaccattttgagctgttacttaaaaaaatgtaatagtctagtactctctgcattaaggaagtttctgtagaaaaaaaaaacctaagacatgaacagcagaagcacagaat

SEQ ID NO: 81065 - DNA, 2097 bp, Homo sapiens
gagtagctgggactacaggcacccaccaccatgcccagcttatttttgtatttttagtaaagacagggtttcgccatgttggccaggctggtctcgaacttctgacctcaggtgatccgcccaccttggcctcccaaagtgctgggattacaggcgtgagccaccgcgcctggccgtctcttgtttaatctgtaggttacttccctaactttctttgttccttgcaagtcattagttggagaaactgggttattctgtagtttcccatagtctgtatcttgccaattatatcctgtgagatagtttattgtgttcctttgttctttgtgtttccagaaaattggtagtgtgtatttattttaatataaaaatgagattgtactgtacatgctattttgtattcttttcttcacttaataaaatttgtacaatcttgtcattcttctataccattattttaatgtttacataatatttgagctccttaatattggatctttagtttgtttttagtcgtttatgaacaacacagctattaacattcttgtagctccataaataattatttcgacactagaatggtgaaaagataccccagtgccacaaacatgtttggttaacaagaacagattttgtgctttaaatgccatgaaggtatttgatgacttgggtttcctttactcttttaaggcaaaatgggcatatcaagtttttgaccaaaggagataataatgcggttgatgaccgaggcctctataaacaaggacaacattggctagagaaaaaagatgttgtggggagagccagggggtaagtatagaggggagcatctcaaactttttatatcacttgaagtgtggccctctcaatcatattatttgatcatacacagttgaatatagagatttggttctggttccaccaaatcacccttgtgtcctttgaaaattttgcttcttaaaaagtgtctaaaatttcaggtatactactccaaaggtgaggaactgggtggggtgcaataaaagaatagaatactagtgatgagatggtgaattggatgtgacaattttaaaaaatgtgttcacttatttggttcactcaagaaatagtgggcaccttccatgtgctcttacgtccacactatgctagcctctgggggtctagagcactattaatcctgcctcatgaaagttacatttctttttttttttttcttttttttgagatggagtcttgctctgtcacccaggctggagtgcaatagcgcgatctcagctcactgcagcctccgcctcctgagttcaagcgattctcctgcctcagcctcccgagtagctgggattacaggcgcccgccaccatgcccggctaattttttttttttttagtagagatggcgttatatttatatttcttaagaagtactaagtcaataactcaaaagtgttcatccaaattagttttatcatgttaatttaatccataatatttctagtcttgaaattgatgaggttgaatgaaattaaaaagttatattaagcctgtttgtttcagattttatcaggagaacagttcagtggaggacaggaattgtaagttgttggtattaaggaagtatggcattgttgctcccttaatgtaattaatagtattaacaataactcacgtttattagggcttattgtgtaccagagactcattctaagtgctttacaagtattaccacattttaacctcagaacaaccctaatattcccattctacagatgaggaaacataaatgagttaggttatgtatctaagattatactgatggtcgtaagtggctggctgcatagtccaccttaccatcatacaaaaattactagcgtaacatttctgaaatggatagttgctaattctcactagttagatgccacatggcacttttgccactgtcagaacctctgctccttttgacctagaacagactgtatggatacagagttattacaccagtaagcaggtctgagatacgcagttcccatagagaaggaagtatgagttgctaagtgaaagcttcctcagttacagcacgagagatgctcagtttggggcc

SEQ ID NO: 81066 - DNA, 1166 bp, Homo sapiens
ttctttatagataaaaaggggttcataaattagtgcaaatatcttaggaccttttcagcacttggcgtaggatggaagaggtaagaggtaagaagatactctgtagaagttagtcttacttgttaccatggaattgaatcttttcctggcttcggaaattcttaggcaaaaatctctgcttattccttggttttctttttttctctttttaaaataagtaaattgataacacaagctttatctctgtagctggctgttccttgacttgatgagccatttttccttctaaatgagttgaacatataaggtcatcttggctgttatctttataaatggcagaggaagatgatccagttctcatttgcatatctgaatatgtttagtgttttcagatgaagtgagaataagggcattgttttaaagttcattcttttatattctgtttgtcatttgaaattttaaaaggttaaggaattagtaacactgaccttttcaagatttaagcttctttgactagtgatacttgaaatggaactagttagtgaaggttaataactaaaaaaaaatcctttggcgtaactttttagtctgaggaaaccatattttgagaacaatacacatttctgttgatatagttgttagggtattgagtatactcccaaagtgatattttttattttgttgaatatctaattttgaaagtacatttaatctcatactttctttttgctgttatattcttctttcccttccagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagtatgtgcaaagtatagcatctttgtttctaagtgcttttgtttaagtgtttgtggtatttagttttgatagcctaaagattgtaaaacagtgaggaacctctaggccttcttccagtccatttttatgaatgctggaaagtttagtgaacattttgaaaactgtaaataattatttattagttcatttctttccctgaaggtttttccagaggtttttctttgttcccttttacttcccaacctgtcagtgactctgtat

SEQ ID NO: 81067 - DNA, 1049 bp, Homo sapiens
agcgcaggagacttgctcgaccagagaacctacggtcagacgacacatccactgccacacccatacccaagccgggacgcggaaccgcttctacccgcccacaccggagaggttgctcgcgattggccgggcgggcacagaggcccgccttccgaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcaggtgagcttgtccgtcctctttttctcctggctcttcttgtcccttcgaggctgctgctgcggggcccggcggaccccagggttctggtgtgagggtctgagctggtctgatacccgggtcattcgctttctttggagactgtggccagaggccgccttgtccgcctcattatttttaaccccgaactgattcagggcctaccgggggcggggcgggaagcggtgtcttcacgttccattcctcccactgaggcaggggagcaaatggaaaccgtacgcgcttgaagtgggagttggggttgcttattgttttagtcattttaaggcggcggactcttgatttctccagtcggagcgactccaggtggtttcgggagagacgaggtttagccggtttctggggcgctcaggaaggcgattggaggccccacaaaaaccgttttgctgctttcagctccttgcaaccctttagtagagc

SEQ ID NO: 81068 - DNA, 1036 bp, Homo sapiens
aagatatttatggggttcgaaagaaaaaaatattagggctgggcatgatggctcatgcctgtaattccagctacttgggaggccgaggctggtggatcacctgaggtcaggagtatgggaccagcctggccaacatggtgaaaccccatctctactaaaagtacaggcgtggtggcacgcctgtagtcccagctacttgggtggctgaagcatgagaatcacttgaacccaggaggtggaggttgcagtgagctgagattgcaccactgcactccagtctgggcaacagagtgagaatctgtctcaaaagaaaaagaaaaatatattaggactctggaaaggaatttggaaatgaatctttgaagtgtagatgggactttagcaaatagagatgggctgagtaaggagactgtcccaggcagaaggaacagtacaaccaagaacccacagtgggaaatagatggagtgttcagaggggagcaccaagaaatccatttggctggagcacaggactggtgtagaagaaaagtaggggaatcaatgtggaaaggtaaggtaggaaatggggtttcatggactaaaataaaaggaaaaataatgactatatcaaaaatggtcctgaatgccaagctgaaccctgtgtcttttgcatgtcaggaagaaccactgaggcttgaacagtgcaggtaataaatttgcaaataaattgtcctgtaacttcttactcaatgaggtttgaggtctcaacccatcagtcctaatatttggacatctaattgactcagagcaatgagttaggggcagcagtctttgcattacagctgtttacagactgaaagttgggccttgcttctctggctattaatgactacaatttctattcaccagcacagtttcagagcgagaacaaattagcaaagagtaaaatggaaaggaaaaagaaatgtgcaccttaaactagtactttgaaaacttttttgactgcaatcctccataagaaatgtattttacacctcaacccagaacatacgcatgc

SEQ ID NO: 81069 - DNA, 1050 bp, Homo sapiens
ggggaaagggagaggggagattagtctggagactagggccaaattagagcaatggggccttgggggcagaatgcctccctccttagtttggtttgtatctccagtgtaattaggaacctttgaagggtttaagggaatgacatgatatttacattttaaaaggtgtctagcccctgtgcagggaatggacttttgagataagcaggtaaggcaaggctttctgggttgagtggcttaactacctgatctgtttggaaaagcctcaagcagtctgggggagatcctttgcctctgtgagtctgcttcatccagcttttaggaagggaaggcaaaaatgaattaacatttatggagtacctgccaggtgggagaaccaattttaaagacttctgcatacattattgtatttaacttagtcctctctacaccctaagaaaaagaggttatcatacccattttacaaagaaataaatgcagaggggatagatgacttattcaaagccacatttgtaacatagcctggattcaaagcacgtctgcctgaattcagagcccactggctctggagccagaccactgaagtttgcattttgctcctgtcacttgctaaccaatgatcttgagttatttagcctctcttgtgcctcagtttgctcacattttaagtgcagataaaactccctcatacagttgttgtacagattaagtcatgtaaacagttgagcactgggttcaaatattagttgcttttattattttaaaaatttttattactttttttttttttttaaactggagacaagctggatgcggtggctcatgtctgtaatcccagcactgtgggacactgaggcgggtggatcacctaaggtcaggagttcgaggccatcctggccaacatggcgaaaccctgtctctactaaaaatataaaaattagctgggcatggtggcacgcgcctgtagtcccagcttctcaggaggctgaggcaggagaattgctttaacctgggaggtgaaggttgcagtgagctaagattgagccactgcac

SEQ ID NO: 81070 - DNA, 1102 bp, Homo sapiens
caggggttttgaggcagagttggaatttgagccaagtctttaaggattggggagattccccccccccccaccctgccatttaaaaagtaatatgtgcttagtttagaaaatttgggaacaatcaggaagaaattctggtaattcttcctaatgatagacagttgagatggataggcagaggggagtgatccttttaaaatgtcagtctgatagaatttgaggataagtggttaaaaaaaaaaagaaccacctacaacaaataaaatattggtctgagcacatcattcttctactccaaatcctcctgtactctttcgtcttagagtcaaagtcaaagacctagcaatggcctgccatcatctgcttcccagccatatctcctactccttctgcttcagggcctttctcttccttcttgttcatccctccgcctaaaacctcttctcccccatattctcatggcttgctctctcacttcagaactgagaatatattcactcttctgatgtcatatgaggagccctggttgagaaagagaataagtatgacttttatgaatctgtctctgtatgtctgtctccttccagtggattatcagctctacatgggcaggaatttcatttgttctgttcactgtggtgtccactgtggtatccacagtgactagaacaaggcctggcacacagtaatggtgctcaatattattgaatgaatgaaagtacatgcgtgcatgtctgcggtgtgtgtgtggtgtagagatagggtagcaaagggcagtgtagctagcagctggagtaggagagaaggagtgtggttgggtggaagagaggaggatgaagaggatgctctcagtaggaacggagttcagagacatggtccagtctgttccagtctctataccccatctcttactggtgctgttcagcagggaggcagtgagttggtgctgcaagaccagtgaggggcagctgctgaaaaacacagtagccctggtcttaggcctagattatggaggtttttgaaagcctggcccagggcttggacctaatatggtaggctacaggaagaagtttttttttttttaggacagagtttccctctt

SEQ ID NO: 81071 - DNA, 1729 bp, Homo sapiens
ataagagatggtgaaaagtgttatggagaaaaatgaagcaggcttggtggatgaggggtttggtggggaggaaggtcttctattttaaattgagaagtcagagaaatctcatggattaaatggcctttgagcggaggtctgaaggaagtgagagagggagccacgcagatatctgagaaaagagcaatcagattggagaaaagagcaagtgcaaaagcccttcaggctggggagggtttaaggaacccatgggggaaggtacggattttggggatcctatggtggctccacctctgtaatttctggtttaattggtctgagctggggttaggcattaggatcgctccaggtctaagaagcactggtctgagggttaaataagccttatcccctgtatttggtggagagatttgaagggtaactgtgagtaggagacttcagctgctctgatgggaagggcaagcaagggccccctgaccttgccaggaataacaggaatcttccacagtaataaaaactcttcagtttatgtcccttttcttatttgattacctcacctctctgggcctcagtttccttgcttgtagagtaagtggtttaaatttaatggttttctagaatctctttggctccgatagtcctgaatctttctagtgttggaagaagctctaatctagaacagtgttctagagcaatgttgtctaatcttggtcttataacactctaagttgtgtcatcattatggcaagggctgtggtgaatgtctcaataccaaattgaaggaaaatttgtgccctattcagtagcaccttgggaagatgagtgtgttgggaaacttgaaatgtgaaaactgacctgctggtttggagtccaaagtacaggggcagcttggtccttgggggcaggcaggagcctgagtgccagtcttagttcactcactggtgagttccttgtgcagtgtgaagagtgtgttataaactgtaagattcctacacatccaagcatgcgtgtgtgattagggtgacctgggagaagcagccagcctggaagtgaagcctgacactcaggtttgttagccattctgcatccaaactgcatgattgcgcatgtgagagagactgtctggataacccaacagaaactggtggccagaggaaccaaggttaatctggagtaaataacctagtatactcattggagcacctcccaatttatttactattggacagcagacctaagacaccccttggcccctgatctctaacttttgtcctcatttggacagcacagtgtctgcttgttagtttatgttttgaaatgtgaaagcccaaataagaaaaggaaaaacttcaggaaagttttctctagtttctttctgtagaattgagataattagtttctttcccttcccttctacatttttacattaatattgtctgtattactatttagaatccaaactaaatgttggtctgtcaaaactggacaaaaatgaagtcaagcgagggaatgcaggattagagtgagaatgggcagaacgagaaattcagggaatgagtccttttattaggtaacttgtgggtatatgtagttgatgggccgttaaccagtgtttctcaacgctagtcaattaaatctgaatcttagaggggtagtggccaagtattagtagcttccaaagttctcaaggtgattctcatgtttggctacagttagggatcacctagtt

SEQ ID NO: 81072 - DNA, 1159 bp, Homo sapiens
tgtgctctgaagcaccagcctgtaatagagggaggggagcagacgtggagctgggaaaagttttgtctttgactacatttgtggcctgcttgaatttacatttggggatttttctcagggtcttacttacacttggattattattattagtttttttaaactatctttccttactctaacacttaccttcagacccacttaaaaaaaattttgtttttcttctttccttaggtggtgtttggactctagaccatgtgcctaggtagaagtttttcctttctccgcagctctgctcccctagcaacgctcgccacacccttgttttgagatcctctctaaggtatgatgtctaggctgacctgaactggccttgaaaagccaagagtttgaacatgagatttttttgttccctggattttgttttgttttgttttgtttttttttgatgataaaatacatataacaaaagttaccatttttaagtgtgcagctcagtggcattaaatacattcacagttgtacaagcatcaccactgtccatctccagaacctgatatcatctcatactaaaactctgtacctattaaacagtaactccctctctctctcctgctaacccctggcaaccaattctacttcttgtctctatgaatttgcctactctagggacctcatgtaagtggaatcattcagtatttgtctgttgtagcatgtgtcagaatttccttcctttttaaagttgaatgatattccattgtgtgtatataccacattttgtttatcctttcatctgttgatagatacttgggttacttccacctttgagtgttatgaataatcctgctatgaacatgggtgtacaagtatcttgtgtcctcccgctcttaattcttttgagtatatacccagaagtggaattgctggatcatatggtaattctgtttaattttttaaggaactgccaactgctttctatagcagctgcaccattttacattcctaccagcgatgcacaaggaatctgatttctccacatcctcactagcacttgttattattgttttttttttttttttttttttgagacagagtcttgctctgttgccagactggagtgcagtgatgtgatcttggctcactgaaacctccacctcccggg

SEQ ID NO: 81073 - DNA, 1108 bp, Homo sapiens
caatactctggctgctgtgttgggaatgactagtagaggcaagggtggaagcaagaagatcagttggcaggcttttgtgggaacacaggagagagatgatggtagaggtggtgagaaatggctggacttgaatatattttgaaggttgagttgacaggatgtgcttgtggattggatgaagggtgtgaaagaaagagaggtttaggcctaagcagctggaagaatggcattgtcatttactgaaatgcggaaggctgtaggaggaaatcaagagctagattttagacatagtagatctgaggtgcctattagatatccaagtagagatccaaatctagaaataacaataatttagtgaatgtctactgaggggcttataaaatagcaggaaagagaacactttactgaaatgttcagtaaactacagtacaggtagaaaattatgatgtgaggaagaataaataaagcaaaagggagcaaaagggagagtgaggtgacttctgtaggaattctgtgcccttgatgagcctcagtggtgcccacagatgtttccagtggattatgtatgtgtaggtgctcaagagcagggtctgggccttcagctttgtgccctcagtgccagtcataagtcttagcatttggtgactgttcccctctctgagcctcagttctccatgtataaaaaatgaagagtttggactagaccggtgcagtggaatcacctgggaagctttaaaaaaaaaacaaccaaaaagcaggaatccatcctagacatattgaatcagaattttcatggtggagcctgtgtatctgtatttttaagtcattccccatgttactcttttgcagtctgtccagcagcggccttcagacaggcatttggaagcccctggaccagatagtttccaagggccccttcagctttaacatcttatgagtcttgttagaatgttcgcagtataattctgtccttgaaatctttggttggcgtggaaaaggcatggcagggggagaggagaagctgcctttgggtgaaggacaccttgcacagggcaagcaggggcaggtacatcagccagggggttgaagagacatccaggaatggctc

SEQ ID NO: 81074 - DNA, 1592 bp, Homo sapiens
ggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaagg

SEQ ID NO: 81075 - DNA, 1029 bp, Homo sapiens
gggcctctccagacgcggcgctactgcagacaccagggccgccaagggagcggactcggagccggccctggggcgggcacatgggccccggcgccccccggcgtctccaagccgcgctgcccgggtcgggccaggccaggggagggacagcagcaggtgacgacggcccggccaccggctataaataggggcgcgcgtcagccgcgggcgggagcggcggcggcgggcaggggcccgggggccggggcctggaggacaggcgaggcagcggcgagtgcggggccggcggtcggggagggcggtgccatggggtcgcggagggcccccagccggggctggggcgcgggtgggcggtcgggggcggggggcgacggtgaggacgacggccccgtgtggatccccagcccagccagccggagctacctgctcagcgtgcggcccgagaccaggtaagtggcaccaaggggcagggcggcgtcgggccggcgatgccctgggatcagtccctgtgagggcggcctggcccctggaggcctgggctgggcctgcgccctcgagccctctcagccccaaggcccagggcctggggacatggccgggctggaatggctttcatagccccttgtgacccctcctgatccatgcgcctcaggcctctggcaattcgaggctcaagagaggacaaaggctccactttggagtgatttcatggggtctgaaggctttccttatctcccctgccccctaccctgctactccctggcttgggattccacagctagcgataaggaaagccagagtggctgaaattcctccctggcaggaagggagggggagagcactggtggggacagggagagggtgctggggggctgcccagagtaggagctgcttagctcagggtggggaggttctccaggaagaaataaacctttgtaaataaggttcctctactgggccgaggacttgggtcctccccaggacctgagtgggggctggtgagatagggggtgggatgaggtactgtct

SEQ ID NO: 81076 - DNA, 1031 bp, Homo sapiens
aaaacaggcatcgaggacattcaggaaaagtcctgggcacttcctcgtgaattggctgagtcctactgaccttggagttgggaaagttcaaatgtaaccggaaccggtttctgcataaaactcgtcaaatggtgtcacatgtctggggcagggctgaggactgatgttagtgactgagtcagactcaacaaggcccctggctgccaggaaagaatacccctttttcttactcctggctctacagataaaccagaatgaaatttggacatttattccagtccttagagaagctgactcccttgtgggagcctcacatttgtcacagtgacttgtctgggctttgcctcctgtgtttggcctttgtcaataccagtggaacaaacagaagaggcggaaccagggtccttcttggagacagcagcaatgaaggaagggaggaaagagtgccttgaaaaccaggcagaatggggagggcaggggatctgggcttttaggaaaagggctggagaatggacatagtgctgctgcctggctgagcagttgtatgatagataaatgttaattgtacacctcatgagcacaaagcttgtgccagcctgagagctagaggcaggatagaagtggctggcttaagtccctttggacctaaatgggaatgttcttaaaaggagtctctttcatcaagtatctggagggggcaggacagcaggagtgggagaaagctttggactttgggctgtgttttgcccctgcagagttttttactgctcctgctggctagccacagacccctagaggttctgagagacaaggacagccagatttatcaggcatctggaaaagcctttggccaaagtggggagaatgtgactggggctgcagtggggagtggaggaggcgaggcagttcctgcttctctagtaaggcctgacctgtgttggagggagccaccgtactgtctgctgtccctcagaacagcctcactgcctgtgggggtggggagagctccctagagatagggagaaagacag

SEQ ID NO: 81077 - DNA, 1788 bp, Homo sapiens
ttttttcttctattctgcttatgtatgaattcccattttgtgagatgaaggtggcacgaagaactctttaaagcttttctgccccaatgtttgatgcctctcattcagctccccctcagaggcagtaaatggggagctcccctgcctgggtgacagccctgagcctagctgtggcccagccagcagggcacaggcaggtctcccaccttctgaagaccaggtgcctccattagttcagggtttctcctgacctgactaacaatgtaagggcgaggcctagagagggcagggcggttggtccaggagcagcagagctgggggaggggtcctctgtcccagctcacttcttgaccaacatgcaggtggaacttgtcattttcctctctgaattagaaagctaactctccccctctccttcccagggaagaagtccagacccaaagaagaagaaatctcccaatcctgaaagagagggacaaatgaaatttatggtcaggaaaggatggagttggccagtgccttggaaccatgggaggttctgcccacgcggcctccagaggatttttaaagctctgagcagaggcagctgcactctagcacgctcctttccatcttttctggagcagcagctccctctcgggggcagcacccttcctgcttgaaaaatgcctttctctcccctgacctctctccctcccccaggtcccccactgtactttcctcctctttctttttcttcctctctctctctctcccttctatagaacagcagttaaatacccatcgtctgtgcagcactgcactaggagccacagaagctacaagaactaggtttgaaggctggatgggcaggatttagttgagcagtaggagggaggaaggactttccaaacagggaggacaaaagggaaggctcaggggtcaggaaggactgttcatgctgataagggacaggcctggctgtggtggcgccggagcattgggaagtagagggaatctggttgcagcgggagtgtgagtagatcagggagggccctaccaacccagttaaggagtggagactcagcgtcctctacactgggggactgcagcattttgttagagaagtgggttatatgaggggttaaggagagggggctgaggtggtcatcaaatgtggagccatgagggtctagactgtagtgcaacaacaagagcagagaggaagggagaaacaagggccaagaattgtgcggactggatttggggttggagaagaagtagtccaagatggcaggttttgagcttaggagtttgggagaatgctggaggtatctaccaacccaggagcccggggttaggggtgaagccaggttttagggaaaaggatgggtttggtgttgtggttataaagagatgggatcctcatagagctttcttatggttagagacatagaccgtgagcaccattgaacaggctgggctgctgggaaggaagggagagctcttctcatgatagggacagccgaagggagtgtggatggggtgacctctgacatctctcaaggagctgggatccaggtccccactggagatttttgtatcaggaaaggaggagggagagggaacagttggctcatagtaagtgggctagactccactaaggggcggtcctgtgtgggtcctcatcctagtgccctacacagtggcctttcctagctgccccaggcaagagagatgattggggcctcaggcagaatgggccttgtgtggaccatggagctgggtgcctcccagctcctgctgaat

SEQ ID NO: 81078 - DNA, 1053 bp, Homo sapiens
ggggcctgaaaacttggctgtttactgtagggtgacctaggtagccactgttgggaactgccaagtaagtttctttagttccttcctcttgaacttgctaggtttcctagcgaaaggttttctgggagttatgcagatcagagggttgggtgggctctcagcataagacatttattttatgatatatggttattacatttttctatttttcatagaatagtcatgccctcagttatgctggcttactctcagggcagatttttacatttccaaataataaacttcatctttggctgtggtggggaaggagcagtcatccagtgagatagaatggttgaagggttccaaagatttattttttaagcatctttgaacctttcctccttcctctttctcccagttccagaggtaccaaattgccaattcttaggccctttggggattttctggtgtcgaaaggatagttctcagttttctccactgctagcttagggttgagctgtcttgagtctgctaagtcagtttccacttgtccatctgctttctaactttcaaaattttgttgctcctattactctccttgcctgttcacttcatctttgtgcttttacatatgttgattaaaaagtcttttcagggcagtttagtgagtttgagggagggtatgaagatagatggcatgttcattctgcctttttacctagaagcctactctttttctgcctggcaaattccttctcatctttcaaggggcttgccctctgggaggtcatctccagtgtttccaggagagctcttgctccatcctccaccacatagtttttttgtttacacatctctctctctccaacaagatcgtgacatctacaagcacagggcatacacctgacacatcatgcctctccagagctggcacaaagatgctcagtacatatcaaatgaccacagtgaagcttgactgtgctgatgacaaaaccagtaccttttccacttgccatattgcctgttcatttcagccacagctttggtaccttggtaacagcggctgcagtg

SEQ ID NO: 81079 - DNA, 1014 bp, Homo sapiens
tgggaatggttgggacaaggctgcaagtttccaagctgggttcttgagtcaggtctgctggctgtgaaacagaggccacagggtgtgaaggggctgagggaaggccacaggctcaagtgccgccatgggctgtcctggccagggccagaagtgtgtgcacacctgcctgtggacatgcacaaatgcacagctgggagtgaaggacccggagccctcctgcttttatgcattttaggatatagttcacattattcagggctcaaggcaatgtgttctcccaaataaatttgcttccaaagctcattgtggctatgaagccctaagctgtcgggttggcccccactgtgtagaggcagcaccagagggtggcatggaggctgaggccccagccctggggctgtggggtccattcagctcctccctccttgccccacccctgccctcttgcccaagcatttgactggactcagatgccctggagactgaggctgtgctgggcaggtcatggggcagggaggctctgagctgggtccttgtagggatgagatcatctcacaggatggtgaggacacctgtgctggctctggtcacacacacagtgatgtaaccagggggtttagctcacagtggaaacatggggctcgctttacagccagggctgcccagagtttgttcctggccgacgctgctgcagcctcgcctcccctgctccctgctcctgtacacagttccccagcatgccctttgcttgtcaccctccccctctcatgttggggttcccttgtcaggcatgcccttcccatccaccttgtgtgttcaccctacttactcatttacttatcgtcccacagatttcttttaagtaattaccacaccacagtgtcaggcactgtcttaggtggtggggatatagcagtgaacaagatacagtttctacccacatgggacctaagtctagcaggagagataggcaaggaaatagtcaatgacagtattgtgattagtgctgtgaag

SEQ ID NO: 81080 - DNA, 1126 bp, Homo sapiens
ctatccaaggcaattagtgccacaggagaaggactgctctgggagccctggggagaggacagtctccttcatatggtaggggtgaggggtggaataacccatgagcaaggtctttcaggaaaggcaggatttcttcaggaagaggtggaaagggccagagctgggtctgggtgctagatattccccagtccagattctgagatcagagattagggtgagtgggcatggatggggctttgggcatttgtcacatgtctttgcctcccaacttccagcaggcctgagaaaccaggaggcaagattcccatcagagcagttgtagatgaggtccgaggagactgggatgccagactggaaagagatctgaatgtccatgtagttaaatccttgcttttgtccctctgttttcaggtcctggaatgccagacaaccacggctcctaccatgtcggccagcagcagctctgatgtagcctccattggggttagcacttccggaagtcaaggtatcattgaacccatggatatggaaacccaggaggatgggagaacatctgctaaccagagaactggaagcaagaagaatgtgcaggcagatgggaagatacaagtggatggaaggaccaggggagatggaacacagacagcccagaggacacgtgcagataggaagacgcaggtggatgctgggacacaagaaagcaagaggccacagtcagacaggagtgcacagaagggcatgatgacacagggaagggcagagacacagctagaaacaacacaggcaggtgagaagatacaggaagacaggaaggcccaggcagataagggcacacaggaagacagaaggatgcagggagagaaggggatgcagggagagaaggggacgcagtcagaggggagcgcgcccacagccatggaaggtcagtctgagcaagaggtggcaaccagcctcggcccaccatccagaacccccaaactcccacctacagcgggtcctagagctcctctgaatattgaatgttttgtacagaccccagaagggtcttgtttcccaaaaaaacctggttgcctgcccagatctgaggaggcagtagtaacagcctccaggaaccatgagcaaactg

SEQ ID NO: 81081 - DNA, 1050 bp, Homo sapiens
agctcttggccctggaatcgcgctgcttccccaaagctctcagagctggggttcacagcagcctctgagagtggggtccaaggacgcttaggaccacagtctgcccccatgccatggccctcacgagtagggtctccactctgcagcgcaggggatgaggggccggcggccttggccatcgtgcaggcctcccccgtagactgcggtgtgtatcggtgcaccatccacaatgagcacggctcggcctccaccgacttctgcctcagccctgagggtgagtgtgccccgcggcccggggtctcagcctggcctggctcctggtgggtgggcagcagtcatctttgagagaaggcactctcttggcacagcagcctgaaggcactgctttcttctttttctgtatctagtgttgtcaggattcatctccagagaagaaggtgaaggtatggttcccccctggggaaggcggggtggtcctacccctgccatctgcagggaggaccctctttaagggcttggaatctggtcccaatccacatactgctcctctttgcctcttagtttaggatatggcttgggagatgatggaggaggactgctgtatcagaagattatgggggaagaagtgaccaagggggccactgcacaggagttagttcacccttgtgccctttgcccatgtcagagtctttgatccagggcagaaccggccaccagggcatgtcttatcctgccagctcctacccagggtttctcacagtgctctgtggaccctggtattagattcacacagggaacctgctagaaatgcagtttcctggtccctgctgcactgcagacatctttaatgacctaggagggacctaggaatattgcgttttcagcaggccccctggtgatcatgaaataccttcaaagtttgatacacatttgaagggctcaaatagggatgggcacgtactgctcctacaagagacaggctaaggcttgggactgtgaaggcagccagtgataaaaagatgtttggagctgtatttgctaacaaatgca

SEQ ID NO: 81082 - DNA, 1054 bp, Homo sapiens
gtgggcagatcacgaggtcaggagttcgagactagcctggccaacacggtgaaacgccatctctactaaaaatacaaaaattagccgggcgtggtggtgcacacctgtaaccccagctactctggaggctgagggaggagaattgcttaaacccaggaggcggaggttacagtgagccaagattgtaccgctgcactccagcctgggcaacagagcaagactctgtcttggaaaaaaaaataaagcaagaaagaaaatcacccctggccccagcagccagggacagtcaattcattgccattttggtgtatttctttctaatcttttcatgcgccattttggagtttgtttccccactgcccctagttttggttcttctctacctgcaatgttgtgggccctttcccacttcactgtgaggccttgatgaccatcattttcaatgacagcctgacgacgcttagccggtctcccattgttagatgtctgagttggttctgatttccctgcttggtaaatgacacagtgatagggggaaacgtgtcatatttctctgtggaaaagaacagagaagcaaagggtttggggtcccagtgaagataaaacttcaggaagggagaatcccaggggctgacattgctctgccatcttgctgggagtggttttcacagcgtggctcccagaaggagactgagggtcaaacggtggctgtcatagaggcagatttcctgagaaggagttctcaaactgcaggactggatgtgatgggttggcttgcagtggtgagttccccgtcacagtaagcattcaaagagagagcctagagagggagtaccttcctacgctagtacatacctacactaaggtggaattggtttagctcttaaatccatttcatttcaactcttaggttctagagctttgtctgaaagcattacaaattcctccactaagggggaaacctcagctaacggggattagtggtcaacagtgacagcctaaaaaggaagaaagaaccttgaacttggagccaaaagatgtgataggctctaat

SEQ ID NO: 81083 - DNA, 1069 bp, Homo sapiens
gccttcatttctggagttcctatcaccagcatgccctctccatctccctgccgcctgccctgctcccatctcagttctcattttccccagcagctttggcttccaggacctgcgatgcaccctgcccttgtggctgctggggccctacaccctcacccctacctgccaggtccaacttctttcctagctggggctgaccctgacctagggcagtgggagggtggagccctggccagcagttattcagctcagccccagtgagccaggtcctgtttctgttctgccacagactttggttccagtgggcagcagccttgctccttgtgagccccacaggctgacctgggtccccatcctcagggcctgtgtccttcccttagctccacagagtggaggcttggcctgactcctgtagctccagctaggctcttgccttctctctgcagccctccctcagtccttgctacctgctccagctgcccttgggctgtgggcagggtgccctgttgatatggacaacacagtcctctcccaggattggccctccgccccttccctgcccatatgttggcctcagctccactagctgggtcatggaacagcccaaggactgcccttgacccccttctctggactccctgcacgctcattctgtggccagtggccttccctagaagactgcaggccacttgaatatagggctcacactgtacccttctgtcttagtcagttttggctgataacaaaataccataaatgggatagcttataaacaacagaaatgtatttctcacagctcttgaggctgggaagtccaaaatcaaggtgctagaagatgctgtgcctggtgagagccagtttctcataggtggcaccttctccctgtgtcctcacatggcagaagaggctaatgagatccctggggcctcttgcataaggacactaatcccattcatgtgggctttactctcatgaccttatcacctcccaaagaccccccctcctaataccttcaccttgggggctaggatttcagcatatgaactttgaggagacatgaacattcaga

SEQ ID NO: 81084 - DNA, 1302 bp, Homo sapiens
ccttttttttttttttttttttttaaagacagttttttgctcttgttgcccaggctggagtgtaatggtgcgatctcagcttaccacaacctccgcctcccgggtcgaagcaattcgcatgccttagcctcccgagtagctgggattacaggcttgcaccaccatgcccggctaattttttttttgtatatttagtagagatggggtttctccatattggtcaggctggttttgaactcctgatctcaggtgatctgcccacctcggcctcccagagtgctgggattacaggtgtgagccaccgcgcccggccttggattggttcttaaataggagaaggttcatgatgtgaggacacagggtgaggcagacatcccagagtaaccttaaaggacagaatattttaaaaaattttaaaaaaaagaacagagggataagtacttaggacatgagtaagccctcagtcttacccaagcttagtggcttcatcctggtttctcagtacactgaggcagtaggaggtgatggattctgcagttcttagagtgcaaactattcatattaataatagccaccatttcttggatgccctctgtgttgcaagcaccatgttagatgctttaaagatgttatctcatttaatcctttcaaccctgtgaggtggcaggtatcatttccctttagcagataagacaccagaggttagaaacttgtccgaggtcatacatttaagctgagattcaaatccactggtcctggctctcacctgttaggttgttgctctctgttaactagctatgttcattgcatttcccattctttggtcttctgctaagctacagatttcacaggacaactgggttttaagcaggcatcttgaatctgcattatcaggattttgttaagtttcgacttactgtggaagttggttacagctctaccttaggttcctgtgtttgaggaagttgaagtcatcttcagccctgtgccagttaactcctgaagctagatattttgtgacgccctctgaatctgccctctttgctgtctgaaatgagttgggagggcatcccttgggagtttttttcctttcccctttctcctgctcaggtttcaggcagcctgccctaccaagagttccccaggagctggttctttccattgccctttgcctagagtgctgttcccccaccagtgctgcatgtacctatcttctcaggagttagtcaaggcccagctgaaagcttccttgagcccttggctggcttgcactcttttctctgctcttgggacctgctcctg

SEQ ID NO: 81085 - DNA, 1030 bp, Homo sapiens
attatctctatattactataggacttttttttgttttttgttttgaaacagggtcttgctgtgtcacccagactggagtatagtggcatgatcacagcttgagctcctgggctcaaatgatcctctcacctcagccccctgagtagctgggactgctgccatgcaccaccacatctggctaatgttttaatttttttgtagagaaaggttctcactatattgcccaggctggtcttgaactcccggactcaagcaatcttcctgccttggcctcccaaagtgttgggattacaagtatgtgccactgtgcccagctgttattacaggaacttttaatattttgagttaaatattccaggccattttagaatttgaatagcttgtcaaatttgttgattttatagcacctccgtcttgaaaaatatgccccctggtgttcctaaaagaacattttgagagaattatatggtatttagtaaggcaattagaaatcaccaagtatttagggactattgcttaagaagctaatttgcacaatcagaattcattagcccaggacacagacaccttatacacctgtggtgacaaatgaaaactgtgaaagtccaatctgattcattcctctcagaatatggaggacaggagagtggggacaacctcagcattaggactgccctctctcgttttgtttcaaaaagagtttaagtaacttaaaaaatacatataataagtttaaaaaaaaaaggaaattgggccaagggaacatggcgagaactgaccaattaagtcaggagtgaggtcagtatgtggaaacacatgccacaggggcatgcatgattgccatggggctgggtcacacgttcggctctgagcttccacagcctcaccaaatacgaaaacagttgcagaattctggagatttaaaaatggcaaatgactcaggagaagtacagtttctgagctcagacctaaagaaattattctctcaggaaggggaacatcacactctggggactgttgtgaggtgggg

SEQ ID NO: 81086 - DNA, 1051 bp, Homo sapiens
atttagtttatacaaagttcaaaatcaggcagaactatggtgttggcagttaggacagggctcacctttgaggaaggggaggggtagtgatttggagaaggcttgagggcttttgaatgttctatttttgacctaggtggtaattatatgggtgagttcactttgtgataattaaccaagctgcacacttagggtttatattcttttctgtaagtatgttaaccttcaataaaaatgtccatcaaaaaaactttcagtgtttattatacttgagccacatgttcatatgcacctgtcccttctggtcttagggacttagcatgtgctttagcctcagtctcaaacagtttgacttcctttttgcaaaataatactcatcattttggaaaccttatctgataagctgcttccctctcttccttacacacagaagggagtgtgtagtttccctgttatatcctctgtgggcaccatgtcctgaaccacagctaggagttcacatgtctgtatgtatttgattgcctctcctgatgtttaaacttgaggacgctgggcctatttatgccagtcattatgtctctagggaccactacagtgcctacactcattggtatttgtcaaatgaatgaactgacttcaaagggaacagtctttttttctgtcacccatttcaacttttaattagggttagtaggaggttggagcccctgtgaggttgcatggaacatttttgagataatagtgactttaatagccttaaagtatgacctgtaggaaaactcagctgaaggaggggagcagttattggctaatcagtgtcccttaacctagttctgtgtttcccccagtcgtgttcctgagagtgaagtttatatatgatgacttcatttgttctggcttttctcatgacaatcctaaggtcaagtctattttaagtctgagaaatatgtcctggaagttagtttcagagtccctatttcctttttctctcctttgtattgaaatcttggctgtcctccccattccctccttccaaactgttcttagaaac

SEQ ID NO: 81087 - DNA, 1035 bp, Homo sapiens
atacatatgtaactaacctgcacattgtgcacatgtaccctaaaacttaaagtataataataatagaataaaaaaaaaagaagaaaataatggttttaacatacagtattgttagactccgaaaagtagattagggctttctttttaagaatttatttggaaattaattttgatgatttataaatgattatataatacccagttatacaatttacccttgggaacaaagaaggaaatataatattatattggcttgtataatcaccctcttactttggaaacaaaagagtgggagtgggagaattttggagaacctgatccactgttaactctaataatcgtttcctgaagaacagccccatccacagttaaacagaaatctggggatattaaatggagctttgtactcttgtcacttttttctttcttcatcaatttctagttgcttagaattaagggctacactaaatgaccctgcatttgttggtgagaacaggggaagcagagagatgttttgtaagggatggaaggtagtatttacatacaaaattcacagatttggaccttagcaactttgatcctgatgggcttgatagagaaattacaaggttaaaagggctttgagatgtggtggaaagaacagagacttcctataccctgcctctaccactgtgcacttttaacaagttattatcttctctgagcatcacttttcttatctgcaaaatgggaataatgaattctatcttttagagtttttgagattaactgagataatgtgataaatgatacttttcttaaggcagtgaggtagaaaagcaacaaatttttattagctctttcttcctctccttcaatttaatctattatatgtgtttgccagaataaaggaattgtgtttaaaggattgtctgtaattactcaacttagtattttgaaatattttattgtggagaatttataacatgtacaaaagtagaattatgttgtatttgttgcataacaaattaccccaaagtttactggcttaaaaca

SEQ ID NO: 81088 - DNA, 1035 bp, Homo sapiens
agttttacgttttgcagatactttctccaacttcgtggcttactttttcattcctttacatgggtcttttgatgacccaaagttcttaattttgaaatctaacttatcagtcttttcctttatgattagtgcttttcgtatctggttaagaaatctttgcctcaatgaaagcaaaaatagaaaaatgaaattgcatcaaactaaaaagcttctgtactcggcaaaggaaacaattagcagcatggagagacaagctgcagactgggagaaaagatttgcaaatcacacatcagataaggggccaatatccaaaatatataagaaccgcaaactactaataacaagaaaacacgtaacttaaaaaatggccaaaggacctgaatagacatttctcagaagatatacagatggctaacagataaatggaaaaaaatgctcaacacctctaatcatcagagaaatgcaaattaaaccataatgaaatatatcacctcatacctttggattggctgttatcaaaaaggtgaaagataaggctgaggccggtggctcacacctgtaatcccagcactttgggagactgaggcaggcagatcacctgaggttaggagtttgagaccagcctgaccaacatggagaaaccccgtctctactaaagatacaaaattagccaggcgtggtggttcatgcctgtaatcctagctacttgggaggctgaggcaggagaattgcttgaactcgggaggcagaggttgcagtgagccgagattgtgccattgcactccagccttagtaacaagagcgaaactccatctcaagaaaaaaaaaaaaaagaaaagagtgggtacagtggctcatgcctataagcccatcactttgggaggctgagacgggaggatcgcttgagctcaggagttccagaccagcctgagcaacctagtaagacctcatttctatagaacacaaagtaaaaattagctaggaatagtggcacatgcctgtagtcccagctacttgggaatctgaggtgggagg

SEQ ID NO: 81089 - DNA, 1047 bp, Homo sapiens
gcctctcaaagtgttgagattacaagcatgagccaccatgcccagccaagagatggttttaacagtacagcctcaggttgaggacagcattcagaaggtccgatggtttaatacaagaaggaggctggggttaacaatttactctttgttgcagatttttttcagatagctttcagtctcaaaactcactttctacccaaagctatgacagagatagcatgtttagcttccctacctggtcaaggatgccttctttgttctagaaccaaagtaggggctttatgaatggttgtgcatccacttccagtagtaatggctatacattatggagcacttaactgtgtggcgggtactgcacagagtgcttcatatctgttactcatttaatcttcacaatcactattttccaagtgaagcttagcaaagtgaagaaactcacagtttttcagaaagggtcacagttcaaaccccatatctgtctaacctccagaatacgggttatgggaactgtgggtgattctagataattcgattgtgtggattgtcattctcattgtaatctccttaaatctcattaaagctcattagccaacccaataaaacctaggctggcctttgcagtcaggatgctagtagtgatcaggtatgcaggcaaacagctgtagaacctccagacaaggctctctgtctgaatatacagtgtgttacagaaacatgattgacaaatgtaaatattcctgaaatagattcatctgagagagaggcatgctgctaatttgttaatcaattgatttggtatccatatcacccatgcctgctgaattcagtttttctttagaagggagttaaataaatagcactgagttctcaacctttggctccctgctccctggggcagcctgtagaccccccttttcattctgacagatgaataggcaagtgatcagttttgtcttttgggagggtggagggaagaggtagattctagtctggcctccatgattttatacctcagattgccacattggatttgaggatcctcagatc

SEQ ID NO: 81090 - DNA, 1050 bp, Homo sapiens
catactatcccttcaggctttccatgtacaaccagtgaccatctgtttctctctctggacaaagagaaataatgtgatcaaagggacacagcctggaaagagtcaggagataccagttcttaggtgtggaagagtctaaatccagacacttgtggaccacctattactgtaagacaagtgcagtgctagatactaggagtacaaagaacctaatcctgtcccttgggtagcaggagaggaaaatgcaaataacaacatggtccagtcagttttaatagaaaaaagtatctaacacgtaaatactttggatccaatcatatttaagtccaatttagttcttaccttatgagcaaggtaagctcattaactccattttattgatgaagaagctgacactcagagaagtatggtcaaatagttggtaagcagtagttgcaggaatgggacccagttctgtctgaatttaattcctgtgatcttttcatgctctattaggaaaagtctaaaataacctggccgtaatctgtatctagctggaaaaagatcaagaaactggaaaacagcatttatccttctgacagatctttactgaacatccactatgtgccaaatggtctcctaggcattgaggattcaatagacagcaagacagacaatatctctgattaacaacagggaaagatgtgatggagagtaactgaatcagagtcaaggaaggcccctctgaggcagcaatgcaggaggtgagatctgaatgacaggaagtagccaaccatgcaagaggtggaggaaggagtaccaggcagaggaacagctagtgcacaggacctacagtggaaataaggtgggacactggaggaaacaaagaggaagaaggtcaagagatgaggttacagctaagcaggggccatacaaagaaggtcatgagatgaagttacagctaagcaggggtcatacgatgcagagttttctaaggcaggacaagacatttgaattttattctaaatttcatgaaaagccgcttaaaggttttatacaaagaagtgacat

SEQ ID NO: 81091 - DNA, 1074 bp, Homo sapiens
cagaaaacaaccaattgatgaacaatgagatcacatggacacaggaaggggaatatcacactctggggactgtggtggggaggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaaaaagaaaacaaccaattgaaattcagcgaagttatccatgctccccgcacatgaacatgtttcattcactattacatttaaaaatatatgagaagtgctgacagaaatgtgtgctcttagttctttgcatgtatggtctttgtgtagttgagtaaactcggaagaaataagccttaggagggtttctgatagctttgcagtctgtttcacaggctgcccatctcctccttaccactgttgccccattttcagtctgcttctgaagggatggagcacgggtgctcctgaaccagattgggagtgggaatagcagggagagagagggaaggaggctggctggataaggaagacgctatggatacaggcctcgcttgctccaggccaggactgacgtgattggggcagccagccactgtcctgggcagaggcacagatgctacctcttgcacctggtgactgtgtcacttaactgataggctttgaagtgtcacattttggtctactttaaatctttcttcttttaatcaaagcaattttttttttaacttggaggaattacataaaatcttgagtcaaacatttcaatacattatttataggattaagtattctaataatttcaccaagatattagcattcaccatctgagaacttacccagttaactttctttcagctaaaataaatattaatgtgttttaattcttttagtttcaagataaaatgcttaactaaatctttgttgagttctgccagtgggtttcttagcaaaaaagtaggcatatggccaggtgcagtggctcacacctgcaatcccagcactttgggaggccacag

SEQ ID NO: 81092 - DNA, 1049 bp, Homo sapiens
gtttcagttggtctggggaggggcctgcatgctggtgttttttcaaattgcagataattctaatatgcagctgagagttgagaaccactgggagaggcctagcaaagatgggctcaggtcctagccgtgggtgtgatatgctttggagaaagtgaggttaagttagcttagaagtctaggatttgtagtcccagcccctttcgtggaagaaggttaagggagaggagactaaccgctgtttaagcagagggaataagcttgctttctgaggatccctggacctgattcttcaccctccatgccctgtgggatccttgggacagaaacaaaagttggcaaggggcaggaaagatgagatgtttagataaagagaacagtgtttaaacacgcatagcaaaacaaaagttttgagggagggggcaaacaggagcaagatgctgtacatttggtcacatgctagttttttttaccttgatttctgcctttggggtaaaaaagtttggtggatacataacattcagaccaattaaaaagtctgattgcatgcatgggaatccatttgtggaaatggataaatacacattccctccacagccctcacatcccctccacagccctcacatcccagaatcttacctgcggaggaactgaggacccctgtctatctcaaggccccgattccatgtctcctggagtggcacaagcactatgtcaagaaatctcttttccctgtccctgcccaatcagaagtgggttcctgtccagtgtttttgggtgttcccatggggtcttggctgatggaggtgtggacagcaggtctagcatactcctcccttctcagtcggtgggagctggcaggcatgtcacctctgtcagacctctgggtaagaaaggggctctgttttggcctataggtataaggtttatcatgctcctggtcaacaggtcttgccttcccctgtgggggtgacagtagctgttctttacatttatgcagcagtttgtacttaaaatgctttctcccatcatgtctttttattctcggtgac

SEQ ID NO: 81093 - DNA, 1341 bp, Homo sapiens
catttgggttttttccattttttggcttttctgagtaatactgctatgaacatttgcgtataagtttttgtgtggacataatggggctgtttcccaaaaaggggctgcacttttttacattcccaccagcagtgtaggagggttcctcactaatacatgttatcgactgtcttttttattattcaagtgggtgtgatatagtgttccacttatttttgttaatgtttattttctaatttttttcaataaacattgtcacttgtataattttaaaaatgttttcaaacacgaaggatgtgagaaaatgctcacagaagaaggctaagtgaagaaagcaggaagcaaagctagtctttccagatgccctcaattttgtgaaaataatttgtttaaaataataggtagaaatgattgccttctctttgccaggctctgtgcagtattcttgactctattctcttatttagtcttcatgaagactctaaggtggtgaaagggaaggcttgatggggttcagtcacttgcccagggtcccacagctgctgaagagctgtgatttgaccgtggtatgtggccaccctggctcactggcccaatgtgtctttccttcatattggaaggaaagataccgcagtgtgtacatagtggtgattccagtggaggggcttgcaggggggtgtttatttctttttatgttttaaaatattttctcccttccttataaatcggacaaaaaatacatttaaataatgtaataacccaagattttattttgtagtatttacattaatcattcctttttttgtttactcataaagggcttgtaactcagtattcactgcattagaaaacagtgaagatgcaattgaaattacaagcgaagaccgttttatacaggtttgttattttggaaatctgtctttctggatttcttgttttgctttttccaacttttaggattgaacctctccaatatgatttttttttttctttttgaagtttaggagaccagtttttccttcgaggattatcagaacaaaatcaaatatgtaatttaaaataagctctctatagattagaaaacatactaataattaaggtgctagaaaatgcctgtagaaatgccacatttgcattcattatttccactagtttgtttatttaacaaggagagactcactgaaaaggatgattgctgggggcttgggggtagtgctgttgtacgaaggggaatgccctgaccataggtctgcaagtacaagtctttcacctttctcactgtttttgaagataatttgcacttacagaaatatactagaaacaactaaaagtttcagaaat

SEQ ID NO: 81094 - DNA, 2069 bp, Homo sapiens
ggtgtgagccactgcagctggcctgtactgctttatttctaaaaagagcctgggtatttgtttcgtttttcacagtttttggggagcatggaaaagcaacctttgtcctttgtcaggaacctgctggtctatgggcaacatggcagcagggcaggccgctgagctggcctgtgttttgaggtgaaagaatccataattccatctccggggaacagggcttgttgaggggtcagcaggccttatggaacagtggcactgtgatcaggaaggggaattcaggcatctgctggagaccagcattgcagaatggagacttaggaaatggccagatggctaggagttgggaccttggagtgtcagatgctaggtgttggatattgaagtttgaccttggggcagaagagaaattttgctgatgttcaagcagggaatattataaacattttccatctccacaaaccctgctgcccattgttgtcagtggctcctcttttgggtaaaaataacaggtatgttgatttccagcccccgcacttaggcttctttgcatcctatatgtatatccacctgactcttctcttttttcttcttccccaagacttgtctatcagggctttagaacccatagtctcccatcttctcagatacctaaactttatattgtcaattctcttttagagatcttttttttttttcttgagacatggacttgatctgtcacccaggctggagtgcggtggcacgatcttggctcactgcagccttgatctcccaggctcaagcgattttcccacttcagcctcccaagtagctgggaccacacgtgtctaccatcacacctggctaattttttaagcatattttttagaaatggggtctcactgtgttgcccaggctggtctcaaactcctaggctcaagcagtcctactccctcagcttcccaaagtactgggattacaggcgtgagccaccatgcttggcctcttttaaaaatcttgattttttttttccctccctcagaaactgtgtgttcttcttttgtcatttaatgggtaccaagtaaatggtggctacttagatgcctaagatgatgatgtgcagctgcagaaatcttcagcatttcaaaacttttaccttcattagctcctgtgcctttgctttcctctcactgtctccccttttcctactcttcttccatttcctcccagatttaccagaactctggcctttgccccctactgttgtccctcagaatgttcctttgttgttgaagtatcttttctgctctgtgtagaaatctcacacttctctggttttagtgtcagcctcttttccaaggtctggttcagcatcctactatcatcttaattgtctagcaatggttttctctcatctcccaaaaacccaatctctcttccaaatcctgctgtctctgctcatggacctacctcacagttgctttgacttagattcctgaaatggttttgatcccttcctccccgttggtcccctccatcaaatccacaagcattgatggctgttaaacccctgttttgagggtccattgcctgggcctgaccttgctcagggccttcttcccacactctggagttacagtgtgtaactctgtctccttgtccggaatcctccatctccactcggtccaccatacactactgcctgattagtcttactgagtcatcattttgtcatgttgcttcctcagcatagagctcatagtcctcagcttggctgccaggattctatagttgaacctcagcctacctttcccattcagtaacaaaagccccaagtgttctttgacagtttatcatgtgcacacactgtgcccaccctggggataggatggctggatgatgatgatttaattctcaagacagcgggtgccaagagggactgcatcaatagcttggtgcatagcttgtagcagacagaagggaggtaatagtcttactcctgttctgaggggagcttggcctggagaaagaggcctatgcaaaccacctgcacccaaaccagctcatttactgaatgtttactgttatgt

SEQ ID NO: 81095 - DNA, 1159 bp, Homo sapiens
ccttcagttgcacgggaggcaacagctttgacgtctagtgagccttttctcctgtctttatgtttgcctgtctgattatctgtagaaacaaatgataaatcacctcttcaaagatatttaaacaacatattaaggaaggttaccaatctaaaatttttttaaaactctcaactttaaatgttttaaatgccacaaaagtaaacacagtacagagatgaagactatgagaaaccagttttatgggggtagagtttctcaaaatgtcccaccaggtgcacagataaacaagggctttacagttccagattatgtaattacagagtcccaagacataaagtgacaactgatagaaatgacctcaggagaatttctcctattatatttctatataattgaataaaatgatgggaaaattttgatccccactcatcttgccccaaagaaaaaaaatcttttattttctctacaaaataaggactacaatatcccagggaaaacattcttctctttcctagggtagtatggtgaacactgtttgaggtatatttcaaatgatagctcatctgcctccctttcaccccctcttctctacgaaggacacactactctcctaggcttcaaacggggactgtctttgactcttctctaatcctgacccccaaaccaatcactgacaaggcaactctgacttaccttcctgaccccttctctgtgcacctgctgggtaccatgcatccccatttcacagacaaggaaactaggagctgctttgcagatgagtgcatagcagggtgggcgctgagctcagctcttcccacagccatggagtagcttctctgccttgtcttggcttcctcacttggaacttctctccctgctcatgtacaggatccgaatgtaggcccttagcacttcctttgcaccatcgaaaaggctcttcacttgctctttgcttctttgcccaattaaactaaatcctcttctctgtgggcactaaagagtgaatgtgtcaaggtcaccaacgacctcctttttgctaaatctgaaggctacaactcaatccttacctgacctgacttgattgtggtactagacacaactgatccctttctggacacttctgtttgcagagtccacactctcctggttttccttccac

SEQ ID NO: 81096 - DNA, 1125 bp, Homo sapiens
ttgacacattcactctttagtgcccacagagaagaggatttagtttaattgggcaaagaagcaaagagcaagtgaagagccttttcgatggtgcaaaggaagtgctaagggcctacattcggatcctgtacatgagcagggagagaagttccaagtgaggaagccaagacaaggcagagaagctactccatggctgtgggaagagctgagctcagcgcccaccctgctatgcactcatctgcaaagcagctcctagtttccttgtctgtgaaatggggatgcatggtacccagcaggtgcacagagaaggggtcaggaaggtaagtcagagttgccttgtcagtgattggtttgggggtcaggattagagaagagtcaaagacagtccccgtttgaagcctaggagagtagtgtgtccttcgtagagaagagggggtgaaagggaggcagatgagctatcatttgaaatatacctcaaacagtgttcaccatactaccctaggaaagagaagaatgttttccctgggatattgtagtccttattttgtagagaaaataaaagattttttttctttggggcaagatgagtggggatcaaaattttcccatcattttattcaattatatagaaatataataggagaaattctcctgaggtcatttctatcagttgtcactttatgtcttgggactctgtaattacataatctggaactgtaaagcccttgtttatctgtgcacctggtgggacattttgagaaactctacccccataaaactggtttctcatagtcttcatctctgtactgtgtttacttttgtggcatttaaaacatttaaagttgagagttttaaaaaaattttagattggtaaccttccttaatatgttgtttaaatatctttgaagaggtgatttatcatttgtttctacagataatcagacaggcaaacataaagacaggagaaaaggctcactagacgtcaaagctgttgcctcccgtgcaactgaaggtgagtgacaaagacaagagaaaaaaatgtgatcaaatcactgttgaacacatggagccctgccctgccttgcccaggctcatcctgtctacctccaattcttgggagaggag

SEQ ID NO: 81097 - DNA, 1033 bp, Homo sapiens
ttttcacctcattaagaagtttcttggtatgtcataaagcctcagaaacaaagcagctgtccctgaggcggtactgtcctccctaagaaacagttaatcctggccgggagcggtggctcacaccgccgagatgggcagatcacaaggtcaggagttcaagaccagcctggccaacatggcaaaatcctgtctctactgaaaatacaaaaaattagccaggcatggtggcaggtgcctgtaatcccactactcaggaggctgaggcaggagaatcacttgaacccgggaggcggaggttgcagtgagctgagactgtaccacaacactccagcctgggcaacagagtgagattccgtctcaaaaaaaaaaaaaaaagttaatcctttaaagcctatttgttctccaaattacatcactttacagacactcaaatggtttcaagcaatataatcactcccatctcccttgatgatgtcccaccacggatagctcgggccatggaaaatgaggaatactgggactttgatatttttgaactggaggctgccacccacaataggtgagttcatgcagagctcagcagcgggagaactagattcccagggcctgtgtgaggaggctacctgaggagtatggattgtgcacaagcctggtacctggtcagggtggggccctaaggaaggagtaacagggcaccaggtggctctgagtcaccagggcctgggggagagtctgctggccacagtgatggcacattcatggaaagcatgcaactgagccagtgacttctccaagtagcacaggacttttttctgtgaaataaaggtatttctcctgtaggtggtaatatgttaagattgctgtaagagatctgctcagagcctagaaccaaaatttattagaaacacatacacatgtgataagagctgctcccagcttttggttgttctgttggtgataggcatagggacacccaaagccccagtcatcctcatctgggtgtgatcacagagagtgggagcaggaatggggt

SEQ ID NO: 81098 - DNA, 1042 bp, Homo sapiens
gttttcttataggcaggatgtctggccaatggcatgggtccagcaagtccaaaggagaggatagtgttcaaggtggtacaagcttagcctggagaaagggttattttgaggaacccactagtgcaagtaggaagctgaacctggaaggacagaatgagcaaactccccccaacaaatcgggagccccaacgaggctgaggtcagagctgctgtgggcagccagctctcacccgtgcatcatggtcccctgagggcaagaagtggaaccagagttggttggccccaccagagagaggccagcacagcccaagcaatctccactttgctgccctgcactctctgaaatttggcttggaacctattcaggccttaaacacttggcctgtttgtttgctttgttctaatattgtggggttttttctgtctataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggtgagctgttgtttacctgccacatttaatgggcaggagcagtggggagagtctagtgcttctgcctccactaagatacatagcatgactgctcacgtgtgcagcctggcacaggaagggcaaggtcatacgaggaatcaggcaggaggccacattagctttgggaaattgatgtgttaattcatgacataatcccagctattccatgagggtacaagaggcagaatttggtcccggaggagaaacctaacaaggacaggatagggctattcttctgggggtctcactccaagcctgtacactagtagagccaagtaactgttggatatccccactttagggcctccatctgtacatgaaagtctgcagggctctaaggtcaggttcatcatctctgttcccagcactgctcc

SEQ ID NO: 81099 - DNA, 1044 bp, Homo sapiens
acacttaatttggtttgtgtggcttattatatgaacatgattctgtttcagttccccagatggaactagcttaaatgtctgtcattcatagtggagcaaaatggccagagtgtcatttattgttaacttcagttgtattcctttaccatctgctaaatgaaaaagaaaaatttgagaaatactgtgtgtgtcagtttgctcagagtgatttctcgtgctaagtgagtcctgtggagaagcgttcctgggcttttctggtttggtgggccttgtgttataaaaccaattttcttcacctgatgaagctaaagacaaattttcttcaggtacagccattgcacttttaaattacagagccgcttttaggattcacagtactcgctccatggcttcccttcctggttgtgtggttttgtgtgtgtgattgtggggaaggaggttgacagaggttggaagggattgtcagggagggacataatgtaagcaagtactacttacaacatgacgtgacgagtgcactagttgctttccttctctgggcggtgatggcatgttatactgtaggtactattgttttaggatttctcacacttcttttgccttgactaaatggtaactgcacacatactatactataaatggactcctcctctagtcctttaactccttgagggctgtgatagaccttatttagctttttaccctctttgccggtagtcttaacatagtgcaggcacggtacgtgtttgaattgggtaaattatttttactgcctagtggtagctagcgtacacaggagagagccactaactggggacctgtccagaatgacagttcacttgcagatctgtgatgacatttactttaaaaggatttctaacctttttttaatctgtcaattattttttgaaaagaagtgggtttaactagcgctctaaggatttcaacaagaggttccaatttagaaatcagcccccccctttttgtgaaattattattgtttttttttagagtcggaatcttcactgttgcccagttgtctct

SEQ ID NO: 81100 - DNA, 1012 bp, Homo sapiens
ggactgcaaaccttttattaagcacttttatatgaaatttgaggtttctgtcaaattagacatggaaaattaaagctgcacaaattactgatctgtgcagtttttttgagtcctctcgtatgttagactttttttttttttttttttttaagataactgtttctcttaagtaccagcacaggaatgctatgatttatacataattatttttgttttcacgtcagtagtcttttgttccccccattgaatttggtgattcccccccgccccccgaggattattttttaaataatgcattcccaagtattttgacttttgtgaaagaaaatactttttaaggtaattgaatacctccataaatcttgtatttccttaataatttatttggcaatgtatttaaaaacagtgttgatatcttaaaagctttcatttgaaggcccaaaaacaactgatacattgtttttcatagcactttttgtaaatattatgtcctaagtgcatagattctttgaaatactcctctttcaccccctctgtggtaaagaattattttggctgctttgccaaaagtgcttgtggcagtctaaagatgatcactttattagttagctcactgggatatgtgcccataaatggagagttttctttcccgagctcaaataaaggtaatggttcatctgtgagatacctcgggactcaaatactaattcagaagaaaaattatatttattctctcccctcagccttgatgcatgttgaaatctgcggggacaagttcactaatataatagctgtcacttattgggaaccattattgatctattggtagctattcatctaagtgtcttatataggtcaggtcttatctctgcaaggaaggtatttttatgattttaccagaaaaggaaattgaagctcagagaaattaatagctaattttatatatacttcattcagcattttatttaaggcctgttgtatgtcaggcacactactgggcaccagggattga

SEQ ID NO: 81101 - DNA, 1056 bp, Homo sapiens
gatgggacgggtgtgctgggtctttttttttttttttgggacggagtcttgctctgtcacccaggctggaatgcagtggtgcgatctgggctcactgcaacctccgcctcctgggttcaagagattctcctgtttcagcttcccgagtggctgagactacaggcatgcgctgccatgcctggctaatttttttaaaattttttttatttttagtagagacagggtttcaccatgttggccaggctgttcttcaactcctgacctcaggtgatctgtctgccttggcctcccaaagtgctgggattataggcatgagccatcgtgcccggcctgtgctgggtcttaaagcatgagtaggaatttgccaggcctgggttgaggagagaaagaatggaatgatggttctgctgtgatacactgtgtgcaaagaaacagacgtcaaagagcttggtgtgtttgaactcagtgagcagtgaggtgtagaattatttcgtgtggatagggtgtggtcaccgaattaggttagaaagtcaaaatggggtgggtggaagcgtcttttagtttgtcctcttgaagcaaaagggaggatagtctggttttgttttggatacctcattctgtgagcagtagaggatagtggcttggcagagggagaagggagcattgcctctcagacaagttagaggaggccattaccatagttttggacagattgtgagggcttgaatgcagtgaggttggaagggagccagcagatctaatggacattttgaaagttgaatggatgaaacttgttgagtagatggtgggaattaggaggtggtagttgtccagaataactgggaatttctagcacaggctgctgggtgaatgagagtgcactgaggggcatgattcattctggcatgggagaggagttggcttcctggaagtggtaatgtttacatttggcttagattacctcattcaaagtggttcttgattttgcccacaatctattttagagtccatttattcatctagaaagtaccaactgcttactgcatgccagtaatt

SEQ ID NO: 81102 - DNA, 1648 bp, Homo sapiens
attggttcaacatcaggagtgggatgggaaggaaaacacaataagaagaaaattgaaagatgggaaattagtggtggactgtgtcatgaacagtgtcacctgtactcggatctatgaaaaagtagaataaaaattccatcatcactttggacaggagttaactaagagaatgaccaagctcagttcaatgagcaaatctccataccgtttctttttttttttttttcattactgtgttcaattatctttatcccaaacattttacatacagctatttcaaagtgtgttggattaattaggatcatccctttggttaataaataaatgtgtttgtgctaataaaaaaaatgagatgtgtatattgatgattatcttttaaaaaataatgggaggtttatgagagagctggtgcacttaaagcctggtggttcagtacgcataacccctagagctcagttttcatggatcaaggcagatttgtaaatagaagaataatgagtcagtatggtaaatgtcaatgggaagattcgaatgaagtgagatgggagcacagaaggatggagcaactatatttgctttgaggagtcaaggagggaaggacattctaaaattttgagagcattaaagaataggttactcttttataattgtagagtttattgtactatgtatttgcataaatggacacataatatttagttaaatacctctattcattgtgcagtttatgtttagcactgtgccaggttcttggggaaggagttaaaaaataaaagatgtcctgtttcagtactttcttgggagtggggctactatgtgaacagcttgagtaacattttgttcaagactcagttgtgggtagccaggtactgtggtggactggtgcttttgttaagtctggtttttttcctccctgctggtaagccactttagaaatgatcagtttcattaatgtaaagtcatattttatacctctacgcactaattcccgtggacatgactggtagctacgataatttttgggactccagtggtcaatgagtatgtctcaggtacttaatttcttccatggctaactagtttttagtgggcaaaaggaaatttgagagaagctgcataatttgctttaacttgcagggtgtgttaagtattgaatcacatctattatgattatggaattttggtgtgtgtttgaatgtcagagatagtgttaaggtcagaattctgctgaaaactgacccatctgaaaaccagtatgttcactccattccactcttcagcaaggccatagtttccctatcatggttcatttctccttttccctgcccattaaaggtagcaaattttggaggttcttacacatttggggttcttaaaattgttctgtaatgtgtaagctcggctgtccacaaatgattataggattgacatttgttatttggtggagtttgatatattagagtaatataaatgtgttatgcttcaaaatgaaatacgggatttttattcactagtttgtctttgtttcattcctttccaaaagaaaattaatgcttaacttgaacagctgattttttgcattgtttcccttaaaagcttgctagcataggaacaaaaggtaacttttttctttgccttttattgtttt

SEQ ID NO: 81103 - DNA, 1025 bp, Homo sapiens
agctttctcttttagctatttcaactcaattctaacctcattcctaacttagcctaactctatagtttattttggctgcaaaatcctgcccactttatcttctataaaaatgtatttttccttcaatgaggggaaaaatgcaagctaacatatttattttggattatctttttaccccattattttcctaatgagctctgttcatgcctctctgcaaatcttaaaaaaaaaaaagtcgattcagtttgaggatagctgaaacattttttatgcagaaagtggtttgtaaaatacgggagaattctactgaattccctcttagagcatcattcagtagtagcttactggtgataaagattactattgatgtctttactattctgggaaagttttaaagtttacaaggagaatgttagaattcagtatataaaccaggaaaaactttactttgttatctgaaaaagacctaagtggatataaggcctcattataccactcaattttcattcacttcgcaaaattgacttttatgaagctaatataatacaaggtgaaaaaaatggtccatgatcctggcagtgttgctatggactaatttccatcactttgagtcatattactataaaagggcagaaaacactgggggaggctcttagcagatttctaactactttgtttactttggttgatagggagtttgctgtcatatttttgaaaggtggtggtggtgggattgtctgctatctcctttctctgccacctcccaggtatataggtgatggttacaatttggaaaatatagaaagaaaaaaaaatatacaccccattaccttgagatacttaacattttagttttcttcttgcttttttctctttcttacatggttttaaaaatagtttttaaaatattaaatcatataccattattttctcctttttcccccctttaacactgtgttcccttctgtacagttttttttttttttttttttttttggagtactgtttttaagggatagcatcat

SEQ ID NO: 81104 - DNA, 1080 bp, Homo sapiens
ggggtttcaccgtgttagccaggatagtctcaatctcctgaccttgtgatccgcctgcctcagcctcccaaagtgctgggattacaggcgtgagccactgtgcctggcctagcctgcttttccttaacagtaccatcatctatctagttaaggtgaaaatctttctagactcctacttagtcttcactctcaagtatattggatcactaagttctagccatgctacctttcaaatatttctcaaatttgttttctcctcttcatccctattactattgcccatatttaggttcactagtttttatcaggacagctgcagtagcctcccaagttccttttcacagacttaccttttcaaatgtgttttcatatcaagggcaaaaattgctttcttgggcatacatgtcatgctattttaatgcttacagacttttaatggcttcccattgcacctggagtcaaatttaactccatattagtctataattgtttctttttatctttctggcgttttctcctgctcctatcacacacacactcaccaagcttttgctatcaaacttctagcagttttctgactattgtgtgcaattttatgtgcatatgcatttgtacaggctgtttattctccctggaaagtacacagcccccgatacagctcgccctgcattttacccatcattgtaatgcgttcttagaagatacagtggaagttcactggtgtgacattattcatgaaccctgtcacccccagcctggacagaaataccttccttgctccatgtttattgagccatttatgatactttctgtggtagacaggataatggcccccacaaagttgtccatgtccttatccttggaacctatgaacattttaccttatatggcacaaggttctctctgaagatataattaagatgaaaggccttgagatgtggagatcatcttggattacccagatgggccagtctaatcataggaatctttaaaagcagagaacctttcttgcctgtgggcagagagagagatgacaattgaagaaaggtcagataaatttgactttgctggctctgaaga

SEQ ID NO: 81105 - DNA, 1048 bp, Homo sapiens
ccattagaaataaaatttttcattgaagcgattaacattaacaaaatctttaataggggactgcttagaatattgaagttttcctcatatctgtagaattttcacttaattatgacatatacaagtttttaatttgaagtcttcattgtttaaaacttttccttccaattttgataggtggtttaacaaaaacctaccaccttgtgtttccagtgtcattgttctcaagatgttaaaggcttagtattgtgaaattataacattgaagacaatatttattctcaagacaagaaccagtctaataattaacaaggtaactgacatttttaacgtctctgatcccctctgacacttgtgtgactcgttcgatagtcacataacgtgtgtgagaaggtgggccgtgcctgccttggaaatcattcctaacaggtctcgcatttgtccaggtaaggtcatccagctcagtaatgtcctcatttgtgtgagagcctacctgcctatatttagtctttccaggtggtttataattggtttagcccattggacagcctgctttttggttgatagaggctggggaggatgaaggaagtgtaaaggcttgaatttggcagtctctttgccggatatctattttaacccctcctgaagttaatttacataaaacccagctgtgtaagaatttttctaaatttaaagtttattcttattaccgtagggataggaatgtcagcactcactgaattatggccttcctctcctgtgtctggacctcctggcagcttatggttcccgtttcctttggataacaggatacagctggtggcaaaattctcacctgtggaatggccattgggagttttcttctccatatagatctttgcaaagcagcagaaaccatttttgcaggaaaccacaagcctgtgttaaacaccaaaagagaattgaaataacatgtccatgagttcctctttccagaggtaccaaccatcatgtgggatcctaagtatagtgttaagtagctctttgtcctccccttcactttgaggtt

SEQ ID NO: 81106 - DNA, 1062 bp, Homo sapiens
ataaactctaaaatgattataaggatgtcagagttctgattttttaaaactacatttaacttactattttaaattatttgtatttcattattgtaagagttctgattttttttccatgataattacattgatttggtgtttgtgcatgtgtttggcccaaactcaggatcatttatgccttttgggtaatccagcgttgataaagaataaattaaatgagtgaacgtgggtgttactgttttgtcgttgctgttgttttaatttgctatgttcttttgttttactgttgaatgttaccctgtgttagactcttcatttccttcatgtcatgcctgcctcctttgtcccactcccaacccctcgccttacccatttgggctcagtgctttgtgttttgtcttggtggctagtaagtaccatcatatgatagtggggcagagcagggctaactgttccgtatgagaatcagacacatattatgagtcttaacatcatttcccgaagtgtgggtcatgattccagagcaaaggatcaccagatttggtctcccgatttctactctttctggtcctgggaatgagaatcagccttatttaacaaggccttaaactgatgttcatgtgtactaaggttcaagaatcgctgcttaaaactaactgctcaattattaatgtagctgcaaacaaaagtaaagcattcatgagggtcttgtaagacttcctcagtcccttattcaggaaatatatttggcccatgtggtattttacttttttgatagaacttggcatcttcaacaggaaaagcgtatttactttttgtatcctggtcttcttccgttgttcagaatttctagctcatattcccagcctccccaaccagggcataacatttttatagccaccagcccaggctccgtgggttgaaggaaagagtttttggatcctgttattttcctggaggaagagctgaacattgactcttttacaagaatccaaagtatgcattgtcatttccatgttaaccctcactcgaaatttttgtgggttttgaaggattgactgt

SEQ ID NO: 81107 - DNA, 1152 bp, Homo sapiens
tgttaattcctgtataaatttcactgatatttcttctgcttgatgcaggaacacttgacaagttagttaaggtagattggtccataaatttataggttctttcattcccatgtcctaggcaagtctgagcaggccctggaaagctgattaaaaggccagtgagcacagtgagcttaattgtaaattaaatggatatttaatacattaagaaggcactcaagcctttcaatctttcattttcatccatgcttgctgtttgaatctgatgggcttgaaattgactttgttcttctaaaaatgttggttggttattgctgcctttctcaagcttggttttcagtgtggatttctgcagataatttttgcacctaaaagtacaaagtcattaagtgaagatagtcaggaaggaaagagtgccctgagccaggaggtctgttatagcgcatggggtggaccagagaatgaatgggcatgggcatggaggtggttcagtcagtgtgggaaagccacttgcttgtcagttttctactgcgttgtccagcagaacacgttgaagcttggggcctgcaactggtgtggagatgattgcatttaggaggctgatgtagatttttttccctctaagtgtgtgttaactgccttttggtgaagtcttgatccgagacatacacaacttgatctgtgaggattgtaatatcgagatggttctgttatttgagttaggcatggctaggctaccaaggcattgcttttcagtcccaacagttggtcatttcaatttcagtgaggcttttgtgatttgttagaatacaaagtttgttattttgtctgtgtttttgcatgtatgaatgacactttatactgttattttgctggttagtatgtgccttcatttacctattgtgagtaagaaacttcctcagatcaaattatagtaaagtcacttggttctgtttctctgactcttaagagattgagatcactttatactcaaactcagggtgtttggtaaaggacctacccttctgagcatttatagcctagatgaagtcctggtccaatcaccaagttaaacttttaagaacatgctattcttaatgttcaggaattcaaccctggaagccttctctaaatcttaatgagatttttatg

SEQ ID NO: 81108 - DNA, 1272 bp, Homo sapiens
ggtgggggaagttctctgcacctggacaaagaaataagcaagagaacaaagactgtgaagattttcatttagatcatatttgggatctgccaggggtgagtatcatcattagaagggagaatattgctgctaaataaggaaaaacactgtacccggagaagaacttttatctgtcagttaagacaaataggctggactccaaataaatattttaatcagactttgaataaagatgtgtccagaatacgttgcaatagttaaaaatgtaaggaaggttccaaagtgtacaggtggcagtactgttggatgtttcaattaagctcttttaatgaattattttcaatgaaatgttcaccataaaatgtgcaggaccctggcctgaaactttggagaccagtagctcaatatggctatgccttggttttcctgtctgttagctctgattgcatgagtacaacctttatgttaggcaagctagttacatcactaagtcgggtttttctcacagtcgccacaaaagtaatgattattgccagatgaattcataagaattgcattttcagttccatttagtggtagtgctaaaaactctgagtagcttagtagtatccttcttggtatgagggcctggattgtttagagagaggaaagatggagaggcagtggcagatgcaagaaatatttcaaaagaaacagcagggccaaatgctttattagactatagggagtgaaagagaaccatgaatgacagttgattgagaacttgagtgtgagtgacagctgatgccatcattgggtatagagaagaaggagatgatgatcttgttctttacacatgttaaataaagtcacatgggtatcctgttcataggtggaggtgtgtgcttgaaactacagagcaaggaagttggttttgaagtgaaatcgtttgagtcttctctaagaaattgattcttttgacaccatgtgactgtaagaatagatgagctctttgagaagctaaaagagtggatggaattagtatagtggactgtggtgtagaagacaaagtgagtcaagaaaggagttccagaaacctgggttgcattttagccttaaacattttgttcctggtgtttcttaatttcacttatacatcaggattggaagtaaactttgggctggagctgggcaatttattcttttattcaggtgccttctttgtgccaagacctgttctggatgctggagatttagccatgaacaaaacagaaggtccctgctctcctggta

SEQ ID NO: 81109 - DNA, 1034 bp, Homo sapiens
ctccagaaacagtaaataaatcctccctcagactaacagctgaaaaggaaacaagagttttagacttctgatgaaggaggaggaaagggtctttggatgccccttatgtcaggccccaggcttagtctggaagagatctgtctaggccaggcctgaagctctgcaaggtacaaggaaataatagctgtcaagaattaggcgacgtggatgaatcccatacttgatatgccagagaaagtcacttcctctgtcctctcatcattttactacacccaagtgaatgtcccacactcagttctacatgtaggaatggactttatgggagaggtcaggactggtgacgaatttgatgagtcataggaatcattgtatgttaggagtggttgagcccagtcttccggaagagtgaggatattgaactacagagagagattgagggaagttgcctgcagtttcacagcaggttacgagaggtctgaacaggtagcagaatctgcaaataattagcttatctggtgtacaggaggcaggtccctaattggtttgaatttaatactcaaagtacatgcgcagagaagttatagtataagattcagaacaaatgggctaagtaagagaaaaaaatgtagcaattggaagatgaagaagagaggaatattcaaaaagatagcattgtgctcctttcttggtggagtgaacaggtgaggattatactgtctttatggattataggtacattggaaaatagtttacagttattatttgaaattcctctatagtgaaggaagtagtcaagataaaatgtgttttgtgacttttgatataggaaagtcagtaatagccatctcaataaagtatatgctcagctatttcatctttatacttagagattcctcaagaggatggttacacattagctctggatcagtgagagtaagaccaaggccctggaacagtaaggctttctcttgtaaagctcagttcccatggttctttgatgctttttctgtgttagaataatgttctttactggt

SEQ ID NO: 81110 - DNA, 1103 bp, Homo sapiens
gggcaccttgatctgcctgcagtgggtgaggcatagtatgtattagatcaggtaaaggaggcccttcatctgaggaaggggcccaggtttctacttagaaaagaaaggcattgtatttcatgctttactctctcgctctaatcatcagtgtgacagataaagggagcagcatggccgagtagtgagacaggtaggaagagtgagccttgaacatgtgttcatgaattctcaggggcttggtatacttgtagcaaagtgtttgaggagaggctctgtgagggagatgatgctggaggggtcagtgagggctaggtttgttgggggctttgtgtgctgtgtgttgaagggacatgctcaggcatagggctttatcaggagagtagcttgatcagattgtattttggagactctgtgcttcccagtgtgtggaggccagcttagaagcctggagtcccaacttaattgatgactttggagaaaaacaagagaactgaggataataaataaccaagaaagctaggtgaataactgtaagatataggtgagagcagaagtcagatcttcagattttaatgacagaatgtcaccttttcaatcagcaacaaagtagccgagtataatcttcaaccatctgctctctgggagaggagagaggagaggggaaggagcgaggaatgaggagccagagagattgattttagctaatcacttctaactctttcattaaatttttatggagaattaatacaggctgggcgcagtggctcgtgctggtaatcccagcactttgggaggctgaagtgggaggatagcttaagcccaggagttcaggaccagcctatgcgatgtggtgagaccctgtctttacaaaaaaaaaaaaaaaaaaaaaaaaaaaaaaaagaaaaaattagccaggcatggtggcgtgcatttatagtcccagctatttgggaggctgagacaggagggttgctcaagcctggaagatcgaagctgcagtgagccatggtcgcaccactgtactccagcctgggtgacagggcccaacaccctgtctccaaaaaaaaaaaaaaaaaaaaatccttacatgtctgcattttagc

SEQ ID NO: 81111 - DNA, 1063 bp, Homo sapiens
gaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatggtgagaatttatatgatctacaaacacactttaagtttgtgatatttctactttttttttaatggggctacttttctatggtcatcatattcaggtcttccacagaggctgcgtaaatcttagaattactgtaggaaagtggcctcaatggcatctcttctaggttcttcaattgagctgttaagcatgttgttgcagcgaaatgaccctagggattacccaaggagagtggcacgtcaccttcctgtgggtctggatttcagatttgatctctcaagtgtagaaagtgacatgctcttcatgaggagagtagcagagttactttttggtgtttaatgatcaaagacatggttttcattattgtattctgaagttctctaaagatagcctggaagtgaaggagaggaaagattgggcagtgagtgggaggagcatgagaacagggtgtgctctgagaaaccacacacttccttaaccaggttagtgtcactcttactgactttatctgttggccctccctatgagagttcactgaagaaaggactttttgtttgttttttgtttttttttgagaacgggctttcactcttgtagtccaggctggagtgcagtggcatgatctcggctcactgcagcctccacctcctgggttcaggtgattctgctgcctcagcctcccaaatagctgggattacaggcatgtaccaccatgcctagcaaatttttttttttttttaattagagacagggtttcaccgtgttagtcaggctggtctcgaa

SEQ ID NO: 81112 - DNA, 1054 bp, Homo sapiens
gcctcccaggttcacaccattctcctgcctcagcctcttgagtagctgggactacaggtgcccgccaccacgccaggctaattttttgtattttttggtagagacggggtttcaccatgttagccaggatggtctcgatctcctgatctcatgatcctcccgcctcggcctcccaaagtgctgggttacaggcatgagccactgtgcctggcctgtgtttgtgtattttttcagctgtcatcactgctgaaaagaaaataacaacatattttaaaactgctagtggtttttttttccccttggcagaagattaatatttattgatcccaagactagtagtggtaggacttgagctccaaaaggttttgttgcctctgaaaccttgtttttgttacaaggttacaggtctcatttttccacaactgcattttctcacagtggcctgttctccttcctttcacatgcagctgagaattcctgcatcatgtgggactttaggttttttaagaggtagtccagaatagtacaaagaatggtgattttggaatcataggtatagattcaaagagtactgtaagctgggcttgctggggggattgatggggtaggagagtagtccttgattattgtactgatctcagaacttagaacattttacttagagaatctgaccatttataaaagatacaaccctctagcaggctcatcatgcttgaatgcctactaggcacatcaacttttttgcagatctgagggaaggtgtgtgacaggtgtgtccagcatataagtaaatagaaagcaggatgtgagacattttctgccttccttctctgtgggtagaggctaagcctacagagatctttccaattaagtatggttaaacaggataaccagccaacatggggtctatggaataacattacagcataaagaaaagggaaaagtatcataagtattcagatggaagattttctgagtatgctttctgtaagaaacaaaaaaatgtagatgatatttcccatttgccctttaaagagctcaataaaatcaggtt

SEQ ID NO: 81113 - DNA, 1688 bp, Homo sapiens
attctgtcactttcagagtgactcactttactaagagggagcctttatttcaagttaaataaacgttttcctttctgcagttattagtggattgtcttagagttagtcttccttattgtgccaggagatgcatttcttcctctcattaaacaaataaataaagctggcagtgccagaaatttgatttgcccttattgtgtaggaataaaaagacccatgtgtactgaacaagcagaacctgtttttagtgtttaactagccaactcctgtctgggtgttcttttaaaaagtaattataccatttatgatacacccatttaagtcccaacagctattccctcttggacctcatgttgtggggctgcatttgcttctgttattattatttgagtaaaagaacgtgtgtatgggtcgcctttatatgcctgcctgtgaaattggttgaacaaacactgtgtattaagtcagaatatagaaatgtcctgattctcttttgcaggactgtgttcgattgaagattttgcttcctatactttctatgcttttgtagctttgttttgcctttacttgagggctgattctacctggccacaataaagctgttcacactgtatgttgtagcttaactttacaatcttaggcacttggaggcagtggtgtttacataacttgtctttatgtttgtttgttttttgtttttatattttcctcacttacgttcattttctcccccatttacagatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgagtaagtgctccttctgccttatttccctcctctcatccccagccccacccccgattcataggagtaccacccacttggcatctcattgtgtgtttgccgcaaattaaaacctcagctctgtatcttgccttctgctggaggtttgtaagcttgctcctgctaaccacttcattgtctgagagagaaacgtaagtcgtgttaaccattttctctctcgtctgcctgcctgccttcttcaattcttatctcttatattttactattttactcaaaagtcagaatgagccttgtctgtggaggtagcataacattaccaatgtatacagtttatcctggtttagtacaagaggaaacagatttcctatatcatatatttttttctggtatgtctttaagacttgaaagagttaattagaaaccagtacttccatattataattgcatacagaaaatattgtaaacaattaagttttggattgaatgtaatttctgtgaataaaatttgagagcagtggtttcttcatatgaacagcaataaaaagcaactgaattgtcctggaaatgtgcagtaggaaatcctgtctgtttttgggctcaattattatatgtcctgactctttaaagagttctctagaggaaggttgttagtcaaaacatttgaagagcgctcttttattcttgtataaataaagaaataaacacactagagcagccaaaagtttttattggaatgtttatataaagaagtttcaagaatagtttc

SEQ ID NO: 81114 - DNA, 1109 bp, Homo sapiens
ttccggctcactgcagcctccacctcccaggttcaagtgattctcctgccttagcctcccgagtatctgggattacaggtgcacgccaccacgcccggcttatttttgaatttttagtagagacggggtttcaccgtgtcggtcaggctggtctcgatttcgtgacctcgtgatccgcctgccttggcctcccaaagtgctgggattacagacgtgagccactgcacctggccatctctgttttataattgaggaaactgaggccagagaggtaaagtgacttgcccaaggtctcggttcacaaggttgcaaagtaacagaacctaaagtgcaccgatctgtccagattgaggggacacatgtgaatgttgaacacagacccagcctgacaagctctaggtactcagtcatgatttactgtagtgggcactattggcccctctcaaagggtttgtgcctgtaagctctcaagtccttcttacaagacacttgcgcttgaaacctaggtgtagggttaggtggtggagtgactactcaagaatacatatttcacaatggaaccaagtgctattgagcaagatgttctgccaacatagtaattttgcccttttagattcctcttcaggtacttgacaagtgggtcctcagtagcccatctggtgcaaaacaagtttggagactttgcttttgcatagtaaagcaaaagatgaaacaaatgtacagacataccttaaaaataataaccagagaggcaggatttgggataacttgacatctggccaaattcccattcatcagtctgtccatccctttgtatctgacttcctttgtcattgtgtgatctaggtctttgtgtcttggtaaagataaggttgtagaactgagtggaaactagagaatgggggaggagactaacatttattgaatattgaatacctgctttgtattatgcacagtactaccttggtgctttacttgcgttttcatttaaaacccctcagcaaacctcggggaggctaaagcagcttgtccaaggccgtatagttagtcgctcttttcacaacctgtctttaggttgtatttggatttattcatagaattttgtgagg

SEQ ID NO: 81115 - DNA, 1028 bp, Homo sapiens
gactcacaaagctctgtgaaatctgaacctggtgcaactcttgagacttcatttcataacatttttctcattcccatagctctgtctgcacagctacactggctgtaacctccctggccagctcattgccacctcaggatctttgtacttgctgtacacattgcctgatgttcttgttccctaactctgcatgctggctctttcataccactcaggtcagttgttaggtcacctcctcagaaagctcttcagaagaagccgccatttccagtcgaagacattttctaccataagcacctgttttattttccttaagtgaagatttggatttgcgttttagaatacatacagagtaaataaaaattctctacacaattttgctgtaaacgtcttctgggatttttgtgtatacacttccttttagagaatatgtgcatttgaagtggttttgttgtttaaggtgtgagtgttcagtcgaatacctcttagtgccattttaaaatgtgatctaaagaaacattttgcttttatcttttctttctgctcattaatccacataaattactacactaaattgatttagaataaacagattgcttggaattaattttaaaatttattttttagccctcatttcagcccttagctctgtgaagccttggttgatttgcctaaacgctatctatctgcagaaccttggccttgttacttggaagattaaataagatatttatgatgaaaatgctctgaaaaactgaatacagctttttacaatcgttttatatttattatgtactgtgatttgttcctgatatttcacatttgattcagggaaatcatttcaacaaattatagagcttcttttgttgtcgtttttgttaggtgtggttttttttgtgttttgttgtttgttttgagataaggtctcattctgttgcccaggttggagtgcagtggcccagtcatggctcactgtagcctcgacatcctacctcaacttccgcagtagctgagactacaggcacgca

SEQ ID NO: 81116 - DNA, 1032 bp, Homo sapiens
tcttttagattcgcttatcatgtgaccttagaagagctagaatagaagtgagttctgtccaacagaatttttgctcagaggtgtcagtgacatcttctcctacaggcagttttttaaaagtgtatttcatttcctcctagaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgctgccagttccctggatggtaacaaacctgctgagtcttcacttgcatttagtaatgaagaaacctccactgaaaaaacagcagaaacggaaacttcacgaagtcgtgaggagagtgctgatgctccagtagatcaga

SEQ ID NO: 81117 - DNA, 1747 bp, Homo sapiens
gcttaatccttttctctagtaccatagaaaacagtgccaaaaagctgtgttttatctacaagcctgaaactcccttcctcccctatcatcctagtctgtattctgagcaaatttagagtcagagtggtttcatgaacagctgtaagtattgttctgagctgacttcccaacatccaaaatggtggtattaggtcattggtggttttttgtttgtttgtttttgttttttttgggctaggggtgttgttgacggggaactccttccttttcctgcttggggagtggacctctagttccattgcctgttgcttttgggcagcagtctgagaattcaagaccctgcacagtgcaggggataggatgcaggatttccgcccaagcccagtctgctgagctgctgtcacagggcagaccttgtgtctgctttatcttggtgaagcagctgcactgagcagattgctcacacagcagcctgttccatctgtgggtaaccatgttccgaggcagcaaagagaaaccgctattgctccgtggaaataaactatctgaataaaacttcttaacgggggttgaggctgaagctgaaacgggagtcggacacgatcttggctcctgaagtctttaaaggtcagtttgatgcacacttctataccaccacctgttaccagctgtagacagaagacctatctccatgcttgcccctaggcttttgtaggtaagaagcagcctgttttgtctttattgtttatttttgctgttcttttcaatttttgaaaatccctttacacatatgtattaagaatgtgggggagggttatggagagaaatgaatcaatggagcaaaagaagttgctttggaagaagcgcaatttaaatacagtggttattttccctggtaaagggcttttagccgtttataatctttttcctccccagttgagggatttaaggaatccgaggtagaatttttgatgactttagctttttagttttattaatgttttggattgttagtgatagatacttgctggctgttgtctcaggatttaaatgaggtctctaatttttaaaaaaagccacaacaacaagtctattttgggggccctggcaggttggcatttcagaagaatgggagtggctgtaagctgatgcctggtgatgttcttttcatttcggtgctgcgtccttggccacatgggccggaattatttctctttctggctcagtggtcagaatttgactcaagcaagtgtgaactctgtggggattgtgtctgtagtatcctatgagaaaaagtaaaaaccagggagaatttcagactttgatttttattagcacatatagtaaagatggtgagaaatgacggatgtttaggattttgaggttttgagaaggaagaaaaatgtatggactttcagcagtatatatgggcttgaggttggtaaattttgtgtaggtgagttacttgtcctgttaccaaaaggagtcatactcatggtctcaaactgcagaggaactctgtattgatggtctcagactacagagaaagtagccagtcatgaagaaattggtactttcttcagaaaatggccaggattgggaaaatccctggtcacattactttagagaaaaagcacctgagtgtgatctcagagccaaagggtattttctatcaagtttacattctactcatagatttaatcatactgttttgtgagtgagaagacataggtttaactgctgattt

SEQ ID NO: 81118 - DNA, 1046 bp, Homo sapiens
acaactttattatggacactgaaatttgaatttcatgtgatggtcatgtgtcgtgaaatattattgttttgaattatgtttccagccattaaaaaaatgtaaaatctcagccgggcacagcggctcatgcctgtaattctgccactttgggaggctgaggcaggcggatcacttgaggtcaggagttcgtgaccagcctggctaacatggggaaaccttgtctccactaaaaaaaaaaaaaaaaatacaagagttagccagaaattgcttgacccgggaggttgcagtgagccgagatcgcaccactgcactccagcctgggcgacagagtaacactctgtcttgaaaaaaaaaaaaaaaaagcctactcttaattttttttcatgggctgtaaaaaagagttaatatcccactggcaatagcatgtgagcccctgcctaataaatacttgtgcaccagtggaagaaaagaaaaaagaagcaagcagatttcttaaattgttttgtggtgaaacctctggtttttaaactacaggttgggagtgggatcaagttctgtctttcctgaatagctttttgacagcctctctagggctcagtttccttgtctctaatcattctctagctttaaccttctagagtctgttttcatgctgaaaagggttagagtctatgattatatttgagggaggagtggcatttgtgtaatatttaacctgatctttctgccacataccccgtctatgtgtgtgccttgggaataggccagtcattgcttcattgaatcattgaatcatcctctccaaatgtaaaatagaacaaattcctgtatcttatgctttgctaccggcttcaaaaccagtagtatggtaaatttatggcagttttctaataaatgtaaataatccatttaaattcttatggaagttttgtaacattctctaaacgtgtaatggtcagagcataagaacctctgtcgagtggcactaccaaggatttaaagaaaaaagctacagctgagttcttgttttctttagtcctttagtc

SEQ ID NO: 81119 - DNA, 1348 bp, Homo sapiens
gctccagagttcatgcttttaaccacgatgctagcttaatagagtcactaagctactcatttgtcccttcatttcctttgatgtttcctgtatgagacatctctgctagtatgtatttaagtaaaggagcattctccactctttaaacatatttttgtgataacccttccaaagcaaatgttcacagtgtaatctaaggtaaacagttacattgtactttcttaaaaatttccagaacattaaaatatgtgttctagttaagtaaaattctcaaaatacaagctccagataatagtctctgaatgaacagaagcaagtttattgctttgaatatgagtgaatgccaaaattaacctggcagtagtgttgacaaataggctttttcatgaagaacttctttcttttcccctttgctttgtttttttggacaattgataaaaagagcaagttgtacctctgcattttttggagcgcatgactgtacaatggtgtatatttgcctggagggatgagggaagtcttccatgggaagctgagtcattttttggcttgtctgactgtgtgactgtgctagagctattctttttttgaagagaaaaataagaagtcaagtaatttcctaaagtaatacatttttattttatgtgggattcatattttccttgggttgtggttattttgagcaggagtttttgtgtctggccaggagtattcttctaatacagaaactacttcagacaaaattattttctctccttgtttaataactaaatttggtcagccattggaagtcttagggttgtgattgtggtggtaaacgaagacattattagttattcatctcaccttggatgtatcataccatttttggcactctggagaaatttaagaaatggctgttgcctttaaggcaattattatttgcttagaatcagaccaacatgcagtagcaatgaacaacacagggcaggacaccatagagtcagcaaggcagagtctaagccccatagtggttcaaaggagagcgttttaaggagggttagagtaggcagagagagctgaattgggaaagtagaattaaaggatggactttgactaaggtggataggcgagagagggaattccagaaaccatgattgttctgagagccgggggccttgaagtaggaagaaccatattctgattgtggaaccttgatacacaattaggctttatcttgaagaacaatagaaaatgagattggttaagggtcatggagtagtctgaaatccagacaagggagattagactggatgaagctaaagacttttgtactgcctttctgaatgacagcctaagtcatatcact

SEQ ID NO: 81120 - DNA, 1005 bp, Homo sapiens
ttctcctttacccttttactgtcttgtaatcttcaaatctgtatgttagtgaatgctaggagggaacagtagacctgcttctcctggagccatagtacaaggaaagcctaattggagacgatcctttgcagccattgtaaagtattttcttctttcacctctcaaatattcatttgtcttatttgaagcagtctattatctaagcagacaggagttgctcaagtggaggctaaatgttttatctgtattctaatacattttaccaccaacatatgtgtaactctggatggatcactatatttaagtttagattaatgaaaattgttgactgtggtaaacttttccttccttcccatttcatgtgaagaacaaaggtagaaagtgtcattatgcaggaataatgttttctgcaagttttaagagaatgtctcaattcctttttctttctcctctgaaactaccgtatcccatgaactatatggcatgtgataacttcctagtctcagactggcagtatataatattagagcaagaaggatcttcagatatgacctagcgttgaatctctaatttttccattctggaaatcttggtccagagggtcaaactagtatctcccaagttgctcagtgagataatggcacacctaggaagacaaagaacccttgattttcacttagtaccttgtgttctctgcagagagtaaaattgatcattgatgagtcattaaccagtgtccattcacatgctgctactttatgttcactttggggtttcaggaaaaaatacatagtagcagaagatgagccctacccctatccccacacccccacaaaaatattcactggcctttggtgttctgtttgggtcttcagcatcccccactaggtggtgtcctaattcagaaactttgctgtgagactccagatgggcttctgccctaactggaactaaagcagccacagtgttgacccataagaatgcttaaacaatttggtaaggtgc

SEQ ID NO: 81121 - DNA, 1043 bp, Homo sapiens
cctagctaaggactactctggacaactcaaggaaaatgtcagcagctcctagaaagagaaatccttttttttttttaatccctttttcttttgtttcttcactcctttctgctttttgcttccctcagttcctcatccttttccctcccaaatcattcatgatccaagtaagagaatgtctcaggtgagagaatgcattctgaagtaagtctgtccctgagaatgttagatagagtggggggctagaagggtctggaatagtaagaaaacaggcaaatgaagtagcagacccacaattcaagacccagttagtgtgcatagaaacactgaagaagtcccagccaggcagctatacttagtcgcaacaaatattaacatacacagaactcctttgttccactccttttctttttcattttctttaaatcaactccatcatcccttctccctccccaaaaataaagcttaactcttgataatttttaaactttatcagacacatttatagccacgtctcgatcctagagacataactgcaatatttggctgacatttttctcgtgttaaatcattgctttgcatttggcagggaggtatagtgtatgctttgggtagtttcaattttctgtacctcacgacaagtccattgtacacgcttgtggtgtttagtataacaccccccttcctttattagcatactactctgacatcaaagaactgagctgcatcttgcaatgcctgacagagcctttttcataggggtgggaggaggaggaggaggaagaagaagcgggttggaaaaggaagccttgtttttctcttcgtctcggtagatgaatcatgttcccacaactgcaattgggttttcaaacctccaaggctgcgggtgcggagctgaaagggcaagcagtgacgttcttgagagagaaggaaaaagggaggaggaggctggctagggagggaaggagggagggagggagtacagcaggagtggtcttttatttttttcccttttactctgctgtccttagagattttcaact

SEQ ID NO: 81122 - DNA, 1052 bp, Homo sapiens
atgctgtgtcacagctgagaaatctaaacctgaagaaatctgaatttttatacagtggacagtaagcctgtgtgacctttgcccttgactgagacattatctttataatactggacagaaacaaacctgccctttgcttcggaaggaaacagtatttttatcttctaagggtgtttgatatacaaacagtcttgaaaagatagtctagaataaaaggaccatcagggcttttgctgataaaacctgcagaaatgcaagagggacatggagaattgttttccaacatgattatgttctcatcactgttattatgttctcatcactgttactcagaaattagcatatttacttaaagatatgtaactttaattttgttctagtagtatgtgtttattgtatataattttgtaaaatatgaaactcactttatgtaacacatgtacctaaaatgacaggaaaagtatagagagtcttagttgcttgcatattcaaggcaaataatgttcactttactcattggctgtggaatgacatgtggtattgagaaggtaatgaaaagtattctaagaaataaaatttttttttttttgaggcggaatcttgctctgtcgctaggctggagtgctgtggcgtgatcttggctcactgcaacctctgactccatggttcaagcgattctcctgtctcagcctcccaagtagctgggactacaggcatgtgccaccacgcccagataatttttgtattttttcagtagagacagggtttcactatgttggccaggatgatctcgaactcctaaccttgtgatccgcctgcctcggcctcccaaagtgctgggattacaggcatgtgccaccgcgcccggcagaaatagaattttaatagggttttctaaactgttggccccttgttgaaggtcaaggtaagagacagtaatatggtaattcgtagtagttcatttccacattctttacttatcactaaagaatcatctgagctcttttatttctgtaaactaaacttgttgctgtattcatgcagcctcttct

SEQ ID NO: 81123 - DNA, 1666 bp, Homo sapiens
ttggaattatctggctgaacaagctttaaaaatatactgatgcctgggtcctacctccagatattctgatttaattgggtggggtgtggcctagatatcaaaatctttataagctcctttgattaccctgctgtgtacccaaggttgagaaccattacactttggacacatggtcaggaattaagtctttccttaagtacctttgagttattcctaacaacacttgagggtacgatgctcttaagaccttgcttgttaatgacacagcacatagcttgtgattagttaggattcccaacttttaaaccaggtccagcctctaactctgtgtgatgtaaagtatgttccctaatgtctgtgtgctccgttgtctccctcccatctgtaaagtgttagtagcctgtctcattttgagggtgtagtacagatgacatgatgagtaatccctgtgcctgttctacgactgctaagtgaatactagtaatttgcattctgagtttttttagtctgttttacccagcaagcctctgtttgccttcccaatttttactgcccagctttaaaaattacctagtcttcatttgcaggtctttttagaaatagtttacatgtagataccctccagtagtattaaatttaaaaacaaatggttttgaatcctctaactccagagcagtttcctactgattgtcaactctctaactttactacaaaggaaatattgaaaacaaatatgagaagtgtttttctctatttttgtctcattttttgagagtagttaaggatattatgctatagttgtgttcagggtccaagttttacaagattggccctgttcacagatttagctgacacttcccccatgtagcctcctagaaccttctacttaaacgtgtaccacttactactgtgttttgggtccttaaactgtttggggctttttctaaaagtgtaattaaaaccacccaagagtgagactttctgccaagtaaaggttaaatgaggttggtcacagtttgaatattcataggaaggaaagatctccacacatcatagtttaatttctatatttagagaaataatttttgaacccctggatgttttccccaggacacaattttgaattctgtagacctactgtacaccctaaccccaagcataagcaatttagtctttttagagtaattattgtaaaatctcgatttaacagaattgcagatcagaattatgctactgagcttcagacctgagattttgattttaggcatagtgtttttgtgaatcccaggtactttgttttgcaggtttctgtattttactttatacacacttcctcaagagagcaatagcattagaccaaataagatattgtcttttggccgggcgaggtggctcacgcctgtaatcccaacacttggggaggccgaggcgggcagatcacgagatcaggagttcaagaccagcctggccagtatggtgaaactcccatctctactaaaaatacaaaaattagccgggtgtggtggcacgcctctgtagtcccagatactcgggagactgaggcagaagaatcacttgaacctgggaggcggaggttgcagtgagccaagatcatgccactgcactccagcctgggcgacggagcaagactccatctcaaataaat

SEQ ID NO: 81124 - DNA, 1147 bp, Homo sapiens
ggagcttgcagtgagccgagattgtgccactgcactccagcctgggcgacagagcgagactccatctcaaaaaaacaaaaaacaaaacaaaaaaaactccacatttagaagatctgcctttctctttacttaggaaaagagaaatcaatagttttatgttattttattttttttttaataatatcagaatttaggtaatttccactgcgactttcgaggttttaattgtaaggaattctgttccccgcaaggggaataccattctgaagatatgtgtcgctaaaaacatactgagataaacagattagatagtatctctaagttccagctttaaaatgggatcattgataatcattgaaactaggtcatggatatacagagatttgttaaacatttatatatgtttgaaaattttaacgtaaaaagttttttaaaaatggaagtgtctttgttaagaaatacttccttgcaacctcctaggtgcatgacagcttgtgcctggatgttaccatctctgcagactcagagttacttctggtcacttaattgaatggttttcttagctaaggagaattagaattttctatatttcgccgtcttattttcccagaaccatttacaaaattgctcatataaatggcctgtgctagatttggaagattttttttttcaagaatattagacatataatttttaaaagttgaaggaggccaggcgtggtggatcttagcattttgggaggctaaggcaggaggatcacttgagtcaaggagtttgagatcagcctgggccaatataatgggaccttgtctctacaaaaaataccaaaattagccagacatggtggtgcacacctgtggtcccagctattcaggaggctgaggtgggaagatcacttaagtgtaggaggttaacgctgcagtgagccgtgatggcaccactgcactccagcctgggcgacagagcaagaccctgtctcaaaaataaataaataaataacacctacattttatactagactgcttagggaaaaccagaaatggtagcttcactttcacctcctcatgcatgcttgagaatgtctgcatggcctgagaagagatggggaggatttttctcttagtgtttttgctgtaccaaagtagcc

SEQ ID NO: 81125 - DNA, 1138 bp, Homo sapiens
cataatttcaccactgcaccccagcctgggtgacagagtgagaccctgtctcaaattggaaaaaaaagaaaagaaagaaaaaatgatgtacttctagtgtagtacctctagtaagaggataaaaagaggatagacctaggccaggcgcagtggctcacgcctgtaatcccaccattttgggaggctgaggtgggtcgatcatttgaagttaggcgttacagaccagcctggccagcatggtgaaaccctgtctgtactaaaaatacaaaaattagccaggcgtagtggtgcatgcctgtaatcccagctacttgggaggccgaggcaggataatctcttgaatccaggaggcggaggttgtggtgagctaagatggagccactgtactccagcctgggcgacagagtgagactgtctcaaaaacaaacaaaaaaaagaggatagatctagactgtttctcttctagagtccaggggggatttgaatccaattgtgatcatcctattaaaaaaacaagtctctgaggccaattatgatcttacctgcctggaatccactgagaagccattggcttgatctagaataactgaggctatctgattggccctgctggcttcaaccatatgtgctttctctccattacagccagaggaagagcatttggcctgtgatatcaccggatccagttcatccaccgatgacacggcttcactggaccgacattcttctcatggcagtgatgtgtctctctcccagattttaaagccaaacaggtcaagagatcggcaaagccttgatggattctacagccatgggatgggagctgagggtcgagaaagtgagagtgagcctgctgacccaggcgacgtggaggaggaggagatggacagtatcactgaagtgcctgcaaactgctctgtcctaaggagctccatgcgctctctttctcccttccggaggcacagctgggggcctgggaaaaatgcagccagcgatgcagaaatgaaccaccggaggtgagatgggaggcggtttgtttagtgtctcagtgtctgcttgcttttgagaagcttctgatttgtattattgttggtaaaagaatttaggagaccccatagtatagaagaaagaatatagg

SEQ ID NO: 81126 - DNA, 1052 bp, Homo sapiens
aggaggctgaggcgggagaatcgcttgaacctgggaggcagaggttgcaatgagccgagatcatgccactgcactccagcctgggcgacacagtgagactctgtctcaaaaataaaaataggctgggtgcggtgactcacgcctgtaatcccaacactttgggaggccgaggcaggcggatcacaaggtcaggagttcgagacctgcctgaccaacatggtgataccccatctctactaaaaatacaaaatttagctgcgcgtggtggcgcgcacctgtaatcccagctactcaggagtctgaggcaggagaattgttggaacctggaggcagaggttgcagtaagtaaaccaagattatgcctctgcacatcagctgggtgacagagtgagactctgtctaaaaaaaaataataataaataaagtaaaatcagaatactattactgatattctactatatctgtatgaagaaatatttagattttcaaagaacaagtattgtatgtagtttgatatttccagtgaaattatttttaagtgattatgcatccagcagatatttattaagtacttactaagtttgaaacattgttagatgctatgagggatacagaaccactgtaaagaatggatactctaatgatccccattttacagatgagaaaactaagcctcagaaaagctaagtaacttctctgaaactgagcagctgttaagtagcaggagcagactttaacctaagtctgtctgaccacaaggcctgtgctctcacccgcttcttcactgccttattttactatgtgggtctaattataaggttttatgcttatctagaaatatgagagtatatgcttacaacgtgttcttcacttttttacttcacagatatgtcacagatctaagcagcagggatttaattactgtacatcagccatttcctctccattgacaaaatccatctcattaatgacaatcagccatcctggattggacagtgagtatactactttttaaaaaaattaaatatattaaatcttaaccactcttccta

SEQ ID NO: 81127 - DNA, 1027 bp, Homo sapiens
tttacctctaatttagtgtatatttcctaaaaacaaagatattgtcttatattaccatagtatatgggtaccatatactggccttctctggctactgagtgctagcattagtatataagagtaccttatactcttatatactgtggtagtactgtattacagtagtctaattatccaaatcaggaaattaatatcgataaaattgtgttatctagtatgtacaccttattcagatttcaaattttctcacttatttctgggtccaagattcaatctaagaatatacattgaattaagttgtcatatctctttagtccactttaatctaaaaagttcctcagttgatctctgtcttccataaacttgtcagtggagaaacctcgcacagtaactgacctgagcttttcaacaatgtcaagctcaagaaggacaaagcaagactgagacagagatttagttcagtgagggccagtaggattgcatctgaaaggggttagtggacctgtatgcggattcagatcaactggtgttggaagttatgtagagatgtcatggcatccataagcgcagggccttgtgatgctcaaaaacatacttggattggatcagtgttgtttgtcacaaaaaaggcaacttgttctttgagaagcctcattttttattttttaaatgttgatttttttatgagtagttgctgtgtgggatctggatataaagattaaattctcatcagagagggagtgagtgatacattatgttctttgctgaaagaccatgtgtctcggaggctgaagcaaaggaaataaacacactctcctggtgtttatggggtttcctcattgttccctgatataattcagtttaagagttggtgacagaagcagatgccctatattcatgggatgttccatctcacttcatgacttactggaatcctaatttttaaaattttcacagtggaattaagacataatggatgactctagccagacatgctgacacatgcctgtagtccagctgcttcaga

SEQ ID NO: 81128 - DNA, 1336 bp, Homo sapiens
ttcataataggtaggtacagggctttttctctcatttcatttaggacattgagattccagaaagtctgataaagggaagttcatttattaatgtgtctatccagtaaatatttgagtacctactcttttccgtacaccaggctagaccatggtaggaggggggtgaactcacaggtagggttcctttcctcaccacatttacagatgagagcaagtgaatctaatagaaaatggtaaatgcagcaacttaaacatctgatgttataggactgacagacctaaggggtcagaaggctgactaaggaaaagtaatattaaagtttggaccagaaggaaactgggaattagctgggtgaattagtatgtggaaagcaagactgaggaatttgggcctcttgcctgagggaattggaatcatttacattgattaagttggtcgaataatgattagaacacttcaggctgaccatagtgagaatgtattgggaggagagattggatcagtagaaggctttttttttttgagaaggagtctcactccatcgcccgggctggaatgtagtggcgctatctcggctcactgcaacctctgcctcccgggttcaagcacttctcctgcctcagcctcctgagtagctgggattacaggtgcccaccactatgcccagctaattttttgtatttttagtggagacggggtttcaccgtgttggccaggctagtctcaaactcctgacctcatgatttgcccacctcggcctcccaaagtgctgggattacaggcgtgagccaccacgcccagccagtagaaggcttttgcaggattcaagttacagtagtagacaatgtcctaaaccaaggcagagagcagtggcaataggggaggaatagaggttgagctggaagacaaagtgaagaagcctgagtgaagtgtgatataaggattcaggaatggtgcccaggtttccattttgattaatgagttagatgttggtaccactcactaaatgaaggaacacaggaggaggaacaggtctgcaggaaaagataagttcacttacctgcttttggagctttagctgcctgtggaacatccacccacaggtgagcagggagaggaatgagcctagatctaaacagagatccggcttccagattagaaagatgtgagtcaccagtgtgttgtatgcagatcgttgttaagaggtggagtgaattaggagatttggggtgagggagaagagagccagatataaaatcctgaggaacatcactactagatgtttttagtatacttttaaggaagagaaccccaggtatgaattgtgatcattct

SEQ ID NO: 81129 - DNA, 1052 bp, Homo sapiens
aagaatactgctttaccagtattctacgtatttacatattggcagccaggcttaaaatagagccttaccttttttacttaccactgccggcttggatactagttggtatcaacaaaagaaaatccccttggacagagcaatataaattagccaagtattattaaatgctttgtatagtcttagcattccactaggtgttaacaggcacctaagagaactaaagctcatagtcctgaccttgaaaaactttatgatctagtttggatgaattcaaaatgttttcattgttttttattttgctttaaaactactgaatcttgtcttcaaacaagcttttcgtggaagaccaataaataagtggagattccccctttctagccatctccccaatgtcatggagttttaggacagagcagtgaatgtaccactcatctcatggataaggtaaaacatacacatgataggaaaaaaaacaacgtaagatggaatttagaaactggaccctgacctttaaaaaagtctcagccctcagcctagcctccttattttacaaactgaggcacagagatgtatgcttcatgtcacacaacctcacacaacctcacacaacctcctgttatctgacttccaggaagtagtactcatcattttgtgtttaaacaaaatgttactatacagcgtaatttttttcttttaacttttttaatctgaaaggactggagtttgctaggaggagatgagcagaaaggacaggagaaaacatattttgtgttagaccgaaatctgtgatcactggtagaaacttttagtatcagttgacctcttgtctctgatcatctcctttgtcaaaatgacaacacttttttgcaattgagattggttcctctttcagacttggcttcaagatttgatctcttggggtcgtgctgtctttagcagtggaaactcaaaaaattacaaatttgtaaccctgaattgtagtccatttcccattaccaagtgtttagagtgccctagtggcaactgtaagtcaccttttatagtgaggtgtt

SEQ ID NO: 81130 - DNA, 1004 bp, Homo sapiens
agattcataggaccaaagcatggggaggtaagagcctgacttctttaaagcactaaattctagtaaacacagaaagagccagtggagttggttgttttgttttgtttccatcctgggaagaactaatttggattgttgcaaagggaagctatttcttatttattcaggtttgaagagcattgcaaggcttgagaggataagctggttgccataaaaagattttttaaacgattgaagtataatttaactttcctgagcaaaaaaatcagatgcttttccatttaacattttatgcatggaaaaacctttagcaaaatttagttaaaagaaagaaattatttgaaaaaacccaaatttagttgttgattattactaaagttttatgtactttagtgattaccaattttcactcagaacagcttcctgttttgtaaagtgaaggagtttttctcccttcctctctcattattttttatagttcaaaagtgtagtaatttggctcttagatgttcattatatgtatttgattaacaaaagacttcacatgaatcatagatctagcaattatttaccatttcattacagtggttgggttctgaacagaaagtcagaagacctgggttcccattttgactgtgctgatcatctgttgtgtgaccttttgcaagtcaaccaacctctccagtccctggcagcatagtgcagtgtatgagagctgagctttacagtcagccagatctgaatcttaatttcagcttgagcagttattggcgtgtggcctcaaatgcattattaaacatctctaagcttcaatctcttcagatgtaaaatggagataatacctagtattatcattgggttgttgtgagaaaatacatgtaaattgcttactacagtgcttagcacgtagtaactgttcagatttttagctgttatttattatctttatcctctacgttgtaaaatgggaagcataatgctcaccctgcccacttcagagttat

SEQ ID NO: 81131 - DNA, 1368 bp, Homo sapiens
tcctgagggaactcagagcagtaaagagcatgccccctcatttggggtcaagatatgcggcctcagggtatgtagtgggagctgggactgagacccctgtataagaaatgctgttttaagactaacatccatgatgaagggccttggaaaattctacccagtggccttcagaagcagaaaggaaccttacagtctccccaggtccctgagtgagaattgatgaatctggagtccaagtttacaccgtctgtatgtgctagaacttcaggctaagaaactttcacaagaggttacatgaaattccagtttaggaatgacagatccttgagggacccagcctgtagcagatgtagaactgctccattgggttaggttgacaaatcagtatacccaaggctacggcaggaggaataaaatcctatgaagccgagctcatgataaaagatacatagatgccacataaggaagtaaaccaccatgaggaagaattaggggatgtacaagcaagagatgttgaaaatcactaaaaggggccgggcgcagtggctcacgcctgtaatcccagcactttgggaggctgaggtgggtggatcacaaggtcaggagttcaagaccagcctgaccaacatggtgaaaccccgtctctactaaaaatacaaaaattagccaggcttggtggcgtgcgcctgtaatcccagctattcagtaggctgaggcaggagaatctcttgaacccgggaggcggaggttgcagtgagctgaggtcgcgccactgcactccagtctgggtgacatagcgagactccatctcaaaaaaagaaagaaaattactaaaaggatgaaacgaatagaatctataatggaagaaaaagacgtaacaactaatgggtagatttaaaaacaactgagtaaaatttaaagcatggaaatagtcattgaaaggtattcatggattttttcaaatatttcagcatattgtcctgatttataattgtttataaaggaataagatggcttctactctgttgtctgcattagtaaggggagagcttcagtctagaaagtcttaatgacttcacactggatttgttttttacatttaatcataaataattgtacccttaagtccttgatcttatatgaagtcaatcaacaaagttcatttgactgaattctgcaagctactgtgtttgatatgtgattcatacaaaagcagtttgtcaacaaatatttattgaatatcaatatgagtcaggcacccacagtggcttaaaaaaaggaattctaaaatgatccttcgtacttatttattgtgaacttgtttatattctggaaaaattgaaagcaatttaaatatccatccataaa

SEQ ID NO: 81132 - DNA, 2169 bp, Homo sapiens
gtctgtctaacttatcaaggtcagatatttaagattgtctcatgaaaaactcctagtgaatctcattgttttattactctgtttatgacaaatagaagttagaatacattttgcattttccgtgtgcacagtacataaagtttctttaattttttgttgtttttcaaatctgtataacagctttattgagatttaatccatatgccatatagtctacccatttaaagttgaacctcttgagtaactgccagactgctttccaaagctgctgcaccatttcattcttttgggagaatttatgaggaagcgctcttgacttttacaactagactggaaacattttacaaaatggtattatgagtttggcgccccatggcataacttctgttctcttttctctgcagttttcaggtgagaatgcagaacgtttaaagaagacatatggcaagttttgtgggcaacataaccagtctgtaaactacttcaaagacctttatgccaaggataagcgttttcaagcctttgtaaaggtattgataagaaacatgaaaatccccgttattgttgagagccatgtgtccctgtcggctttcactagagcctttttcatgtgattcctcacagtctgtttactcccttgcagaagaagatgagcagttcagttgttagaaggcttggaattccagagtgcatattgcttgtaactcagcggattaccaagtacccagttttattccaaagaatattgcagtgtaccaaaggtaagtctcctttctaactcggtcttgtatggtcatggactgtttcctctgtggccagtagtactggaagccccatggaagtgctatttcatgctttagtatgtctaaaagagaccttgtgttttatcttgaattttgttgaatgaaaatttggactgttatgttaccagacttaggatagatgatagcaagaaggaaagggaacacattgattccatccagagttcaatgacctgaacagtattctgttatcactaggctgggagataatttccactagttattcccagaagtgctagaattgctgctgtttttcacttaatcagtaattactggtttctctctcttggctaattctgttcctaggtagttattttaaagattacaaggcagtacattaaaaattaagtaaaacaaataaaaaaaaaaaaacttggttgctcttcctgctattactgtccctcctagaagtctttagttccttttatttcagagcacaacatatgattgcatattatttatatcattgaaaacttctgactttttttagaatcaaacttatgacagcaagaaggataggcacatgatctctgacgtgttggcttccctctgatagcatagtcacaaagggaaaagatgatatggagtgagaagtcaggattcccttgcttctgcccttgtccaaaaagagccataaaaaacagaattattctttccttccaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaaggtaaggcttggctcttttgtcttaagtatgtgcccaggtaaaacaggcaaaaatccaagtgcttttgttggaaattcactaccagatttttttcccagagagcccatctctaaacactacccaggagcaacaagcatttagttcttcgtaatcttatatcaaaaatggtttgtgatggcctgcaaaatcatacaaaatagaggaagaagacaaagaaatgatgcagtcagggaaaatggaaaataaggttttaaaaaaacaaagcaaagcgtaagattggtgcacatatgcaagctgtcaaggaaggtgtattcccctataagagatggacagccaggttggaattgggatctgtggcaaaactcacaaggagggagacacagtcagcgagtttcacagaatctgtgagttcaaaacacatcacttgttcacaag

SEQ ID NO: 81133 - DNA, 1070 bp, Homo sapiens
ttggttttaatttttacatttctaatagtcagccgtatcaagttaaagaagctatgaggcttgttttttaatttatgtgtacatttgattttttttgtttgttttcatcaaacctatactccatgggcctatatgttacaccaatagccttgaattatacccaccccgtcgccctggcctcagtgagctgaggacattgaagcagggtaggccagtactgtcagcctcactggcatagaaagaaggtggaggaaatgggtgctgctttcatttctgaggtataagtgatgatgtagataactgctataggaaatgcccacgcatagaacaaatggtaaagaagttccaggcagtcagctggtttcaacaatgaataaagcaggacaccctgcttagaagttgaaatcaaaatgaagagccttggaaagagatacctgctctacagtgtggtgagtgctggaatggaggagaaagcaagaggaatagcaatagagtcaagtcttgaaggatgacggcacataaggagaaagtgttccccacactaaggaagagaaagtggaagcacagagttgaaagggtgtggcacatccagggaagagtggacacccgggactctcacgtgagagagcagagtgaatgacaggggagtgacgggaaaccagcccaaagaaacgggaggggccaggttgtaatgaggtgcattctccagactgaggagttaacagttgatactattgatgagggaagggggcaaagaatgggttcaaaaacgagaacggcaagcaggagagggatacatgaggtggtttttcagtatgacaactaggggcagtttagagtgcagctggagtgaagagagactggtgacagataagagactgtgcagtgctttggggaagagctcatctgggcctgcattgtagcagaaggcataaaaaagaagggcagaaaagattcagagaaagaaatctcctttcccaccaccagctggctgtgtatttcatggttctgtgataaacttaaactaaggctccttccctccagtcttaatattccatgatgttctgaga

SEQ ID NO: 81134 - DNA, 1058 bp, Homo sapiens
tgctaaaaatctggtgaccagatctgaatcctggagaactgtaaaactgttgctttggaggagtgtgatctcagatcatagtttgcccgtataggggtgtatgtgttgctgaaacacccttcaataaaaaaccttctgactgtgggtaactattaagtagtcatcgttttatcttcccttctcccatttccattttccagaggttcaagcagttcttctcactgacattttagttttccttcaagaaaaagaccagaagtacatctttgcatcattggtaagctgaattgttatttttgtaatagtattataagcagctagtttagttatggaatgtaagcactatgttattgctctcccccgccctcttaaaattaaatggctcaggacaaattcctctgagtaatttcccacatgccctcagaattttctggcatcccctcttcccaaaaaattattattctgtttcatcacagtcttcttttagtgtcttggacatctgactatttgatctatgaagaaacctggtcactggagcatttctcacatttgagcccataaatggtgctcatgtataatattgctgactggattctttggggaacctggaaagattcatcgtgtggaaaacatgactggaacctttagagccataaattactatttcccttttgaaatctttttttgttaaaatctgaatgaaataaggagatacttctctttatcctaaagtagcccttgtttttcaaactatgtgcttttttaacagcatctggtcttaccttagattgaagctgtccttcagagttagaatattgtatatgtatcttttatttgccctcttccctttttccaggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgtaagttaaccaccaggccc

SEQ ID NO: 81135 - DNA, 1044 bp, Homo sapiens
tgctcttttctctttgccagtggcttatcgaatgtttcaaagtaaagactatgctttggatagaaataaggcttagagttaaataaatgtaagcacctaaggagtttggttaggccttaaagccatacagatgatagcattctgtctcactgagggggaaattaaaaatatggacagctttagaccagagccagagttatagcaaatttattggcccatgattaggatgacaaggataaaaatcttccttctttaaattttgtcaagtacctggctaggcatactgctaggtacaacagatgcaaagattccttaaaaagagcccttgcccttgagaagctcacaccctagcaggggagacatacatcaatgatgggccacacagtgatttattagaccacaggcacaattagcatgtgtgggatctgctcatcctgcctctagtaagtctcacagagaagctggtgcatgagctacatctgaaaaaaattatctcagcacacaagagtggttatgtgcaaaggtgaaaaaggacttgacatgtctgccaaggaatgacaggttcggtgtgtctggagggtcagggctaagggatgggatcttaagctggaaatgcaccaggtattaaaaggcaacaagggactcatgtaattaaaaaaaaaaatttttttttttaacatgttgaagatagttaggagagttgcttgagggaatgggaagccactggaagtacaaagaccatttggaagactgttaggataggttaagtgagaatgagctggagaaggaagagatgtaagaaataaggtcattaaaatctgatcagttggccaggctcggtggctcatgcctgtaatcccagcactttgggaggccacggcgggcggatcacaaggtcaggagttcgagaccagcctgaccaacatggtgaaaccccatctctactaaaaatacaaaaattagctgggcgtggtggcacgtgcctgtaatcccagctacttaggaggctgaggcaggagaatcgcttgaacccgggaggcagag

SEQ ID NO: 81136 - DNA, 1039 bp, Homo sapiens
accggaacaggcttctataatctctttgccttaaaataattatctgcatccctgtgtagagcaatcttaagcagctctccttgtttcttcagggaatgggaattcttttctaagtcgccccatcaaaggtactattggttttttacaacgccggcgtttgtgtatgtagtaaaagtattaacagcattaaaggcgatatttttaacatgtttatagatactacttgggggagggcagctaatgaaaccttcaagctctatgcagtccacagacgtgagctctgtagagttcgcagaggtgggtaagtacccagccagcacacccagttgaattcagccaggatttattgagttggcatcacggacgctgacagcctccaagtgaaaacccttctcttgaatatgtacaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtggtgagtcacgcacacctgctctccctgtggccatagtgtctgtgcattctgagagagggtagattttagtggcatggggcggggttgaaaaggggacagttcagatgctcaaaagccaaactgccatccttttcaccagctccgcttgctaagagcactcatgcagcgaacattaagaacccactctgtgtggcacgtgtgcagaagcagagagcatgggtttcattttcaaggcattatccgatcgaggaactggagctcacccctcaatgaagtaattcaagtcctccttgcct

SEQ ID NO: 81137 - DNA, 1040 bp, Homo sapiens
gaggttaaagaaaaagtacattttcctggcctcttcataaattctagtgattatttaaaagttaaagggagcattaggcagtgaaggatatcacttaagaaccttattaaccaaatttgttcagaaaccccggtgcgcagaagagttaattgcccataagccccagtcgcctgtttgcattacagaagactttgggatggggaggaagttcaatgaaaggagcagtttttctgaatttttttcattcttggttttcacatttccagatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgaatgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccgtgttttgcatgtatttctcatttcattttagggatgacaaacatttgtgaaaccagtgagagaaggcttgatgtgtataaaagacgtgatgtgcaccacctcgatctcggtgtt

SEQ ID NO: 81138 - DNA, 1024 bp, Homo sapiens
cttgacagtgctctagttgctggatctaatggcctgtcttggtttctatcacatgagaaggggttgtttttttggggtgactcggactgaattccccatactgtttccacgccgggacaccatgttctccatcaagctaaagaaatcacgtgcctgaaactgtgcttaagttttgggggaaagatggagttcctatccagagcccccagatttccagaatcgagtgagcttcctggaaggagactgcgtcttctctcaattccagtcatctcagtcgttgtcgttaggtgacatgtgcactttaaatgctctcatcggttggcttcattttcaagacaatcaaatgtattgactgtgttttcttcttagaaaatggagagggttaaaaacatgcaaactgccactttcaacctttgccagtattccctctacccccgtgagagctatctggggggaagaatccttaccaaggtttttttggaaaggtacgaatcttaacttttttccccttctgtgtctcagggtaatactattcagagtcgcccctttgctcattttctcccgtatttgttaccttcctgaggcctcagtattagtcgtgagcacaaagttttgagacctttggcgttgtttcttgatgtgggaggggaggtgttagtgcatgcaagggttgaactagatagaccctgccttagtagagggtgggactataaccttagaggccagaacttgatccagaagttgctgtccacagaagtgctttctatttcatcatttttgtttctagggctctttttctgtagccaggtcttcccaaggattttagtatttgcattggagttgaggtttactctaatgatggtggcccagctgtgcccagaggacagccaggcaggccctgggagggagtttagaaagacagtcctggtgaatgggcttcaagtggtcacaaagagggtggctgtgaggtgaccccagacactgcagaacgatgtgcaccctctgcgttttggatgtccttgga

SEQ ID NO: 81139 - DNA, 1079 bp, Homo sapiens
agattgataggccatgaattacttctccatctcactaagggttaaaggcgtgcaaccccccactggctgtgtcccctgccaccgaagtgagtgacctgccctacaaccaggtgggaccacctgtgctgcagtccggaggggcttctgcaggaagcactcaccccccacaccttccccggcctgagcttcccctacctttcgtcaccacctgagggcatgagcacaggccatggggcgtgcctggtgagtctgcctgtggttcaggcttagcctgtggtctcctgtgtgctgctgcccgcatgggatgcgcaggggaggcgtggggatccgcaggagggtggttgggatacaccggatacctctgctctcattgcttgtttgcaaatgctctatggacatttgtgtgctaaatcctattaaataaaaaagacgggttaaaacccagatgctgtatattcatttgtaattatgtataaagtgaagcagttttaaactgtaaagatttttttcagtgtgttttctcgaattttgccacaacatactggcttcgtattttatttatctttctttctagttaccagcttcagacccttgtaaagtctccctcagccctttcaaaaaataataaatttcctgtgaagttctggttggtgctgtgacttattcctattcctgattcctgtagaagggatactccccatccacccccatagctcttgaggagacgccttatgcaccgagcagctgctggggacgcatttcactctctcggagtgggacccaaacccagagagtgactgatcagccctaaagtcaaacaaacagtttatgccaagagccaaaacttcctatttccagataaatcaatacagtgaacaggaactttgctatagagcctgcgacttcccttaatgttagtttctctctcttcgctaacattctccaccccgtcccacccccaaactagagcaactgccagaaactaattcaagaagaaagatcctctctgcttgtagctcccggctgattcactgggtctgatcccggaatgtcggggctcccctggagacacacagggc

SEQ ID NO: 81140 - DNA, 1090 bp, Homo sapiens
gttggatggctcctcccacggggaagcagggctgagcaggccatgggagcgctgtgcctgctgccaccagctcaagggccacattcaccttaggtgtcactccccacccatctctgccaggaggagccttccaccatcagccgagtggtgaggagtaggatgcagggaaaggatggagacaaaaaagccttgcttacattttttgcctgttcccattgggcccccaaggagaggctgaccacagatccatctaggctgagcagaattaatttcctaattaagataaggagaagctgtgctcattcaaactccaggacaagctgccagccaggtttgctgttggccaggccaatttgtctgagaggagtgagggccaagagatggaggagctctttttctagaaaaccatggcgattccatccattgtccggagttcatgttctgcaccctagccagctgggcttgtgagaccttggcagcaagtcccttaacctgtgaacgcttttgttgttcacaggcttggaaatctgagggagaaaggtacccagctttgttcatgcaacaaacatttatttagttttctgaatggctcgccgtggactagaagctgaggaaagaaagtcaggttcaaagagctcctgcttgggagctcagcgtctgatgtgggaggcagacaggcgggtatggcacagcgctagggtctcaatagtgggcatgttgagaatctgcctcagtttcctcattgatgaggtgaggaagtggactgttggtttcctcatttcaaatgtgtccagggaatttttttcccccatctgttctctgccgggctctgggattcagtggagaacaaggcaaggtcctccccgaccctctcctgatcccacattcagctgagggaggcagacaacagactgacaaaaatatgcagctgcagaggaagtggacagggaggtgtgggaagatggtcaagtgaggatgccctccgaagaggggtcaaggaaggcctctctggggtggtgacatttgagccagccgtgggaggatcagagaaaggcctgccaggtgggtagcacagctcgtgcaaaggctg

SEQ ID NO: 81141 - DNA, 1068 bp, Homo sapiens
ccatatgacctaccaattccacttctaggtgcataatagagaattgaaaacgtgttcatgcaaaaacttgtacatgaatattcacagcaagattattcataatagctaaaaagcagaaacagtgtaaatgttcaccaacttaaaaatggactaagaatataatatatccatggaatattattgaaccataaaaaggaatagagtattggtacttgctacaacatggttaaagcttgcaaacagtatgtcaagtgaaagaagctagattcaaagtaactacatatttaatgattcaatttctatgatttgtccagaataagcaaatccataataccagcaagtagattagtggttgtttccaggggtcagaggcacacagggtgatgaataactgctaatggatatggtttattcatgtgtatgtgtgtatgtgtgtgtggtatagttttaaagggtgaattttatgttttgtgaattatatttccataaatgattctaagagaaaaaaaccctgcctggtatacactgccctattggaagagattcttgcacctgaccttgcatgagctccttgttcgattgtgagaattctcagaggagggggctggggccagcatgacagtgttgagggtctgagtactcaaggcaggggctatttactaactagtatggacatatgtcgacattttaacaaagagtgtgaatatacagctacctgtccactattagtccctacctgtgtctaaatcctcagacttccactcctggattaccccactgggggcaacagaaagtgtatatacacccctacacatttcttgaatatcaccatcatagcactaagaagtctgatacttgaatatcaccatcatagcattaagaagtctgataagtatcactatcatagcactaagaagtccaagccctgtactctcagatccctaagtctgtgggtcaggagctgattaaatcagcatttcaattaatattttggagtaggtccttatagaggatggtggaaatttgtctggttctatggaatcatattgcaatgtaatagaaatacct

SEQ ID NO: 81142 - DNA, 1043 bp, Homo sapiens
tgaggaggcttccatgaccttccagactcggtggctttaacaacagaaatctattctggagttcaagctcaaggtagtggtagggttggtttcttcgaatgcctctcttctgggctcttctcattgtatcttcacatggccttccctttgtgtctgtctagtcctaaactcctgttcttctaagaaggacaccagtgacattgggttagggcttgccctaatgacctcattttaacctagttatccccttaaagaccttttctccaaatccagttacattttgaggccctgggtgttataacattaacatataaattttagggggggtcacaatttagcttgtaacacctagtgtcctctttatcccccgaccatagctctgggtagaagcaggtctcactgcacacacgatgggtgttatggaaaatggtgcaaacttcccggcagcatgttccttgtcctgtgttgattgaggtgcctgggggtgcttgccagagagtttggagctgtgcacagagtggaatatgagtggagcatgtgcagagtgaagcatgcatggagaatatttatatgggcctggaataatgtgcattttgtttcaggtgtgtgcctataactaggggtttataggtgatagaggagcaacaatgaaatgaacatgtaggatgtgtgtactgcttaccaagtgaactcctggcttggggtacaaaatcattgtatgttctggactcttgtctcccagcagagccatcgctgatctatctgaattacagattagctggcaccgaagggactgcagaatccatttaaatggatagctctctaatttattaaagggcttatttatgctgttgatatcgggtgctcatcaaattcttggagtggcacaagcccctttcctgccctctgcttgccattgctgctggaagattttctcttttccaggagagctctaaatggctgtagccagagggctgtgtgtgtgtgtgtgtgtgtgtgtgtgtgtttgtgtgtgagtgaaataaaggggccatgcaccttct

SEQ ID NO: 81143 - DNA, 1183 bp, Homo sapiens
ccatgctccctaagactgaggttcctcatgcaccttccctctgtagcactttgcacagttattgacaggaacatttgattagtgctttgcctctccaagtagactgttgtgtttgctcactgcagtaccactcatgtcagcagaccacttaaggcatagggtgcataaatgtcctctgggccccttgggcattgcacccaaagggctggacctggagctcctcctctgaccacccctagttttgttactactgtggtgaagatataatctgggatctttccttttggtacctgtggattgcctgtaagatggaggcagggatattctgggggagaatgttctcctccatccaacagctcttgccttgcatttcttccttctgcctaccccacggtgcctgcagacaggaagacgctaggtctgacctgccttttcctaagatcccacctccatgtttacctgatcttctttcttccttattgtctctttctttacccaccactttgtgcagtatctggccaatgctatggcttcttttccatgccatgacactaagatttcttccccagtcatcctactggggctcattaaaatttagagctatacaggctgaggtcgaatctcagttctgctgcttgggagctgtgggacttcaggtgacttatggaccattctgggcctccacaccctcagctgacaaatgagagggataattcttatcatacagggttttatgagaattaaatgaaattgtgtatataaagcaattagcttagtccccagctgtgtagtaatcactcagttaatgtgttgaggggagaaatcatgatttttgctgcactcagaaaagctgtgagtaatctgcaggtcccattatggctgtggttcatacacttggttttatggtagaatcgcatggggatctttaaaaaatttcaacagctaggctactcccccagccagtgggtcagaatctcagtggatgggctcttggtgttggttgtttctatagctgctcaggtgattttcagtgggaagctaaggctgtcagcctgggctttcccaacgccccccgcccagccccccacctctttctgccagagcacatatcttggaactttaaaggaataggagggatgcgggctgaaaacatggcgggaaaagctctctttattgggctccc

SEQ ID NO: 81144 - DNA, 1321 bp, Homo sapiens
tgcccagtgtgtagaatggggtagcctttctggaaagtggcttgacaatatttattaaaaacctaaaatcacaaaagcccatgcctactgactccacttctgagaatttaacctaaggtaatactcacaaatggctatctgtatttgtggatatgggtatttatcccagtgtgacttacagagtaaacttgataaataaataattacttacagatctaacaataaatgactagttaaatattaatacattatggtccatatatatgataaatacaatgcagaccttaaaaatgacaacttttaaaagtaggtatttaatgtttctgaaaggatacatatgcaaatggtaagaaaacctaatagtataaaagataatggagtaaaaatgttagtttcagtcccttcctaatttcctgccactgggataaccattacttagaggttcttgcatatcctttcagagatagtcaaggcttatgcaaggatatgtttccctgttgcctttgcacaaatgcaagcttgtattcacattgttctgtgccacattatttctgctaacagcctgtctttgagatgagttagtatcagttcatagagatctactgcattctatttttatagttgcataccaagaatgatattttagcaatatgtattgacatgtgaacatgtttacaatatatttccaagtgagaaaagactccaagcagtttctctaatgccatttttttttgttgttgtaaaataaagagaaaatatttttatacacatacctaggaaaaatactaggatcatatggaattataagtcagaatgtaaacagtagttatctttgggtggtgggatttgggatttttttaatttcatcttttttgatgtcttctgaggtttctgtattgaaccttaaaaacaaagcaaagcagatgtgagacccatgaggacaggggagctgttcctccctcagtggatccagaggctgactcattcccccacccaggatccatctgcccctttgtggtgaaagccacggctctggtgtcacttaggattgctgactgcacagagcaggattcccataatgttgcctcatgccacatgcttgacagtcattgatggtggtgtgtgtgtgtggttgttgttggtggtggggggggtactgattaaagtgcagattcctgggtcacatctactgaatctcataccttgatagtaggccctgggaatttgcattcttaaaaaacaggctgggtggtcatactgccattaaagtttgagaaactattgtgtagatcaggaatttgccaactttttcataaaagag

SEQ ID NO: 81145 - DNA, 1027 bp, Homo sapiens
agtgttgggatctgtgggaaccaaactgtagatccacatggttttgctttgactgctgataaacattgcttagaagggcttatgcaatgaggataatttggaaaggaagttggatttcagggcaaatgaagacggactttggtttattttcattacgggtgagtaaagggactcctagtttgaggacacggttttcctcttgtttttgaagttgtgttgggaaggcgtcagcacagcaagatgtagggtagactccggcattgaaaagctgcccatgcaatgggatctcagcacgtagctctacacagagtcccagagtggatgccaagagcaacatgatttctaaatctgctggctggcttccatgacatacagtgctccactccactgtggcagggtggggtggtgggatatggctctttgccaaggctcgggtaaggggactggcatgaaaggggttaacatggtgaattagcatccacctgcctggtctcagagatggatgtgaccaaatggttcaagagaggctgggtaccagttccaaaacagaaacttgaatttcaagatatactcccagctggggtttccatgtttggcgatgttgggtgggggtgggtagggaggcatgatacgaggtttgataagttatcagtttgctgagccaggactcaggttggtgttatctggtgagactatgggatgtgtagagagatgaatttctatggattctctgcatgagcttgtgtctgtggttggggaccttggggcttagggactgaagaagagtacatgaatggcattcacagggacggtgatcctctgagttgtatgcaaatgttggagtgtttgcgcatggaaccgaactagtccatagctttcgctatattctcagaaacctctgtaactccttgaaaattcagaacactgatatatagggaaatacccagagaggattagaagggtagaaaaccctgtaaacccagctactcaggaggctgaggtgggaagattgattgagcacaggagg

SEQ ID NO: 81146 - DNA, 1015 bp, Homo sapiens
tcatgtgcctcaatagacccctattgatcatcttagttgttcttgcagagagaatatggaacctataaacctgctagtgtttctcacctgcttcaggagcctgagcacttggccaggactcgcctcatgagagcttgacttacaaggtttcctgataggctcatgtgtcctcagaaggaattattgaggctcagtttataagtgatttggggctagggctagacaatcctaaaagaatttggggttttgtttatggactgtagggaaacctgtgtttattcctttttcttttttttctccatgggaggtgggaataatagcagcaactgctgccatttttgcctcgtgtctggcttgagataataggtgctgtttagaaacaccctcggctttctggcactgatgtcaatatctgtgatttctttagttgtcttcagccttagaggacttgtaatcttgcagaatattccttcagagaattctgaattggggccatttcttgtcaaggaggtgattctagatggtggagtgaggggaaaattgatacttagcttcccatcctggccttgctgggtaaaggtggtgtttcccggtcagatggttctatttttttaacttaagctgcccttgtgttctgaaatcagtgttaggggaatggatagtgggctgattgatggatccccaggcctcctggatctcactgaggagtaaagaaggaaagagggagggcacaggaaaggcagggagaggaaaaggaatgcctgtggcaaggagtagcagaatgtcagcaacagctgccaccaccagtaacatttgcctaatccagaccctggccaggatcccaaaccatgtttctttttttctgttctatagctcatggcccaagttgcccaggttatgttattttctctggggttggggcagggaatgggactgaatgtcctttattcctatggagcctgtgcttgaactgtaacaccagccagatggtcagataggaacctggtctgtgggg

SEQ ID NO: 81147 - DNA, 1041 bp, Homo sapiens
aagctactgttgcgttaatcagtgtaattcttcctcatgccagaaaatgaattgacaaagttttggccaagttgtctgctgtacagtaggctggagattaggactcttgggccttacgtcatggtttatgagtgactgaccatctcctcttgactgctttagttttctctaccttttgtagattgcggaaaatgagatatggatgaatacatatcaagggaaacccttttttgagagatgggaatattttccacccttgtatcccttctctgatcctaagaattctggattaaggatttttaaggataaggatttctgagattgataattgcaatagctgtatgccaatctgaaaagtgggcataataatagtggctattctagggatgggatgtggtcaagattaaacgataagaggcacatacagctctcagcccagtgaccaggaaatagtgagcgttcagagagaacagttgctagtaatgatagtaattattgttattattcctggtggtgatgatagaatcaaagagaaggggttaggtgaccttgatgggtattctgaccacttctttgtcctgaaaaagctgaatttctgtctcacagtggagcccacctctctggtgactggaatactcatattctccagcgtctttcttcattgtacactgatgaataaattcggataagttctctattctcctcttttatccccttgctctagactgtatgtaggcctctctgtagatgctgtcagtttcagaaaggagttaaggaactgaaactgatgagctgacaactttctttatttccacctgagttgagatctcctccaccagcattattgaacttgggttgttctcagagtcctctgagcccagcttctgcagctggcccctctttccctttatggggtgtgttttctctggcatggctcacacagactggatcgccacagtctgggatccccatacatgaagaatgtagacgtctgtctgagctgcactcaaacaatggtacttcctttcacctgtagagctc

SEQ ID NO: 81148 - DNA, 1045 bp, Homo sapiens
tgaaggtagggtttcaaggcaggcctagaacccaggcatgctgggtgagtgtcctttccctacccttatgcttgactgatgagccccatggagtatgagatttcccagctacctccacccttggatgtcggtactagtgactgtggggacctggagtggggagagggacaaggaacaaagagggctgcagccctgccattactggaccagcagaagccctggtccttacctactggccaggatgggtggagggcagctgccagtatgacccctgacctcccagcctcacggggccctggggcgtgtgagcccaggtgcctccactgagcaaccccagcaggccacctgtgataactggcaatgaagaggtgtagataatccacagggcggctgcagggccagccttagcctcaccccctgccagcctcagcccagagcagatatccctctgccacttgagctctgctgatcctctttttctctctgtctaggaccatcaagaactcaggacttcggagcattcagcccagagcctttgccaagaacccccatttgcgttatatgtgagtagagctgggctgcagggattgggggcacatggcaggtactcttggggcagtgaaaccggagacctgaggtctagacctggctttttgcctccaggggctcttgggcaaggttttgaactttattgggcttccaattttgcctcttaaaaggattattttgggtttgatgatctctaagtttcctgtcagaaggaaaaatctaggaccaggggctgagagggagagtcagtctcctgacacccaagtgtgttcactttcatgatgaaacttgcaattttatgggaacgtaaatgatagggaattccactcatatgtaatgtgaatactatacttctgagaccataagtaggcccataagagtgtgtatgtgtgttaggactggcggggggcgggggggggttgcaagaagaaagaaagtatggctaatagccagtgttatgtctaaatagatctgggttcagtggggaaaagctcag

SEQ ID NO: 81149 - DNA, 1100 bp, Homo sapiens
agagaaatggtgtcagaatgacccaaagttaagttagatttttctgcagaacattaatgtttttaaatgatcagggacaagattgaatagcttaagaaaaaagctgaaaattttctagaagcaccttcctttattgcaagtaggggctggtttagtaacttctagaagcactgctagcctttccatgatgttcagctctcaggggaaactgtgagtggaatggaagaagctgtgaagacacctcacccaccttgttttaaaaaattgatgaagaaggccctgtcctggatcacagttttaattttgatggaatgcatctctgctaagattacatatcaaagaacctacatctcaggaagcagtataagccccaggatttaaggctgctggggactggtgtacaggtggtgggggtactgcattagcatcatcattaggcttcattctcttttgttattgctctggttacagaattccataggttttgagtggtctgccccaacccccttttctgttatttttggagtgtgatattgcagaatgcaagatttttagcattatagtataaataactatatttgctgagtgccagcttgaatcttctaccggctggcaaacatgaccaaaaaattgtttctagtgtatcctttgggggaagattgccagggaacaaaataagatgctatgttctcagtgtgggaggacagcgtaatgtgtgtggtgctgtggggattaggagttccagtttgaagtgtgtttgtacaacctaagaagagaaatgcctctgtgtgtgtgtgtgtgtgtgtgtgtgtgtgtgtgtgtgtaacatgtacaacagaccacccagttcactgaaaggatccttcagttgttaaggtttagccttcgcctcttggtcattgttttcccaaatgatttctggtctccttgttttcacctttgctggttctacagagaaaatactgccctgcttacaaacttgttttcctggtaacttattttcaagggttacttcctgctgggccatttctatgccttgtatgtgcttctacacttaacactttataggataattagttgttaatctggctcctatacag

SEQ ID NO: 81150 - DNA, 1663 bp, Homo sapiens
tggtatcaattttattgtgaggactgagtatggaatccagcttggtttttcccatctggctaatcagttcttcagatgccgtttagtaattagtccatcatttccccatcatttgaaatgctgaattggggttgttaacccttagttatagattacagatactgtctactcatctgtttttgtctttaacttggtttatgccttttttcactaggtaggagttaaaactggggtcctttttaatgctttccaggtgacacccattttaaaggtggatgaactttgttttacagaccaaatgtcctcgtccttcaccagcagatagcgactgggctgattcaccaacagttagcgactgggctgattcgccaacagatagcgactgggctgattcgccagcagatagcgactgggctgattcgccagcatagcgactgggctgattcgccagcagatagcgactgggctgaatgtaggaactaggtgctctgactcccaggtgtgattgtaactgtgttgctgactttcagtctaaaaacagtagcttggcacatgggagtgagcctggtgaatctggactccatgggccaggaggcatttggattgagaggggaggagcctcttttcaggaatggctctagtcctattcctagggattgattttacctcagggccagatcttgcagggaccccctataattttgggagccagagtaaacagatggctgtatccttaccttccaattgtgatttttctttcctccctcttcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattactgtgttggtctcagctgatttgccctttgatggcccagtgaagagagccatctcttagggtgtctttccatttttttcccaaggtgatcactgagtactggattatattacagtgcgtcactgagttactgggcccaggaagaaaggacagaaggaaatgaattgacttcccgaaagccttgaattctgtgaaagcttctctaggcccttgggaaaaaactagttctatatagtttcttagccatttccagtttgtttttccttccctctgcacttgatatgaaggtgttttaatctagcctgggaaataatccttccttctttcccccccttcctaaaagcattttattttaaaaagaattgagttatgtcttaaccttttttgaaacagtcatgtgaaatgtgcagttagtttatctccattctacagatggaggaatcacggccaggttgtgacttagcccagagtcatactgcatgtgcctgttggtgctagaggagaatgct

SEQ ID NO: 81151 - DNA, 1083 bp, Homo sapiens
atgactctgggctaagtcacaacctggccgtgattcctccatctgtagaatggagataaactaactgcacatttcacatgactgtttcaaaaaaggttaagacataactcaattctttttaaaataaaatgcttttaggaagggggggaaagaaggaaggattatttcccaggctagattaaaacaccttcatatcaagtgcagagggaaggaaaaacaaactggaaatggctaagaaactatatagaactagttttttcccaagggcctagagaagctttcacagaattcaaggctttcgggaagtcaattcatttccttctgtcctttcttcctgggcccagtaactcagtgacgcactgtaatataatccagtactcagtgatcaccttgggaaaaaaatggaaagacaccctaagagatggctctcttcactgggccatcaaagggcaaatcagctgagaccaacacagtaatagactcgtttatttctcagaatttagtttgctgcttgatattacctgcaaatgtgaggcaatcacacaatgtccttgaggctctaatcccagacttgtctgagcaccgtccacaggcagctcggcccatcagaggtctgaaacaaacctcctaacttgggccaggtattttggtttcaaatagtcacccagctcatccttagtgacccacacatgatggcccttattcccagcctgggaaaagtctccagttaatagcagtgctttgaagaagaacaccttggctccgaggttactctctgtccgcattgcctgggggaacttgaatgtgtagtgcccacagggtgcatttcctaggaacttggcttccatgttgttttctgaagagggaggaaagaaaaatcacaattggaaggtaaggatacagccatctgtttactctggctcccaaaattatagggggtccctgcaagatctggccctgaggtaaaatcaatccctaggaataggactagagccattcctgaaaagaggctcctcccctctcaatccaaatgcctcctggcccatggagtccagattcaccaggctcactcccatgtgccaa

SEQ ID NO: 81152 - DNA, 1059 bp, Homo sapiens
gctgggcgtggtggtgcgcgcctgtagtcccaggtactcgggaggctgaggcaggagaatcacttgaacccaggaggtggaggttgcagtgactcgagatcacaccactgcactccagcctggtgacagagcgagactccatctcaagaaaaaaaataaaaataaagaccagtggtttggggttgggagagatatgatagtctatttggagaggacatagtatcgtggggactcatgcaatagcaataccagttccagtgtgaactgtcgtagaccttttttagaagcaaattggcaaggtgctgctattggtatagttattgagcatctacatgtgccagacactttacattcattatcttgaatcttcagagaccctcagtattatccacattttcataagccaattgagattcagagtgtgtgacttgcccagagccatgcaccgattcagttcactgatcggaacccagattggtctgggaccaaagcctgcacaatttctactatagtacaggccttacaaatgttcagactctgccaaaccagatgtatttcctgaaggaaaaccttgaccttcaaacaagggaaggcaccccaaaatattgattgcatgtactatcatcagaaatcaaaatgctgtaaatgcccaaccatggacagatcatatactatgaaaagaagtatgtcactgttcacagtggcttctgcatggtgagtcatgaatgatttctgtatattttcccatttttataatgaactgcctttattatcaagaaagtaaattttaactctaactgcttagagattttaaatgataatacttttaaagtgggtatttaggttcagccttgaagcctagggtggcgcctcatggtctgaaattctgcatttgcccccctgagaaaaacctgagcaatatttagaaatttccattaggtggcggtgctgtcctaggctaaacagatcacagtcacgtgaattctgcaacctgccaaattctgtggtctctgctggcgcctgtcctccactatagccatctgccctttgcctccctgt

SEQ ID NO: 81153 - DNA, 1059 bp, Homo sapiens
ccttgaggcaggaacgtctggaagcggagaggctataattaaggctgtaaaactgagtcatctcaggaaagagaaatgaccagtgactcagtgcaacatagtaaaatttataatcactcttcactaaatgagctggtcattccagggtgattttatacttctgataacctggggctgatataagaggcgatttcattaataaggtaaaataatgagttgccacattcccctgctgtctagatttcagttcgatggtgaatatcaatcctgtcccctctttctctgtctctgtccttgttctttttaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatacttaaatatatgtggttggatgactgctttatgttcctatcatactcaatgctttcaagtacttgggttccaggaaggactgtgaaagagatgagag

SEQ ID NO: 81154 - DNA, 1018 bp, Homo sapiens
agactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggtatgaggtacactcctgccttttacttgtctaatctccttggcaaaatgggaaggtttctctgtttgtttatagcccacccctcagaaatagacatttcacgtagtctgaattgatatcctagggcccaaacttaaaatcagctccatttttctctggtcatatgtatttatctggacaaatggaagctaaagttcaagtcattgacaggaagatagtcacctctgattactaccctaactcttctgcagagtattttcagtactcatgagatggaagcccaaatgctacaaggtcaaggtttggactacttatggataacctcccttgattttgtaagactgtattattggtctggctgttttagttctggcaatgagaatgagtacaccataccaaaaagaaaattctctaagtaaccccactttcatccttaaatggttaatgtcaatttacttctctgtaaagtactataaagtcctatttataaggtaactaata

SEQ ID NO: 81155 - DNA, 1242 bp, Homo sapiens
gggcatccccaccgtggtgcactgcagggagggagggagggtgggtgggctgcctggcacactctcacccagcccctctgcctgtgtgttctctcttcaggctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagaaggagccgacagcaccagcggttcatggcccggaaggccttgctgcaggagcaggggctgctgagcatgcctccagaaccagggtcctccccactgcccacccctttcggggcagcgacagcaactgaagctgccagcagtgggaagcagtgtctgagggctggatctggcagtgccccatgcagcagaaggcctgctcccgggaaagcctcagggcccttgcccagcaagtgtgtggctatcgactgtgagatggtgggcacgggaccccgagggcgggtaagcgagctggcccgctgttccattgtgagctaccatggcaatgtcctctatgacaagtacatcaggcctgagatgcccatcgctgactaccgtacccgctggagtggcatcactcggcagcacatgcgcaaggctgtccccttccaggtggcccagaaagaggtaagggcagggatggggacttgtttgggaggtgtggtgggctggaaagagccaccctgggtttgaatcaccactttgcttcactgggggcaagaaaccttgggaaagtcacctaactgctccaaacagtaggttccttctccatagaacaggggaaataaaaataaaatcctgaccttgcctccagataaggattgctggcctgttgcacaggacaatgtagaaaggctacaccaactgtaaggtgataaatagcttacattttagagtttgctttctgttataaaagttgtacgcattgatataaaatttgtaaagcccacagtggcatcacgttcaggtatggatgttttggcatatttccttatgttagtttcttagtgcttagaaaaaattaattagtggttgggaccacactgatgcaccaggaattcccaaacatgcttgaccttagaaacacctaagtcctttttaacaatctaggatccttgtccccagttccctccatagagttcctgatccattaggcttggggagg

SEQ ID NO: 81156 - DNA, 1004 bp, Homo sapiens
acaggcttctcgtggggagttggctccttaacatttcttggcaacagaaagccccaggcacagctcagggaggagggaaggcaggtaagctttggacgagaactggcatatttattttgacccaaatcagggatttccccagtccacccagtactgggctcttaagcaaaagtctgagaaacaagacagtggtttgaattctggggcctttgtgtaggattgtgcctgacctttatttatttattaacagcagggccactcgtctagggcagtggagtctgcgtgtctcctggggctggggcagggcattggcagttacgcagtggccctgaacctggtctggtgcccccgaacctggtctgatgccccctcagctctttgacaatcactgtggctgttgggttttctcctatttctaaaaatgttctcttctttcctaagtgacagttttgaagtattggataaccaagagctcaggtcacacagaccttggagccccatctttgcttgcagcttagctttgagatactaagcaagcgagggacttcactcttgaggctgttttttcctcatctgtaaagtggggatagtggtacggcctacctcatagggttgtaatgagcactaaatgtgaagtgcttggcacagtgcctggcacatggtgagccacagctactgtgagtttctgtttatcccccttttttttttttaagcccattgtttattctttgagaatttgttgtaacttcttcaggataacacctgagtccacaggctgagcagctgtggcccagacagaactgctccggcttggctgttccagcaggtggggcgctggcctcggtgagggcacagcagcaaggttcacggatatccgtgtgtcttgtctgtggccaccaggcacaggtttggcttccggtcagtgtcccgacactgtgcgggaggtgacaacagagcaaagcagcgcaggggtcagggaggtacagacactgctgaaatcacac

SEQ ID NO: 81157 - DNA, 1022 bp, Homo sapiens
tacttttcaaaccacagatcttcatgacactgggaggcagtcagattggagggatcagtgtggattctgcacagatctggggtaggaggcaagcgtgggtaacgctcagcttattgttggatctcaccacagtgaaagacaagcacttccctcattgaaagttgattttctttttgccccagttgtaactcatttgacattcactaaataccaagccctccctatctggcaggcactgttctaagagctcaaagtcctagcctgggagagtgtggacccaaggaagtgtggccgggctggtggggcctccccgaaggcctgcttctccttcaccctcacagagtcagccccactggaggcagagctcattgaggcatctggaacccacggaggcctgtaagggctccctcgctgctccttgccttccctgggttggaagtgggggctagccactcccaccacaagtttctcctgcccattccaataaaagcctgtatgtcccaagagccagcttccctaccccataagagaccactgagtatcagactggtagcaggctccagaagttagttgtgggacattccctgagctccagtcctggggatgtttattctctgggcggagggtgagaaaggaaacaaagatgttgcaatccactccacgaacgtcaaatgcgtcatctgaggagggggagggccggggcaaaggaggggcaccctgacatggagcctgccagctccgtcagccctgactcggcccggagctgagctccccacctgccggtagcccaggagatggagcagcccagcccacgtgcccggccttccgcccctgacttcacttgataacaaactagaaactgaaacagggtcgggatgccgatgccggcttggagttagagatgagtcaccgctgagagcagctgcagtagctgagcagtggcagcagagaggcagacgtgagctgagggcgcagaggcaggcaggtgagagcgggagctggagcagcagctggggaggcag

SEQ ID NO: 81158 - DNA, 1046 bp, Homo sapiens
cactgtctggacggtgatgtcctcctcaccccccactccaaagaagttttctgggatgtccacaaagtcttcacctaggggaggggcaaagacaagctttagcctctcagcctgggaccggcttgagggggatgaggagtgggctggagatgagcatggctccccctccttccctgctggggcaggagggcaccactgtgtgccaggcaccttgccaagcccatttcaggggtactcagctatcggcattcattgtaggagtccccacagtttcaagattgcaagagtgcaagagctatcagagggcaagatattgaccaatgagctgacggctcataaagatcagttcccaccccaacagcccttcctgctcaacacagctgctgcttcactcgtctcatgagcaccttaccaaccatctgatgctgtaactatccaacaggaccaggtaagtcagttataaggagaaatcagaaaatcttgcagaaagtgcagtttgtgaagttgatgaaggtggctttggagaactgcctgtctcatagtcatggaaaaatgagggtaccatgagagtgatactacttccaaaagagtggttagaataccaaaaggttaagagaggcttcgagggggaaatcccagctattaaccctcttcctgtaagatcaggttgtggaaatgaaacgtgtaatgagttgtcattgtgttatcaccacttagtacataaaagttttgcaactcctcattcatgtgaggcattgttttttcctccaagaattagcatgtaattataattataacccaaaatgtgttaaatgtaagataaaaacttatttgaacattttggtctaatttttcaaaataaagtccccatcaaactttcccctactcttttcaataacattttgtggccgggcgtggtggctcacgcatgcaagcccagcactttgggaggctgaggtgggtggatcacctgaggtcaggagttcaagaccagcctggtcaacatggtgaaacccatctctactaaaaatacaaaattagctggg

SEQ ID NO: 81159 - DNA, 1096 bp, Homo sapiens
gaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccactgtctctcttgtagacagaactttggtggaatctgtaacccaggctccaacagcccaagaggcaggagaagggcctt

SEQ ID NO: 81160 - DNA, 1089 bp, Homo sapiens
tgagctcagatcttgccacggcactccagcttggacaacagagtgagattctatctttaaaaaaaaacaaaacaggatatgcttctgggcctgacacccaaggcatccagacgctggccctggtgacccccttacctcctctcccccatgcagccagggtcttggcaggaagcagaattcagcccagatgattccaataaagagactttaatggaggaatgacttctagagagtagggtgaggggacccaacaaggaagtgggggacgcagaggccagcagcagcagcagacactctatggcagaggcactggggtggcaagggagctgggaagcaatgccccgtcttcctcctcttccctctctgccatcttctctgagtgcctcccattggctcaatcccactggaagccagaaggcctggggaactgggacaacagggaccaatacgtgtcagagaaggacagacgatggacctggtgggtgtgtggggcaaatggaggacctcctgtatacccccagcacccccaggcttgggactcttgctggcatctgcacctttgtagtggcagtgccctactggataaacctgtcagtccttctccacctggcaaactcctgcatcttcagtctcatttggacattcccgtttctgtacctccatcgtggtactcaacacacagcaatcaagactgcctgcccacgactctgccccctccctggaccaagctccttcaaggagtgaccccatcttttaattgttgagagcacgcagtaaatggcaggtgagcagggctagggtgacatgagtgaggcagtagcccttggtgtgagatttaagcgggggaggaagggagtttgctagaaatcttagtaatcaagacaaaatatttgaatacaatatttaaaaaaaaatcaaatcatcaaactacagcccatgggttggctacctcttttgagcgcccacccaaactggaatagctcccaagacctctagcatggtgttcaaaaattatttttgagttgggcgcagtggcttatgcctgtaatctcagcactttgggaggccgaggcgggctgatcactaggt

SEQ ID NO: 81161 - DNA, 2056 bp, Homo sapiens
tttttttttttttttttctgagacagagccttgctctgtcacccaggctggagtgcagtggcgccatctcggctcaccgcaacctccgcctcccaggttcaagcggttcttctgactcagcctccctagtagctgggattacaggcagccaccatcatgcccagctaattttttgtatttttagtagagacggggtttcaccatgttggtcaggctggtctcgaactcctgacctcaggtgatccacctgcctcaagtctctcccaaagtgttgggattataggcatgagacaccatgtccggccttatgcccattttatagccaaagaaactgaggctcacccaagtagtttttttcaaaactagaattcatgcctcagtgtgtctgcctcttttcaccttactggagatggtccaagcagagaaaatgtggttggtttcttctgtaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaaggtgggtgtctgtccagctgcccaccctttgccattccttcattacttccctgggagtctggcctggggctctgaggggaggggggctggctcggggtcctcctgacacccgctctgcctctagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacgggaactcttggtgtggttcgttattgtttcatgggaatgggatttaaattgcgctggtttccccatcccccacctgtggtcctccctgagccccagcttgcttgcttgcttttttttttttttttttgagatggagtcttgctctgtcgccaggctggagtgcagtggtgtgatctcggctcattgcaatctctgcctcctgggttcaagcatttctcctacctcagcctcccaagtagctgggactataggtgcacaccaccatgcccagctaagttttatatttttagtagagacagggtttcaccgtgttggccaggattgtctcaatctcttgaccttgtgatccacctgcctcggcctcccaaagtgctgggattacaggcgtgagccaccgtgcccagccccatctttctttatgtcacctgcctgactacacatagcttcatagcaggaggctggagactttggtccagggcggc

SEQ ID NO: 81162 - DNA, 1065 bp, Homo sapiens
ggcgatgggggcagtgctgtgagtccagaagaggaagaaatcctgcccaagtgaagtagtcagggcagacttcttggaggaggtgtctccaaagtcaggcattgaaggagggcaggaggtggtggagcaggggccttccctggtgcagaggagaagggtggtgagtgggaggtcttgggtgatctgtgaggagctgagcccggctggttgaggtgaggaggtggtggggtcggcagtgagaaggtcgcacagttggccctgcaaggcggatggagctgctttctgttgcccaagagcatgacaggggctggtcaggatccacagagttctttctgcttcatcgccttgtgctcctgcccctgggagctgtggatcccagatccagatgacagcccaccttgctggcaggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtgggtcagccttcttgggatatggggctggggttgggtgggatgaggtgggactgccagatctttgacctctctccagcccaggcttctcttctgctccccaaaagagttctggaaaagccttgtttttcttcggcttttctttcttcttcccacctgtactcccttctcttgatcctgcttccaccaaggtggagaaagggtgtgtgtgtgtatgtgtgtgtgtgtgtgaatgtgtgtgtgtgagtgtgtgaatgtgtgtgaatgtgagtgtgtgtgaatgcgtgcgtgtgaatgcgtgcgtgtgaatgtgtgtgtgaatgtgtatgtgtgaatgtgtgtgtgtgaatgtgtgaatgtgtgtgtgaatgtgtgagaatgtgtgtgaatgtgtgtgtgagaatgtgtgtgtgaatgtgtgtgtgtgaatgtgtatgtgtgaatgtgtatttgtgaatgtgtgtgaatgtgt

SEQ ID NO: 81163 - DNA, 1805 bp, Homo sapiens
cgatgaatgtttctgcatttgggggttaccccaggagggttcatcactggggttcaggtggcaaggtaacaggttcccatggatgaagtatctgtaagtggatggcatccctggaggaacctggtatggggtcaaggtgaggggggaggaggccccaggctgtggaggagctgttggtgctggatgaggcctctggaggcctgggcagaagaagaaagccctttgtgcgggcagtgtgctcagctacccctcctctgttttgcttgagttgttcccccacccagtgggggagtgaagggatgggtctgcttggatcttgagtggaaagaacccaggagataagggtgccatctcccctgccctgtgtccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggtaggtcttgttggggcccgaaagaagggctgtggtccataccccctaaggttctagcattgactgaggacccccagcgagtccagagaaccctaggtgattggctatgatgtgggtcttcgggtgcatcttggcttctagaaattgggaaacccagactgtgtccatgttctgtggtttataagcaatagtcccactttagagatgagactagtgagattcaaaatggcacagtgacctgttgagggtgatagtggtggtggagctgggtttcattctgagccttcatgggtacatgtacagttgtgtaggttgtacactgctcaaggatgtcattgctaagcaggcaccattcacagtacaggcattgtacatttgtggaactctgtcagaaaattgtcataataaactatttgagaaaggagtgccttttcctaatttgcaaagaggtaccctgtaggttacaggtggccctgtgtcagctataggggtttatgcccaggctccatgatgattaaggaaagtgagaggagaatctttgtggagggccgtggggtggccaaaggagaggctgctgtgtgagcctctgctggctcttccaagtcctcttcaccctcccagccccacctctgcctcccaggtctgaagaggaagatgaggtaaccccagggagggggactgctcagatggacccccttctccagtcttgtcccttccctgctaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggtgagtgctgggggtgcgggtaggggggcactgttggccaatcctaggaggtggccctccctgctgcctcttttctcagccaaactgagctaggtagggcagcaacaaggcacggggaccaggcttcactcgggcaacgcactctagggggtcacctggccatagcagccccacccaggtgtttgctgtctgccaacccatgacccagggcattctgattgatagagaaaaagacatcagttttcaaagtattttcccttcttctggttggctcctctcctgtagcttctagaacatgtagcgttaggtgtgtttggcagatgtcagctttacgagggcagagaatctgtctgttttgtttgcttcggtattcccagggcctagaatggtgtctggtttataggtactcaat

SEQ ID NO: 81164 - DNA, 1568 bp, Homo sapiens
ttattttttctcccccctggtggacaatggtgaggagggtgaaggaaggttaaaagccactgctctacgggatgaaaaactaaacttgtcattcttcagatccctcccagtctggccccagcctacccttccagctgcatctaactgtgctccaacataccacaccctctgtgcatctgcttttcttggaacattctttactcattgcccagtctggcaccccccttactttgtcttctagacccagctcaaatattccctcctctggggaacttctaattccccagcagaaatcatgcctccagtgacggtccatgcaggcttctggagcgttgggcaatcttcctcatctgtggacttgctggcctctttccccttggcttcttgaggcctgcgctgcatctgatttctctgtctcgggggcctagcatggtcattggccctcccagtgtttcctggatgatcatcgtgctgttcctgagtcagggctgccattggaggtgacatctgtgactgcaacctgtgcctgaattggtgggcggaacctgctcaatgggccagaacaatgcttccttccactgcccctgcctgaaagtcctcatgggcctcctttgcaatcaaactgctgccaagagacctgccctggaccttgcctgcctctccagaccccagctgccagctcttccaccagtgggcagtggtccccagcaccactgccattgtcagccagcacttttctggacactcccaggccacttggaaagctgggcgcttcccttatgtgggccgattcgcctacacatggacttccttggctctaggcggactcaggctccatccagcacacgggggaagagggagaggaagagataatgggcgagtttgagtggagggtccttttgggctggacccatctgctacttctcacctgtgtccccagctccttcctgatcatctgctcatcttacctgtctctgtccccagatatctgttccaaaaacccctgccacaacggtggtttatgcgaggagatttcccaagaagtgcgaggagatgtcttcccctcgtacacctgcacgtgccttaagggctacgcgggcaaccactgtgagacgagtgagtatgtgggggtgcttgttgcctgtttctagcagtagaccctgagccacagccctggtggcataggccatatgctggccttattctctgcctgtgatccccaccccagtggaggtgtcaaggcctcctctggggagactcagagagagagacagagcctcagttagaccgaggggggaaaagggtcctgttgtttcttccttctttctgcctggccctctttcctgagactgccggccaggcctgatgctgatgcagaggagtgaggggttgtggtcaccctggaggtcacgggagtgctgtttcttgagtcaccatgagccagacacacagcattagggttaagttgcaaggatttttctacctaagaggggaaaacaaacacattcttggtcttttgaggcccaggaactcagtaaatcagccttggtttcagagtctgacagttc

SEQ ID NO: 81165 - DNA, 1019 bp, Homo sapiens
cttgttaacatcttgatacttgccgatccgagaagggaaacacgatgctcattgtagttttaatttgcatctatctgattatgaataaagagttagcatcttttcaagtctaaaaatcttaaaaacaaaactcctgaacttttcccgcccaacagactcaagactcgtgacccggccgttggcacgacgcgggacgccggtgtggcagtggcggaagaggcagatatcgcggaccacccccgcgccccccaattcctttcaaccaattccctcccagccgcggagccccgcccccagtccgcctctggccagcttgggcggagcgcacggccagtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctgggtgagtggatcgcgccgccctctgcccctcgcccctcctccccgcgccgctcggaagtttgcccggcgcccgccctccacctccactgttgacaaacttagacaaagccccggggaccgggctgggcagaggggcggcttcttccgctgcgccctggcgggacagggggatgcggccctgctgtctctgcgctggggcttttgggctgggactcgggacatcgggtgacagccctgccgcccccagggatgcggcttacagataatgacaaaggaatccgctgtgtcgggcctctcttttccctggtgaaaaatgaggccagggaactgcgtttgactttcgaaccccttccacctgggagattctaggactctagtatggataagtcttgtctggataactttgtcctggccatctccctgccaactccagttggctggacagttcattggatttttgcgctcccaattgtccgtgcctggtcacataagggaagggccg

SEQ ID NO: 81166 - DNA, 1037 bp, Homo sapiens
agctaccagccgacctcattcctctgagcccagtcgacagctgaccttacccagccctctaaagcagtttgcggtcacaattacccgtctcttcaccccgcccccatcgacatcaaacacgacccaccttctagccctcctcccctttccccgcccactccgggctggccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccaggggttccggctgtatatccatgagcgccgctggcagccggggagctgcaggaaccagactgggggcgagctgagcacctgtagtcaatcacacgcaggtaaagccacggccgagcgagctccgcggagcggggatcgcaccccggacccgtcgaaccgaatctccgagccccgaggtccccggcgtagctcggcccatcacgccgcagcctgaggggatcctggggggcctgtcatctggcgccgtgggggtcccaggggctggcttgcccagtggtggggacagcccagatcgcggcgggggatacgccttcctgaggccctttgtccccttctgcccgaggaaccgaggttggggacaaccccgaccgcggcctttcccccattggtgctcactcctgggtcttcaggggcctggggaggggtctgccggttcaggctcggcgaagaaggtccgggatccgcacctggaaggagagggccgaggggcctgattacagcccgagatacccgagaggcctctgtgtttcggggctccaggggctcacgcaggaccagtgggtttaagttctagaaaggcagcttttga

SEQ ID NO: 81167 - DNA, 1073 bp, Homo sapiens
gactgcatgacccatctgtaagggccttctctacccacaaatgcactctaagtggcctttgatgcctagcttgagaagagtacttctgggggtccattaggttccaagtggctgttgaattcacccataatgaattttgaggtttcagctctcaagagtgggtgttagcaaagagactggattatacaaaaagatagaggtttatttagccactgtgaaactccttgtatttgaactaccatggaccgctctcttaatcttcccaatctctcttttttggttgctggacctccagtttgtcagtttcacctgcattccagtaaccaaatccaaaggcatgttccaagaacaggctccacagagggacctggagagactgcaggtttggcagagtcaacaagatctgtgcccagagcttttcgaaggccgtttccttacagccacattaagcagagtccaaaagagaaatccttcactaccctctgtcatttgccggaatagagagaacataataatctaaaggtcaggaggcagagaaagaatcttaacacaccttgctgtgtgttttaggatgaattaatctttgaacatctagtcagaaagcagtccatatacagctggtagtcagcacggactgtgacattttagagctgaaggcaccttagatagagctcatctctatctaagtctaattaggtggactctcattcagtctcctcaatgcacaggtgaggaaactgaggcctggggtggtcacagggctggttggtcatcacaggcccatgactaagggttgatctcttgactgtatttagatctagccagtgcatgacttatttcactccaagcttagtttgcccattctcagtgttttaagttctaggggagtccagagaggttaggaggacagattttggtgcctgagtgcctggatttgaatcccagccctgcctcttactggctgtacaaccttgggcaagctacttaacttctctgtgcctctgtttcctcacctctaaaacagaaataataatgatacttatgttagaagattgttttgagaagtgcatgga

SEQ ID NO: 81168 - DNA, 1703 bp, Homo sapiens
ctcaaattcctgagctcaagtgatccacccacctcagcctcccaaagtgctgggattacagatgtgcgccatggcacccaggcaaattttagcaaatttctacatatattgtttggcatcctattactttttctcatgtattcaattatgtcattactatttcctaaaaattgagggacatacaatattcctaggattatgtgattgtgctagagtcctcacagctgggaaatgttcttttttctcattcagagaatgagaaaaattcagagttcagcaggcatttattgagctctttccctgctggacgctgtgccagacactctgtcctgaggagtttccctggggcctgaacaccctgtgccccactatgggccatagaggaggctttccacagtgctaactgagcttccaaccccttccagctccttgtgtggcctgaactgtattcacactgtagacattagcttctcaggttccaaatatcctggctgcagttccctcctctattctgatcatgtaaataaagtgcttgctcattcttgtcaatgatgttgacaaatgtacccttctaaatagtgggatgatggaaaatgccgagtagattatagccaaggatatttttcccaatttagaaaacatagttcctttccctccatctatcattaatatcacccatcagtctatttattgactctacatataaattctggatgttgcactgacatcgcaagagaaatcagcactttgccacaaaagagcttataagaggaatgcagatttctttaagtctcttatggatgagcagagaggcctcatggagcttctgtaaagctgaattatcaaggctgaagtgatcagaatccatccagctctgcaaacagcttataagatggatgggtgccttgcttctctgtattcctagagcctcaccagggcctggcacagggagggtccctggtcctcagtttccttgcctgcattaatagtaactcacagcggttgtgagcaccaaatgaggtaatgtcggaggatgcactttgtcagtaagttaggcattcagtcttcactgtcaacacaaatgcattctgtgacatgtttgaggagtaaatgaggtaatgtattaaaatcacgaacactttataaacgatagagctacacaaataggacattttcttatcatccagctttgttccttcatttaaagttatcatgatttggccaggctcagtggctcatacctgtataattccagcacagtgggaggctaaggtgggaggatcacttgaggccagtagttggagaccagcctggaaaacatagtgagactccatctctgcaacaacaacaacaacaagaaattttaattagccaagtgtggtggcacatacctgcagtcccagctactcgggaagctgaggcaggaagatcacttgagcccaggagttcagagttgcagtgagctatgattgcaccactgcactccagcctgggtaacagagcaagaccttgtctctataaattaaaataaataaataaaaggcggggtgcagtagctcatacctgtaatcccagcactttgggaggccgaggtaagtggatcacttgaggccaggagttcaagaccatcctggccaacatggtgaaaaatataaaactaagctgggcatggtagtgcacacctgtggtcccagctactcggg

SEQ ID NO: 81169 - DNA, 1082 bp, Homo sapiens
aacaaaaatcaaagtgctacccctagtcctgcagccacctcttcgactgatcttatttttccccctccgataaaggacactattcttagcatttttcaattttctgatttgctcatcttagaaatgcttgtgaaattataaaaagaaaacacagtacccagtttatccatgctcagactgtttgtgatttggattatggccagttgattagtagctgtaagatgctggtggtgtctgcctgtcaggagcctgcggaaacatctgaattgtgacacaccgtcactggcagtatctcttagcccaccatgcgtctgtagggtggtgggcaccacccgtcctcactgtgcttgtaaacttagacctgtgcctctgctccccagatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagagtgagtagacctcatgccctctgtatgctcagctgctgatgtatttggctttgtgtgatgttcaaagaagaaacttctctcatcgtgtccttaaggcatcaatgggatatgacgtcactggtgttaaaatagccacagtctgattgcagtctagtgtttgaatcctggagggtaggagagaatcagatctctgttgcctgaaacattccttcctctacagtgtgatgtcattatccatgacagggactttgcagaaaatagtagtcatttttaggcagatatggaaaagttggacaatattctagtcctttaacgaatgctttgttgccagttctaggatggagaaactatcctcacccaaaataattaataagcaaaaaagcacagatccattagttgagtactctccatctgccttgttgaaaaatgtaccaagcattagctaagagaatgcacttaaagagagtgctttgtatgagtgaaccaggtttccctatagaag

SEQ ID NO: 81170 - DNA, 1086 bp, Homo sapiens
tcgatttcagaatccaccttggttcaccattcatccttaacttttagcttacacctcatttgctttacaggacttacatggaatcagatctacttttatactccttctcaatgtgtggttgactgaaaattgctccactatccgggagcaggaaatggaccttgttttctagaaagtctcgaatttctaaggatagccaacttttatcagcctctcatgttttactgaccctgtgaattcagaggttgccaattttgatctccactgttctttttctctgcctgcttctcagcatgccctccttcactatgatagtacactttgtactacaaaatagtatatactttatggtaaaataaaattaagacagtaaactgacttggaaaatatattctggagggtaagtaagaatttttcctaaactctcagtgccagtgtcatgcagtgatgtggagagtgaagagctgacggctgtttacgcttttctttgtctgaagcaacagtgagtgaagtgactggctttagaagcccagtcttcttcagcagcatcaagaatacttccctgcaaatggagtctgtttgggatcctgagctttagggtcagaatttattagatggtgtaatgtttacttaaggaaagcattttcctgagtttataaggaaatctacccctccatgaaattctagaaagctataactaatacagaaggctgtagtccttgaagacttgattttatgcatgattggatgagatgccattgctgtttgctaccccatgactgtcagtagtcagactgagaagtgccctctaccaagtaccaagggccgggtactcctcagaggccctccatctgcctgaggtagctgcctgcagtgtagtatcacggtgagccatggaaatgagtcagccattgtggcagcttgtgaaccaccctaactctacctgctgtcagtttctaatcatagagtgagggctctgggtcagcgtgggtgcatggcatcaaaccagatggcttaacttctgaggtagccattataagagtctgtaatccaaaacatttgggaaccctgcctggagatcagtgg

SEQ ID NO: 81171 - DNA, 1084 bp, Homo sapiens
agaaacagcaggttatatgtttttctacccttccactgagtactaatgccattgccatgaccaacctgactttcctgtgatatgtagcaccaaatcctcctgctggcaagaccctgaactggtgttttcagccagatcacaaaagcttgaacagtaatttcttactgatgtaaagtgagaaactccataaatgctttttaaaatgttgacacctgccaagccacagcagtatggacttttccttccttgggatttgaataaaggaagattcttctcagtgaatatatatatatacatatatatatatacacatatatatatatatatatgtatattttaaaaattagtcaattagtaatatttagtaacctgctcttccagtctgttcaccgtctgtacaccatactcagccccttctatatcacacacaatactttttctcacatttccaccttctctgtctgtcagaatcctcaggccttctcaaatcgtagctcttctagtagctcctgacttttacctgtctctgtctcattggctcttacctaaggacagggatggaaacaataactttccacatatgtatctctcgtcacacctcaagtgtattctgagaggcttaaggacagagactgtcttaaaaattctctgtcttccctgtggttgctgcttcttgtagagtcagtacacactaacttcagtagagtcttttggtaggaacatgtgattgacagagtgagtaattcaggtaagtgataaaggaatttagagaaagaggggatattcctgtggtggcttgactgatgaggtcttccataatcctgaaagattagttggctttggatagatgggacaataggagagaaggcacagatgttggtgtgagcatgaaccagtaaaatcaattatttaaacaagcactcatggcagaaaactggctttgctgcccaggccaacacttttcacccatccacctttgtccttttgtcctgtgggccttccaaccagtcagcaggataagaaggtggtagaggccttgctgccattgacacatatccacgttgtcaatgctttgccgtcacca

SEQ ID NO: 81172 - DNA, 1036 bp, Homo sapiens
actaatatttttaaaggatgactaatagactcataggagtctctagaatgaaagcatctgtctgtccttatcatgtttgttttatcatccaaataagccctggacgcagtggccaaggccccagttgaagtctcaaccctgctcttgactagcagtgtgaatgtggccaagccatgaactccctagcctcaggatccctgtggtaaagtggggttaacagtatctgcccatttcacaaaattgtcattgaaggcaaatgagatcattttaaaaaggactttgaaaaactatgaagtgctgtatagataaataaaatagcagttttatttattatgccgtgttcaaagaaaaaaggtaaataaattcttgatgctagaaccactgagattagtacctcaaacatccttgacttcctttgttaaagagcttggggggacatccttaatgtttctgaagttgcaaagggagaggccccaggtttcactccgggtgacataatttctttgctgtagtaagattccagtggcatttgccttagcatgtatctcgttcttgcagctaaattagagcacggtaactatttcctctcattcctttttaatctgtgaaatcatgagccttactcttgccttgttaaggaggagaagccagactactcagaggacccccacggagctcctcagcaagtggcctgcccagccttcccctccacagcccctgagccatcaccacatttgggatcttcttctccacccagttccttacttttcagctcatatcgtcacatttattggtctcaagtctcttgtcttgggttgggctgggaaggaggaacatgcaggaacggaataccagtcggattctagcctcctgcgttcccattgaatgcaggaggggttgaacccagtgacattttgaatataaatattttcatcagagttaggctaacattaaagaatttttctttgggaaaatattttctaaaacaaagtctgctgagccaattcgattccatgatgagtttttttttaataca

SEQ ID NO: 81173 - DNA, 1041 bp, Homo sapiens
catttttccagtaattaacttctattgtcttttcaaaagtatctgttcatgacttactggacattttcaaaacaaacccttcactataaatagcttgagaagcactgatatagacagctccagctagaagggaaaaattcttccccagagaactgagtgaaagatgtatgttgaattccctccccttgttttctagaccagtgaagtgtaattatgtccatttatcatgtcacatttcttggatacatcaggatctctttctctacgctatagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggtaagcatggctaagtggagtcctccctttttctgcaagtgtgctactacttctgcttctgccttgttttttctttttttaagttttaaacctatgcccatctgcaagagatggtaggtcacacggttatatcaacagccaacttgtactgggcattgatgatgccatgcctcacaccagcctttgagatgggcactataaccaccctcacagaggcagaaactgaagcttacaggggaaagtcttgcccaaggtcccctagctagtaagagtcacagcagggctgggagccaggtagatcgggtagcagagctcatgaccttcaggactgtgctgttctgatgctcgttcctcaggactcttgtgactgacaggcaagggtgtgatgaggcatgtgaatgtcagtgggaagggagcctggcacagtagcaactcactggattttaggttcctggggaacaggaactagatctcgtctttcgacgaatgcttcttgatttgaattaaaattttgtgttagctgggccagttgtggtggctcatgcctgtaatcccttctctagtaattaatttttattgtcttttttttttttttttttt

SEQ ID NO: 81174 - DNA, 1069 bp, Homo sapiens
catttgaaccaaagaattattgtgtccagttccatgttgagtttttgtcttattagtcaagatggactagattatgctgtggaaacaacttggatctcagtggtttaaagcaatgatttctgtccatactatccatccattatggcttagctgaggggcctctgtgtctccatcattatggtcctcactcaaggaaccaggcccatggagcagctacctgctggaacattgcagagggtaggaagagtgtggctcttgaagcttctcctcagaaatgacagaggtcactcctggtcacactttattggtcaaagtacagtacacgaccaagcctaacttcagtggggtgggggagaagcatccttcctagagatggaaagtagttattggtggtgaactctcgcacagtttatcacaatttctgaaggggaactttaatttataaattaatgtggaaaaatttataatacttacttttctcatccaggagcatgaccttttccttcaagtcttcctttatttctacctaaaagaactcctagttctctttgtgtaggtcagtttgttgtcaacactagaatttcccatgggagcttttaaaagatacctgtgccagtggcttagctctccgggagtctaaggtatagccaaggtttttcagagccacagatacaggttttactccttgttccctcattagttttatttttgcttttttactttttattacagacatttcaaaatatgcagaagtagggagaatagtagaataaaccccagtgtaccctttacccaacctcaacaattgttcaactcatggcccatcttgtttcctttactcccttctggcatcccctctcaaagattattttgttttattttaatttaattaatttatttattttctgagacactgtctcactctgttgccgaggctggagtgcaatggtgcaatctcagctcactgcaacctctgcctcccaggttcaagtgattctcctgcctcagcctccctagtagctgggattataagcacccgccaccacacccagctaatttttgtatattt

SEQ ID NO: 81175 - DNA, 1043 bp, Homo sapiens
agatccaagtcaggtccatatattgcaattggctgataggtctcttatgccacttttcgatctccttccacgcatttttaataggtccccaaccaagtaagcctcttccaggtggggtcactggatgtgacattggaggagctctctggatccccaggacatactgcagtccaccatcaggccccctattcccaccctgagtgtatggaaattccaggcactgaactccagtgcctgctaatcccaggactgcccaggttctgtttggaaggcccttctgtggtcttcacttggcttctctttgtcactcaggtctcaaccaagatgtcaccctctcagagagcccttccttgactcctctccctcatctaaagctcccccccaaccccagtcattatctaatgcccctccttactttcttcaagccacttaagatttgaaattaaggatttgttttcataacctgtgaaattatttgtttatatggctatcatctgtctctccatcccagaagttcactccatgagagcaggcagttttcgcactccctgctgtagttccccagtgtctagaatcctgcttggaccctagaaagcattcactgcatcagtgtttactgaatgcctactgagatgggaactgacagtttgtgactgtaaaatgatactttacaaactagtacatcccaaaccattgtgccctatatgtgagtcttcccttaggcacattgcctctcttttgagcagatgccaggcattcaagtcactgtgaataccctttgggctttttgcaactgtgatcttgaccagaagaaaactaaagagggcattaacatgaaactctatattcttcttttgctgttatgcacctgcctcagatttctctgagaaaattataaaggatcttttcccatttatcaacccaactctgttccaaaccacataagctttgctaatgtgattagaaattgttgaaaacagatctgccttgcacagaatttcctaaatggataattaagcattcttgtgacttagaacccttcg

SEQ ID NO: 81176 - DNA, 1035 bp, Homo sapiens
gccggcctggcttaggctacatcctaccacaaaagaagacagatataaggggagtttaccccaggctcaaaagatactttcccccatggcttgatgattagggaaggagctgttcaactctattaagaatgccaaaacctctgagctggtgccaaagtcaacaactcccgtttccattgtaaatccgtactcttctcatgccagtctattttgtatgtgctttgcgtcgacatccctatctttccatgttagattttaaattggctccctacagagtttgaggttgggccttagaaggatgtgatgaatcccttcacttgtaatatggccattcacctcctcctcttagcaaagctgctgagacataacatggcttcaataacttcccaaggggacaccagctgagatcatctctcctgggcaaatgaggcccaaacaaccctctctgttaagaggtctcatctgtgtatttttgaatgagcctgcctcccttggcaccctgtccctatgtcaccaagaacgttttaccctaatcctacagagcatcctggcagtccctctggactgaagtttatctttcctctcctttccaactctgtcaagaagattctgtaaataacatccacttgctacttttcttaacaccatgaatcatcatacacatgggtatagcatcccaatttgtagcctaggaagctaatctcaaaggattttgctcttgcatttatttatttatttacttattttatttttttgagacagggtctcactctgtcacccaggctggagtgcagtgatgcgatcttggctcactgtagcctctgcctccccggctcaagggatcctcttgcctcagcctcctaagtagcggggactacaaggacacacctgtagtgtgtagaggtggggtctcaccattttgtccaggctggcctagcttttatttaggtctgtgtgtgagcatatgtgctcatgcacaccctgaaatctgctttgatatccatgattatctagacacggttcttgtgacctacc

SEQ ID NO: 81177 - DNA, 1064 bp, Homo sapiens
ttgtacatttgatacatggtacctccacgctttggcactgctgaggccctgtttcctcttatcccaaggggcatctgggaacttctgtctggatagccaaagagcagtgtctgtctctctctccacacacatcccccgacacacacacgtatatatacacatatatatttctctctcttttagtatactggcacccatttagtaacgttccagcttgcattttctccagataggatgcacctgaaatgattgagcaatctcacccttttgcccacaggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgaggtgagtcatctccgccttccatcagggccttcagttagcccttatttatagagatgccccgacgcacaacacactgttctgtgaagaccggggaacactgtggccgactgagtagaagtttctgagtcttggactcaccttgttttgtctgcatatcatacattggagatgccccatcagaccccttaagcctgggatatgcagctgcgttttggggtcagatctgtaattggagaagtaaaaccccctttgatagttgctgtctcctagggaatctctgtcaggtgacttaatttgttcaggcttcaggagtttttatagaaacgtggattaatgaaagagcacaggagactggcaagctgggatctgaaagctgggccttgggatcccagatccctccttcctgcaagagatgagtcccagatggcatctggaagggatctgtagaaatcatttaatcagtgtcctcacctttaagtatttgtctctgtcaggcatcccaggcatcatcacaaaggagctgatctactgggtcaagctttctcccaccccttagtctcttgccagtagatgccccacaggatgagtcccaggagggcgtgg

SEQ ID NO: 81178 - DNA, 3057 bp, Homo sapiens
cctggggttaaggagctttaagaactccacaactgattctaatatgcagccgagtttgagaaccctttagagttctaaggctttcttcagctggtgcccattcagctccaaagccaagctgtactctaaaacctgctagatgccactgtcttgcctgccccctctttggtgaacaaggcagagtgagtagaggttggatgcccacttaggtgaccctgcggggacagccaggctaccctagccagctcacctctgcacctcctgtcctggagcaaactagagaacagtaactcactcagctgcgtttcccctgcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacgtgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccgtgggcatgggtccaggtctgtaacctgaagaagttgttttctgacaatcaccaaatcatccgaatgacatcaaaagcagcccttatctcagagactgagatttctgtggtctcaacttcgctttggtataatttctggcactcaccagcctctatcattatgactttccccccagtgtattatttctctaataggtttccttttcacgttcttttagcacagactggcactttaccctctcagtttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaat

SEQ ID NO: 81179 - DNA, 1071 bp, Homo sapiens
aaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatc

SEQ ID NO: 81180 - DNA, 1290 bp, Homo sapiens
gtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtggtgtggctatgtgtcctttgtatagtgccagttttccatctgaaaggattcttcctgtgtcttcaccaaagtatgagattaatggaaatacacaaaaccccatttttgcaccacaattgatgttagtccatccttgcaaacaaataccaaaaccttgaccaggccacaagtgtcttcacaaccccatcttctccgggcaagaaagccaagaactaaaataagtgaagtatctcttttctacttttttaattttttagagagaggttcttgctctgtggcccaggctggagtgcagtggcatgatcacagctcactgcagccttgacctcttgggctcaagcagtcctcctgcctcagcctaccgagtagctgggactacagggacttgccactgcacctggctaattgtttagtttttagtttt

SEQ ID NO: 81181 - DNA, 1881 bp, Homo sapiens
caatctcaccaacattgggtatcatcagaattttgattttgcgagtcgggtaggttaacaactgctatttcattgttttaaatggtatttatttgatcttgtttctcggtattgcaaaatcaaacttgaattggccctgtttttttgtcctcattaattttacaaagttatatctaaataagttgtaaagaaataaactttgtcattttcttctaccaggtgggatcagcaatatgtaatccaactcacctccatgttcaagtaagcatcatcttttcccttttctttgtgtatcctgctttgtgaacttacttgctagaaattaaactatagcaaacgtaaacatcactctctcctgattgtaagaatattagtagttatgttttctgttacagattcacagattccctcctcactcctgcctcctttttggctttacttacttatttaaaacataactttattttttttataagaatgactttgcttaggtaaggttattggttcccttaaaggttcttcattagagaaaaatcaaaagggacagttataataatctattatctctttaattctctgctcccaagtttcatttcttaaaatatgtttaatggaattttaaccactgtaaagccctgaattgaatttctgaaaacaaggcagttagacactgtctatagcctttagaatctttgatccacagggatgtccctctgactgcagaagaggtggaatttgtggtggaaaaagcattgagcatgttctccaagatgaatcttcaagaaataccacctttggtctatcagcttctggttctctcctccaaggtacaaatggaaaattgtttctccttagttctggtggtatgaccagttatgaccattcaacttattcatacccttggtttatatagcagagcaaacatagccgaacatagatgctttcatttcacgtgagcaaacatagccgaacatagatgctttcatttcacatatagtggtttggtctggtaaaaggatcatacttctcatccaaggaaaacatgcattatctcttgtattgccacattttctttgcggaggtaaaagggataaagatctcagaaagggtagactataggccccataaattcttacagtaagaggtatttcaaatcttgtttcaacatgaaagtgttctatacattcttagtttgagtctaagtcatagattatttatttaaatttgtactggagaattctttaagctgaaaactactttgaattcaaattggttattttgctgttaattgggagaccttaccaattttgtattgttttcagggaagcagaaagagtgttttggaaggaatcatagccttcttcagtgcactagataagcagcacaatgaggaacagagtggtgacgagtgagtaatatagtgtagaaataaagatcatttttacaaattcatcttctcattgtgtattttagctatttcattttcttctctctcaccgcctaccttcacctcagcacaaaacttttctaatcttctcttagctactcagtaataaagagaataacatgatctcttcagctctttcattttcacctttccaggaaaataattgtcctataagctgcaagtttaaaacctatttattaggtgtcagctctctgccaggaactgtttagccttggggctaccgtgctgaaccagtcagacaatgtccctgctcttgtagaacttcaattttagtgagaagaggaaagaaaataaataacaagaaaaatgttatagtaaaagtgctatgcaggtaattcaaatggatgatctaccactgacagtatagctactttagattgggtcagggaaaacctctctcagatgtgctattt

SEQ ID NO: 81182 - DNA, 1050 bp, Homo sapiens
gatggatagatagatagacagacagacaggagcagaaaattgggcagtagaatttctagtaaacacctgccttcagtgattgtatgagtttagcttgagttggtctacttgctcatcgtagcacctgtccttgtctctcactcaaaaaccatagctcataccttttttttgttgttgttgagacagggtctctctgttgcctaggctgaagtgcaatggcacaatcttggctcacggcaacgtccaccttccgggctgaagcaatcctcccacctcagcctcccaagtagctgggactataggaatgccaccacatcgggctgatttttttgtatttttagtagaggctggtcttgaactcctgggatcaagtgatgcgcccgccttggcctcccaaagtgctggcattacaggcatgagccactgcaccttatagctcataactttctgttgaatcttttaggctattggatgttgtcactgtgccatcaggtgaacttcgtcatgtggaaggcaccattattctacacattgtgtttgccatcaaattggactatgaactaggcagagaactcgtgaaacacttaaaggtagcatcaaacttgtaaggtgatctgggtctcttttgaatgaaagtgtttgaacttaagccactgttatgccagttaatgacaggaaataaatactgtaaaatgaccctgggtgtggaggatctctttttttttttttactttaaaagtggaaaatacatgatgttaccacactcccttttttttaatgtcctcactttagcagtataccacatccttaagcaagccagaaagttctatttaaaaaaaccctcaaaagttctaacgcaaaaaagtgggaaaaaaggtgagaactattcagcaggaaactcaaaatctaattctaagtagattatgtgtcactgtcttatgtgaccttcagctatggcctctgctttctcatttatgaactaggatgttgcatctagtagtatatcgtggagttgtgtgatgctaagtcattcatcatgaagtatttgta

SEQ ID NO: 81183 - DNA, 1034 bp, Homo sapiens
attcaaatgtaagtctttgtgtggacatacattttatttcttttgtgcatatatccaggagtagaactgctggcttatatgagaaatttatgtttatatttttaagaaactgcctgttttccaaaacggtatcattttacattcccactatcactatgtgagggttcctatttctctgtgtcttggccaacatttgttattgtctgtcttttttattatatccattctaatgggtatgaaacagtacctcattgaggtttaactttgcattttcttaatgactgatgataattgagcatcttttcatgtgctcattaactgttctaataccttctttggtgaaatgtctattcaaatcttttgcccgttttttgagtgtgttgtttgtcttcttaattaaaattctttgtatattctactgacaagctcttttttattttttcaataactttgttatgaatggtgacaagttctttatcaggtatataattagcaaatattttttctcagtctgtgacttgtctttttattttcttaatggtatcttttgaagtacaaaagttttaaattttggtgaggtccagtttatcaattttttcttgtagaaattatgcttttggtattgtatgtaagcaatctttacttaatccaaggtcttgaaatttttctatatgttttcctctaaaaatattacaatttttgctcttacatttggatttctgatccattcaaggacctatttttattttttattactattaaaaaatgttttttatgtctctcgagtcataaggacttttttgggggatgcagtggcgcaatctgagctcactgcaaccttcgcctcccagattcaagtgattctcctgcctcaacctcccgagtagctgggattacaggtgtgtgccaccactcccagctaatttttgtactttacaagacagggtttcaccatgttggccagactgatcttgaactcctgacctcaagtgacccacctgcctcagtctcccaaagtgctggcattacaggca

SEQ ID NO: 81184 - DNA, 1072 bp, Homo sapiens
gacttttagccttttttcccccttttttcttaaggaaggcttgtcttcagctccttaaagttcccactgaatgtcataatttttgtaacatcttcatctagttaaaatagttgtcatagggatatatgtgaatggcagctcataggaacagttataaggttaagatttatagcatgagctatataatatttgctttattttcttatttctttcattctgttaggtgcttgatcttttatttatttattttttcatttatttttattaactatactcaaggtgcttgatcttttaaagacttcggttgtaaagagctttaaggatcttcaactcctccaaggctcaaaatttcttcagaatctagttcctcatagatcttatgtttcaaccatgatcttggaagtagtgaagaataggtaagttggtgaaccatatctcaaaaggtttataaggtgtttaatgttagaaaatgcaatgtgatatcatacttgcagcctgtgaggggaaactgatgacttaacagctgttgacgtcacacatcgaggttcattttcttaaaactggtagaggatactttttccctatggaaatatccttgaatctcaggccctggtttcttggccaccttgacagcaagcatacaaaactgaattagttgcttttgtttattccatgatattacaattctctattttccttttctttctttcctttttttttttttttttttttttgagacagagtctcactctgtcaccgaggctggagtgtagtgccacaatcttggctcactgcacccttgacctcctgggctcaagcaatcctcccacctgaacctctcgagtacctggtattacaggcatgctccaccatgcccaagtaatttttgcgttttttgtagagacagagtttcgccatattgcccaggctggtcttgaacttctgagctcaagcaatccacctgccttggcctcccaaagtgctgggattacaggcttgagccaccggtcctggccgtttcttttcctttttaaaggaaacagtctcactatgttgcccaggctggagtgca

SEQ ID NO: 81185 - DNA, 1088 bp, Homo sapiens
ctctcaagtagctgggacaataataggtgcatgccactgcatctgactcatggcctctttttaaagtgagtaaaaaacattaagagttttatttactttgttgaaatttggagcgtacagttggaattcaattattgattagccagtttagagaaattcatttaaaaccacatggaaaacatcagtaactgtcctggtttttattttaatttcaggatatacattagctgttgtaacagtctttactatgtcatgctttcactgtgtattaaatatattttaaagtttcataatttaagcataatttatggtaggcctcttctaggcctggaattcttgtttattaatagattgaatttacatgagctttgcagtagggcaaatttgaaattagagtttattgtttgagtgttttacccattgttaggccttaaagctttttaatctttgtatctcattattctttttcctgaggtttatacttgtgtctccagtattttcccaacccaatctcttaaagttgggctaaagaaggaggtactcactaaccaggaaattcctggaaagcttcccatcttctggaaatctcaactgtcataggacttgaaagcatctccatgtataattagcctggagtgggtacttgccactgggtgggaccaaacctcagctgggagagatttggatagccttattagatcctctaaaataactggctggttagttacacatgcttgccccagtcagttaatgaacctttaaataatgcattctccattttatgtaattgaatttttggctcttcagagtatgaatattgttaactctgttaaagtcttataatttatccataactgtctacttcattctgtagtgctgcattataatttgttgcaatttaacaggtagatataatggataaaggttatattcacattatttccactgtggggtataacattaagtggtataaaaccaccaatgattctactcttttacaaaagattatttgtagttttagcttatgctgttgataccagatcactcatccatttatagtataaatatctactgagtgtcttttatat

SEQ ID NO: 81186 - DNA, 1037 bp, Homo sapiens
tcattggagaccacttgcctgctgttcccattatggtacatttaggaattcagaattctgtcagacgatgtgtgtaaagaaaaggtttatatgcagagtacgttgattatctaggtcaagtttgggaaatgtataacagggcaatgagtataaaggtaagaatatctcactaagtttttcttttttaactaagctttgtgttcttgtagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaaggtgagacactattttggcaaccactccctaattttgtttaaataatccaagtagggcttggcatttgcctgggagtttggtggacaaggaaatttgagtatgtattagtttgacagaggatatatgacagagattaggataatattgaaacattatagatccagtttgatggaatacttacttacgtattcttctatgtaagtttttcatttattccacttaatccaattgtttctgacctagaagtttgaatataagacagctttttcatgatttttccttcttcttccagaagtaaaccatttctagtttttgttttgttttgttttaatgctgttcctttacacagaagaaatttttttaggtcactgtagagcatcaagcttaaagaatcatgcttaagaatttttactgaaaataaaacaaaaaaagaatcatgcttggtcgggcatggtggctcaagcctataatcccaacactttgggaggctgaggtgggcagatcacttgagctcaggagtttgagaccagcctgggcaacgtggcgaaacctcatctctacaaaaaacacaaaaattagccaggtgtggtggcacgcacctgcagtcccagctacttaggtgactgaggtggatcacttgagcccag

SEQ ID NO: 81187 - DNA, 1067 bp, Homo sapiens
ctaagtcttcttgatgttcaattgtttaatgtagctacacaccaagagtgtctgctgaaaatgtttatttgggaggctgatctaaatgtaaatctagtgttctaatccagaactatgaagtaaatgtcagaatagttcttgagagttatcagtgtatttgatgatataaattaccctgcttaacagtgatattgttaaagacattatcttagagtatgtttttatatttaaattattatttttcaaaactaaagaggctccatttgatttcacatggatgtcggctttatcaaggcatctttataaattgctactaagtcactaacagtctgaggtctgaacgaattagtctgtaccataaagtaatcaagttgaagtaagaattttaactacaattcaagtgaaaattcagaatgggtctttttaacagcaactgctgtgcttctagaaactgagaaaggggttagggaagatcttttaagtttctagaaatcttcatgggcttttacattttaatttttagaataaaagttatgtatactgtcaggaatatggatattgtcaggtaatggatacctaagtagaattgatcctgtttgatgctgaaccttatatgtagcaatagtttaatgtgatctgtacttttaggctaataaacatggtatttatcctactaatgaatcatctaagcacagaacaaggggaaagttgagtgattctgtctttccagatgattcacattatattctgattttttgagttttactcatatccaaacggttcttcatgctgcctgacatgcattgatatacttaaaagctgaagggtcacccaggaatattttatttattctgttctttttagatccatgagatgatcagacaagaaattttggagcaggtcctcaacagggttgttaccagagcatcttctcccatcagtcatttcttaggtattcaactttgaaagaatgaataaagtttttagaaatattttcatttcaatgtcataatcatttggtcctgggaaaaaaattttaatgagcatttaaatgcagtatctttgat

SEQ ID NO: 81188 - DNA, 1281 bp, Homo sapiens
tttttgagatggagtctcactctgtcacccaggctggagggcagtggtgtgatctcagctcactgcaacctccgcctcccgggttcaagcaattctcctgcctcagccttgagagtagctgggactgcaggcacgtgccaccacacccagctaatttttgtatttttagtagggatggtgtttcaccatgttggccaggatggtctcaatctcttgacctcgtgatccacctgcctcaggcttccaaagtgctgggattacaggcgtgagccaccacacctggccaaattgtcagctctttatcctggcactgaaggtgcttgacaagttgatcccaccctacctttccattgttaaagtcagttatttactttcctggattcttcaccccagcatcattgatttccctaccatcttctgaatatgtcttaaacttacctttctcatacctttactcatacttttccctttatatatgtaggcctttctggtgctttgtgcatttaaatgttccccatcttttagaacctagtttaagttccttctcctcattgctttcctaatatataccaactcataatgagctcttcttcctttgaactcctatttaaactctccctttaccatttggtaggcaataaactatgtttggaattaatagatatttgatattgctctgtgatttacctctttaattctttaaaaaaatttttttacttccaactaaattattaaaatttttgaagaaagactatgttttatacttttatgttcctaataggaccatattacgcttgtgcatagtaaaaattcagaaatatttattgatttattttagcttagaagtaagaagatgtgtgctactacttatgtctaggcagtgtaatcggtttcttcctttcttttaggcagtttaatttttatagaaattgaaactatcatagaaaaaagctaaaattatcctggttacattggagaaaaagtatatatagaatcagtagaaatttgtattgcagtatacttgacttatttgagaaaggaaacaaaagacttcacatttctttctccgtatttttcttttatttcagttatctttagttatttgagacaactgattatagattctgtttttcagacctgctttcaaatatcgtcatgtatgcacccttagttcttcaaagttgttcttctaaagtcacagaagcttttgactatttgtcctttctgccccttcagactgtacaaaggctgcttaaggcagtgcaggtaagtcttcagatt

SEQ ID NO: 81189 - DNA, 1030 bp, Homo sapiens
acttgtccttcggaaagctatgtttgccaagtatgtagcatctttttctatcataggaagacgttgtcttctaatgttggagctaaagttatctctgccatctcctagtaccacctgttcacagtgatcatgagaattcctagccccgcagagcaatttcatcaaataaggcattttgctaagtgctttatgtgcttttttcatttagtcttcagagcaaccctatgaagtaagaattattgcaattcccattttacagataagaaaagttaggcttagagaagatgagtgactttccaaaagtaaaacagtagttggtggtggagcaaggattcaaagtcaggtctaacatcagagcttgtgatgtcaagtactttgctctactacattagaataatcttcagggtaatgttctagtgtcaaatactctgaaacctgagctggcagcagttccaaaggggaaagtaccttagtcaagaagattatacttaagaatctcattttagtgaacatctgaattatgatctagaggctagtagatcaaattaattgttgaggggaatgagttttatttgtagcttagccagtccctcctaacatctcttcctttatttcttagtatataagctagagatgatcttgccatctcctaaaaatataagacagtaatatgtgaaaagcatttggtactttgaggataagatgcccaattaatatcacattggccatattataatatattcatgggtgtccagaggaacaactaagccatatgctattatctttgttctagaattaaaagtttttgttactcctcacccaaaggcatagcgaatagactgagatattacgttgtaacatctttaacatgaattaatcattgcgcctcagtgagaagacaagtgtgacattttctggatggacagtttacatggcatcaaatattacattatcctatgatgaaagagagcatatgaagggaagcactccttcaaacatggcaaaatcagcaatttcttacatttgagta

SEQ ID NO: 81190 - DNA, 1962 bp, Homo sapiens
aattgtcttcataatttaaatgatgtactataagatttataaataggagacatttatatataacagtttgactaggaatcctcactttattgctttggtataactacataaagctttgtctataacatatagcatagattaaatattaggaacactagatatcatttgtgtgttattatccccattttaaagacagggaaactgaggctgagccaggttaaataacttgcccaaggttatataaccaagaaagggtggaagaaggatttggcctcaggcagtatgaactacattactgtgatgcctggagtaaggattaggaattcttggtctataattgctgattttattatgtaatttacacaaaggatgtcagttctttgtcatgtccatttctaaacaaaagactgtcttcctctcaacctttctagaatttgtggaatagtgagattcttctagctattgaagaagtcttagaccttttaaataaaattatgtatattgttactactggattctagtggcttgaaataagcagtgtaccttcctaagcaattgatattgtcaaggaaaccttaaggaatatgaacagttaattttgttaaaatgcttaaaaattctcttattccaaaccagaataagagtgacacttactactgcatggtaatgattatactgtgtgtctcacccctggggtttggcatgtggaggaagctaagttttttcgaccaagaacataggctcatttagctccttattggaaacagctttggtaagatagacgtgaattggcctgtcttcctttcaggttcatgtggatgttcacagccattacaattctgtcgccaatgaaactttttgccttgagatcatggatagtttgaggagatgcttaagccagcaagctgatgttcgactcatgctttatgaggtaagtccgtagaatggaaagaatgtagcaaaaccccaactaataatttttattttagtaatttttttcctgattataaaagtacaatagctatgctcttacttgatgtagtcagcaccagtagctagtgatgtttagtcaaaaagttgtttaaggcagggcacagtggctcacacctgtaatcccaacaccttgtgaggccaaggcaggaggatcaagcaagactctgtctttacaaaaaataagaaaataaaaaacattagctgggtgtggtggcatgcgcccgtggtcccagctactcaggaggctgaggcaggaggatcccagcagtgaggctgcagtgagctatgatcacaccactgccctccaacccaggcaacagtgagaccttgtctctcaaaaaaatttttttaaggtgagaaatcataaaacacagttgatagaccttaaatattttattttaatttgaaatatttaaatatactataaatttgccagtcttaagactaagtccttttttttgctttgttaatgattacaagtttacttcctgcctctcatacaaacccatacccttaatttattgcctatagtttcaaatttgtgtttacctaaagtggtatgaaaactttaagctacctcagatacagtttagcacaaaaatcttttagatagcttcagttttttctctttttacaattgtgttacctctaatttatcagaaattggtttgagagactgactttccaaacattgttccaaacttagtttttttttttctttgggacagagtctcgctctgtcacccaggctggagtgcagtggcacaatctcggttcactgcagcctccatcctccatctcctgggttcaagcagttctcctgcttctcaacctcccaagtacctgggattacagccatgcaccaccatgcccagctgatttttgtatttttagtagagatgggatttcaccatgttggccaggctggtcttgtactcctggcctcaagtgatccacctgtctcggcat

SEQ ID NO: 81191 - DNA, 1028 bp, Homo sapiens
gggattacaggtgtgagttacttcacctggcttccccaggattttactctgagcagttcttaactaagactaggacattttgggtgggaaaaaaatatggtcatttatattagggcatttaggactgtcaaatatggtctcaataggaaaaaactgagaagaggataaagaaagtgttatttttaagttatgattgtccagatcactagtatctctgttaaagtgcttatttcttctctttgattcctcttaggggttttatgatgttcttcgaaggaactctcagctggctaattcagtcatgcaaactctgctctcacaggtaaaatacatttttatggatatatggaaaacagaccatcaaggatcgagagacagttgatggttttcagacctttcaaaatataaaataattcccaactagtacattagtactttgtgaacatgctgtgggtatgttatgctgttctgggttgtcttatctcggtcaccacttacctgtctgccataataccatcatctagcagttatccttgtgaattaacagtctgtatcctaagtcagaaggacattttgaagaaccatttatataaggaccattgcaactgtatccattatgttatatttctgaaagaaaaaagaaatccaaaacaaatatagcaaaatattatttcttaaatctgggtaatggatacatggatgtcttttacattcctttctgcacttttcagttaacaaatttttaaattagaagattaaattcttctaatcttcaagactagaagaattcatatagagactctctaccaggagggttcctttagacccctagtctatcattttgtttgctgtctctcaatgccattgctttgtgatagttatgaaatttcatttaaaattaaggtctcagatgtgtgaaattattggaagttcccatactgtccatcaaaagcttttcatctggccttaggcttgatcctatataaaatttatattctgtcagctatattgtatctttcaaactgtaa

SEQ ID NO: 81192 - DNA, 1067 bp, Homo sapiens
ccactggtgagacttttattcttccttcaaccattatttttagtattaaggatagggttgaactttgcaaagagatacctttccctgtgaaactctcttcctggttcttccaatgaatgtttacttttaagtcttccctgcttatcatttctgaaccattatcattttggatctattggtaagttatctccatgttagccctttactaaatcaaggcttccatcacttcccccagagaatattttatctcatttatgaatctttgattacattcactaaataaatgtactttagaatggggagagggatgatgtcacctacgaacagatgaacctaggggacctgcttcattagtctagaggaagtatatgatttaggctgaactaggattggcactgttgaaccttcagaggagctaggcctggttgactttctgttcttatctagcctcagaaggacagcgaagaggataaaaatggaaactcccaccccaagtgacttataactcatggcagaagaaaggaggaagtctttcagttgtcatatcttgccttcatttttgtgccttctgtgacatgagatgtcctcagcctagatctaagatgctgtgttggtctcctaaagattccctcaacataaacctctatctttagaatagcctctgggactcaaatgaactagagaagatttaacttcaccacctagctccagggttatttatcagaccagagatagcacatctaatgttgcattttgaggtgtcagccacttaggccaattttcggggggaagcattagaaaaggatgctgctgttcaattaattttcccagttttgttaatttagatggacttaatttgtaacgccaatgaatcattttctttagccttatagataagaattatttgctggttatgaacaactttataagttatccatcaacactcaagagtatttaatttacttattttctcctacaggattatctgctgtgttgtattcagcattgtttggcctggtataagaatacagtcatacccttacagcagggagaggaggaagaggagg

SEQ ID NO: 81193 - DNA, 1046 bp, Homo sapiens
gcaggagactcacttgaacccaggaggcagaggttgcagtgagccgagatcatgccattgcactccagcctgggcaacaagaacaaaattctgcctaaataaataaaaaggtagggggggtgactgaattaaaaatacaaagggacaaaaaaaaacctaaaagactaagactgacatttaaattttatcaaagtaaaggatttggggagggagagaaaatgaggaaccactaagaataacgattataaaagggcagccatagcagtgactatagcttgggctgcctagagagtctgccagtcggaacttactggcaagctctgttgggtgctgctgttctgaacaatttctagaaagcttaattccatataccaatagcagtaagggaatcttcctttttctttctctctctctgtctctctctagggatagtatccaaagccaccaagaaagcctttctgttctcaggtccagcaatgagtttatgcgctatgcagtgaatgtagctctgcagaaggtacagcagctaaaggaaacagggcatgtgagtggccctgatggccaaaacccagaaaagatctttcagaacctctgtgacataactcggtaagccactcccaccccttagaaacttattccacttggctgtggtgtctccaagagaacaaactgggaacagaggatgaaggtaatttgaggttggacatattttaggagtgaaagaatataaaacattagccaggtggcaggcacttgtaatcccagctactcaggaagctgaggcaagagaatcacttgaaccaggaggtggaggtcgcagtgagctgagttcataccactgcactctagcctgggtgacagggcaagactctcaaaagaaaaaaaaaaaaaaaaaagccagacatggcagctcatgcctgtaatcccagcactttgggaggctgagccgggtggattacctgaggttgggagttcgagaccagtctgaccaacatggagaaaccctatctctactaaaaatacaaaaattagcctggcatggtggc

SEQ ID NO: 81194 - DNA, 2003 bp, Homo sapiens
aaccaaagatgattaattcagaaagtgtaactatagtcccaaagcagaaacacctctgcagagataggttgtatgtatgtttgtgtaagtgtgcacacgtagatgtagagctgtgtacccacatgagcgttcacacacagaagaataagagaaggaccacttgttgggggtctgtaccattcaggagtaattttcctgtaggatgatagagtaccttcaggagcccaggactgtgtgctcctaccacatctacttcctgggcttgagaaagacaatgaagccctgcggtatactcctctttatgtgagcccttgcctcagaagactgtagcctgggagtatgaaggcgtttgggcactagaaagcagagctgcttcctgtcgtcctacttccaggtttgcccaaagaaagtccctttggttacttcatcccagttccaaacagctcacccccactttgctctcatcatcgttctttcatactgctgtttttgctgcaaagaggaaaggactgagaaagaaatagctaattggggcagggggaaatttgagagaaaataaatggatttaggaaggctaaaatgttcaggaaaatttaaaaatttttcttttttaaacttttaaacttttagatttttaaacgttttaccacctaccccttctcccttaacttcaggtagtctctttaaaaaaaaattttttttttttttgagacagagtctcgctctgtctcccaggctggagtgtagtggcgccatctcagctcactgcaggcgccgccttccgggttcacgccattctcctgcctcagcctcccaagtagctgggactacaggcgcctgccacaacacccggctaattttttgtatttttaatagagacggggtttcaccgtgttagccaggatgatctcgatctcctgacctcgtgattcacccgcctcggcctcccaaagtgctgggattacaggtgtgagccaccgcgcctggccaaaaatttttaattttaattttgaatgggtaataaagtcctatgatttgaaaaccagagattatcaagagatttatggtaaatggtgtcccccacccatgtcctccatctgttcagttcctcctctccccaaataagtaaacacctttagttttttgtgtccttcaaccttctttattcccttccaagtaaatatagagttttattcccaatcctacccctcttcacacaaaaacttgttctgcatcctgcttatttcattgagcacggtattctgaagatcttttaatatcagtttgtagagagctttcagttagcctcttaatttaccttttcctcaacagatcaaaactgcatttttgttagtcatttacacttaagtataacggcatttcggtgcctttgtagctgaaagaactgctgaagcagaaagttgactgtgtgtctggtgatgcagatgcttgctatctgaagaccttaagtctccttcacttagctaagaaaatgctgtctggtttcttgcctcttttatttctcttttttctgcccttctctcttctaacctcctttgttcttttggcttctaaatgctaattctactgttcttatagctaggttttctctttcccacacctttctgataacctaatatcctcaagtggagagtctgggggcatgggaaagaaaagagggcgctttagccctagaccactatggtagaagcagaggaagttcaggtgtaaggaccctaaaacttttggacctcagtaaggacatagacattgagaattaaattatatattattctcataattcttagaattttggacttatttttatgcccttcatcatatattaccacttgagatctaaggacatgttttggcagctgatttgcttagatatggaaaggtctagaactcttctgttctgacaacacctaggtctatctctggcatgtttctttaatatctgaatgatctctaatttagtttgtgcagatgttatcctggac

SEQ ID NO: 81195 - DNA, 1112 bp, Homo sapiens
ttatattacccccacagctgtgtgtagtgaatcacaccaggcactcttttctttcagttacttgttctgagtcaggccgagaaggttctagaagaagtggactggctaatcaccaagcttaagggacaagtgagccaagaaaccttatcaggtaagataagttcaactgggattccaggaattgacatgagcaaggtcaaaattcatattgggtcggtgcataaaaatggagcccctgagctaaatttcttatttgcctttaagctagattttttcctatgtgatgaaagaagtagaagatcatatgtcttatcacagcacgattaattcactctgcatattgaatgttcgtttttccataaagactttctagttagtagtaatcaatttctaaatctcctttactcttaattagaaaacgaagttgggtttgaatgtgccaattttatttccctttagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatatgtgagtatttgagacaagcagattcgccccaccattctaccccagtgagccaggagatgaggatggggcagcagcccactgctgcagaatgcccctaaacaagagagcatttgcctccatcttggcaggtcatggtttcattttagtttggtcagtaggtggcaggcatctccacaggccagggaaaaacagtttataattctaatctgcttttgggcctgtcacggtggttcatgcctgtaatcccagcactttggtaggctgagacgggcggatcacctgaggtcaggagttcgagaccagcctggccaacatggtgaaaccccgtctctactaaaaatacaaaaagtagctgggcgtggtggtgggcacctgtaatcccagctactcaggaggctgaggcaggagaatcgcttgaacccaggaggcggaggttgcagtgagctgagattgtgccactgtact

SEQ ID NO: 81196 - DNA, 1213 bp, Homo sapiens
tttaatctaaactataactatcctagaattaaatctgggcccataatgcatagaaattataccatttctaaccagtctggacacttaaagagatgtttattccttttttcattcctttaacatgtaggtgttaaatgccttatagatcaaatactaaggtggggaagaaaattattttttataaaaatacaaggcataccctgcccttactgtttatgttcctagcaatgatccatattaaatacttagaaaggcacagataatccaagaaagatgtggaccaccccgcatcacagcagtgtggctctctcagaatgtgtagctctagctacatgtggctaagctgctgtagtggaaatactgagagcctcttctctttattggcatctttaaaaggaaaaacagcaaagttgttggttttttacatgcagggactaccagcctgaggaatttttaaagaaatgagcaaatcagaaacaaacccttcattacttattgtctgggaagcttaggagctttggaggagaggaataaggaagcttgtgtcttggcttctctgtgaattttgtttttcctcttcagtcagaatgatgagtcacactccataggctcactgcagcagtcacttgtagtttcataggacagtctactaaatctaggaatctttttttattagtatctccaggtgtgtcagagctccggaggaattccaaaaaatatggaaaagctggtgagttgagaatgcctttcctaggaatgggggaagcacttttactgctggttacattggtttccttctcccttgttgtgcaggtgaagctgtctggttctcatctgacccccctgtgttattctttcatttcttacgtacaggtaagagattcagaggcagtacccaataggtcttcaagaaaggatttcttacatgcccaggggactattgatcacctgaactgagcatatataaacttttttccctgcttaccacaagctggaggcacccatcagagaccaagccaaggcttgagggctttgcagcaaggacatctttatgtaaagaaaactgtttcacttaatttggagaaaggaagcatatatgtttgcatttggagcaaggaaggaacaagcatgctcaggctcaaggacttggtttattcctgggtgactgaaagtccatgccatgaggcatcctctgggaatgtgagcagagtag

SEQ ID NO: 81197 - DNA, 1962 bp, Homo sapiens
tgatctatcctgattattgggtaaataacagatgtttacaatattcaacattgttcccattgccctcttaatcatcatctccgggaggttatgcttaacaaagctaaaagtcctcatttatgcttcaaactctggcccaattggaagtgatttcgtatattaattaataaagtgtaccaaactgggaaaaaaaaaaaaagtatgttgagtccataattgcatttcagtatctcagtgggaggttaggctgctggatggaaaacagtgctggaccttcacctttcttgacttagctaagtgaacagatggggtgttggtccaggggaagccctgctctaaggggtgtggggtcattgctccaggagtgatgcatctgttcacaggaggggcatgactgtgagagtagattgggtctctttcaggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgagcacaacacatttgttcctcattacacataggatctgaggtggactagaaagtgggtcttggagaacaggaaacttggggccccagagaatccactcttgactcaggctatattctaggctaatttcagtttataaggtgccctgtgtccagagtgaatgtgatatgatgtttcagaaatgaaggcagcagagcttcaaatattctacctgtacctgtcccctacttcaaccacagaagaaatgtttaaagataatttattctatagagtgcattcttgcactctataggtgacagaaaaacaaactgtgctttaaataccaaacaagtaaatcagaaagcttattttctatttaaaatatatctaagacacacttatataaaaagaaaacagaccctcctaacatgtaacattaccgttcgtggcaattgttctcaacctttcactctccttttgaccttagcattaagctcctttgctcacttctgagctctcagttacagttcttgaggtggcatcctaaccaatttgcactatctttcaggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaagactctatcttctcatcaaagcctttgttagtcatgctttccccactttcccactcacaggaggtaattatgttgttgaagaagaggaaggagtcctccaaagtgtagagtaataagacagtggcacctccttttaggacttttgctatactgaggatacttatgggacaaaatgacaagagaagaagccattgacatcaaaatgctacatgactctcctgagtgcagctgccaagtgggtaaagagagtggatggggccaggtacattagagcctggagtgtgatcatctgaagaatgcatgttcaaaattctgaaatccag

SEQ ID NO: 81198 - DNA, 1198 bp, Homo sapiens
ctcttcttcaacaacataattacctcctgtgagtgggaaagtggggaaagcatgactaacaaaggctttgatgagaagatagagtcttttttttccttctttttatttccactgccttggagcaggtttatcacgttagagcattaattctttccccttctagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaacatttcttctgtggttgaagtaggggacaggtacaggtagaatatttgaagctctgctgccttcatttctgaaacatcatatcacattcactctggacacagggcaccttataaactgaaattagcctagaatatagcctgagtcaagagtggattctctggggccccaagtttcctgttctccaagacccactttctagtccacctcagatcctatgtgtaatgaggaacaaatgtgttgtgctcaccctggggaatcccgtatctcctttccatcccagttgggttggaaggggttttacaa

SEQ ID NO: 81199 - DNA, 1254 bp, Homo sapiens
aaaagcctttaggggactggcatgatgtcagtgtttttaaaagttgaagtgatatgtgaacattccttgccaaggcactagcgtggcacaggaagcactcccgtggaatgatggtgataacactgcccccaggtatcggctgtcggatgagggcgagtggctggtgagggagttgaacctcccagtggacaggactgagggtggctggatttccctgcaggatctgcgcaaggtccagagagaaactgcaaggaagtaagaaccttctttgtgttaaggatggagggaggggtctgggcttgccccagaagagcttggatgctttgttttttagctttgagatgctgaaagacaaagtctgccctctgtttctggtcccttaggtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagaggtatcttgctacctttggagcatgggcagaggggccccagggagggcagggcagagctccctgtggaccttaccaatgtttgtaggtagggccagagtgaagcttctcttggggcttctaccctggagttaattggtatgtagcatagcccctttcacctctgcccaccttcccttcccagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccaggtatgcggggcccatggcctctagcctggccatgtgctcctatgtggggctttgggtgagcgttccttgggccagactggtcagttttgacttttcatccccctagaagtgaatgtttcagcttatttatttatttctaatttttaaaaagttgtagaagtcctaaaaagactagcctcaattcgtaaaaaaagagttattgggtttgaaaatgtgaaataccaagactgatcattgagggaagcagtgaggttaggggaattgttccgaagggtggtactcacgcttttctatttggaaaatcaaatgaca

SEQ ID NO: 81200 - DNA, 1048 bp, Homo sapiens
aaggactggtgtttctctagaggggtggggagggcagatctgctccctcctctggtcagttaccctggatgaaatggagcttgggaaggagccctgccctgggtcagggtatgcttttgtgtcctggcttctgactagtccagtgggactgacttagtgtctttgcttttgaaatattcttctagaggattccatgggggtcctggctaaagcatcccagaggaggggatggcggctgtaggctggggtcaccagaaagccccagggctttggagggtgggtggggacattgtgagagagagaaccttccccccaacaactgcccttaccatcgtgacactgctgtcttcctgctgggacgtagatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacaggtaaggcttaggcccaggggaggaaggggctggagcctagggaccccttcccctggctggtcagctcaggctagtggaaagagtttgggttcaagagtctgggttcagaagaagggaaaacaggaaaaaaattaacacacacacacacaccctctctctctctctttctctctctctcactcactcactcactctctctctcactcactcactctctcactcactctctcactcactcactctctcactcactctctcactcactcactctctcactctctcactcactcactcactcactcactctctcactcactctctcactcactcactcactctctctcactctctcactcactcactctctcactcactcactcactcactcactctctcactcactcactcactctctgggttcaggttttttcttccatggctaccctt

SEQ ID NO: 81201 - DNA, 1050 bp, Homo sapiens
gtccagggcccagatggacaccactgaacagaagggctccattctttcagcctagaaaagctaaggtccccaacctgagatagaaccagcgccacctgattacagtgggcccgggtaccaggaacacactgacccccagagattcccacatgggctccccctcacctctccaagaagagcggtagctgctgctggaaaacctcatgggtggcccacacgtcctgggcacagtactgcatcaggtcctggcacaaggtgacaggaaggcgcaaggtgggcagccatcccattaccaccaccagctctcagggtcaggcctggcagctgcatctccccaagtgcagctaggggtgtgccacagcccatgtccccagagccccctccagcaccatacctggaagttctcacgaatgtccttcatggtgcccttcacaaacagttctcgaggctccttctctaagggaggcccccctacataaagtctgtgcacctctgccagactgttgacactgctgatgtccagccagtcccaggatgagatctggggaaccagagcaagggacatggcagatcagcctggcctcgggccagacgggctggtgagagggggtcccaagcactatgctcctgcccaccggcagtgtgctctcaccgctgggcctcttctggctttcctctgggacttctggccttgctttgtggggggctggaccttgtgtttgccctgcttggctgctatccacagactgcgctggaagctgcttagccctgagatggccatgtgcatgctcatggtgtccaggaaacgcatgcgggaaccctgaggaggaggaggagaaaagggaagggaaggagggaggctgcaactgtggggccagcccaccactgcttggtggtgtggacctccagccccacctcagctcctcaaacagcctcccctcccagcacacagccttcaacaccaaatacagaatcctcatgcttgttcatgcttgccccatcacctgtaaggggcctgccttcccaaatcctagccaccctttaagatgc

SEQ ID NO: 81202 - DNA, 1029 bp, Homo sapiens
ttaattattttgggcggtagaaagctcccttttgtgggactgtcccaggcagtataggacatttagcatccccagcctttcccataaacgccagaccaacacccccccgcccccctgcccccgccggcaacgtttccagacgcccccttgaggtggcatctggttgaccacccctagttgagaaacattgcttccttcccccagccttccaagcaggcattttggtcccaaacaagtatatccaatctctcttttctttttaaataactttctaagtgctacccaagtttctttttcaaacaatgatggcagtactgtttctcccctttttttattcttcattccaggattaaaatactatttacaaccttaatgctttcaggcatggccagcaaaaaagttggcagtttctttattcctattggaagctacatctttgtaaagaaagctgcgaaatgttaaatatgcagttgaaaatggtgaaaacatggctaaatagataaggtaggcattaatggctgaaaagagcaaaactagatgattctgcattgattgagttccagttacaatgagaatcacactacttagaatatgtaacttgatggtcaaagtaaaggggaatatcggccatcatttgaaaagataaagtaggctttggtggctgaaagaaaattaggaaaccagtgacaagaaagatttgttttttgatctgtcggtcattttaggccaaattacctcaagtccccttttcttttctctttctccttctttctctctttttacctctcctttccctccctgtccttccctgctctgccctcattctcattccattcttgccagtggtactcggggcattgcttagttgacctgatggcagaagtcactgttaaggcctgggctcatgctgggaccttcctcctgggagtctgactggtgggtgggggtgggtgccacatggtgccctaatagcggtccactttgaacctgggcatgcccctgccccttagctgagtaacattaggtacc

SEQ ID NO: 81203 - DNA, 1040 bp, Homo sapiens
gggcctggggtcgggggagcagcagaccgggaagcaccgtgaggaccgaggtttccggcggggtcggcggcggggaggccgggtcgctgagcgacggcgcggcccctccctctccagtcagggagcgaggcccggagcagggcggcggctagtcccagggcgcaccgcggcgcctctgccgggcgcaggcgggcggcggggcgcacgggggtggccgccgactcctcctgcaggacgctctcggccgggtgggccgtggtccgggtgtgggtgtgggtcccgggggacggcggcccaccctgcgggttcgaatccgggcgctggcacctctcgacgctaggcccgcgccggtcgcggtaatggcagccaccatttgccgagcgcttgccaagagcagggccgcacgacataggcgccctgtgtcccccagacagcagcccggtgtgacaggcagaatccgtaatcccattttacagaataggatatcagggcctaaggagctttgcccaaggtcacacagctcgagagagccagaagcggggttcaaaaccgcgtcgccctactccagatactgctctcttactcgctgccctcggcttccccacgtgggttcactgacgaagttgcgtggaccccggttcccccaggaggggtattgacgtttcccaagttttgaggcttaacggaaaatgcaactgaagcgcctggcacagtgttggggacgcagtaaatgctcaaggaatgatgattatggatacacctattacatatatggtaaaataacgctttatatcatctgtctcctttaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgc

SEQ ID NO: 81204 - DNA, 1013 bp, Homo sapiens
tgggtagttcctacagggatacatggtagaaaattcaccaaacccagtgctggagtgtatttacaccccataggagccaggtggccctgagcatagattgtacaaatagaggtccttagcaagactggcatctaatgcagaggtctcccagagcctccctcttgtgtcttcctgttggtctttgttccttagccttgtaatgtcaagtatattcatttctgctcatttctgggttgtctgtttcaaaataggtttatgttgcagtctccctgaatttgattgatcataaaattatctatttcataggccatgactatgtatttggaaactgaagggaaaggctgatgggcacagctggggcttccctttctatccttgtgtgcttttcttagatacttggaccacattctcatcctcttctgaaaatggggagaagttgctgttgtcaagagctgtgctgtcctttatgataaccactagacacacatgctattgatctcatgaaatgtggtcagtgtggcatgttgaaatgataatgttgggttaagtacaatatattgttaaaatgacctgttcattcttactttttaatgaggcttctgaaacatttaaaattatacttggaactgacatattttcactggacagtgaggtctacactagatgctcaagacctcctccatccccagtgcttagtaactaatcctgatctccccccaggaggcctctggccacacagggttctgtgcatagaggtccatggaaaagctagagaggaggcaagtagagagcctcgggccttaaggggcttttaggagtgcctagttcagccctttaaatggggattaccccccagtccttggaggcagaagtcgtggcttgaatctgcaggcaacattgtatttttcagcatttaaggtggggacaaggcagccaatgggtaaaccccagaagagtctttggatgaaggtttagcactgccccagtggagtttgaatgggcacagctgtaga

SEQ ID NO: 81205 - DNA, 1126 bp, Homo sapiens
aaccatttactgagcactgactctgccaggttctgtgctaatgctttgtatattgtatctcttttgagggccatctcttggggagaaaaaagaacagtaaatctgaccagggatttgcccttcttttctaagccaaatgccatttgggtgactgcatggggtgtgttacaggagctacaaaccttgcataggagggactatcagcccccagtgagtccttgtctcccagagaatcagcctgggctttgggaagcagcatgagttcatttgcgttgccaaaggatgcctctgcagtgtttcctgcttgaggctggcagtacacctggagaatcaagatgggagggctccatgctgggcccctgggagccttggtgcggtgctagaggggtgagcagcataccacccggtctggattcatctcctaattgtgtgccccatatccttgctgtgcctcagtctgtaaaattagggggttggcccaagcctaccagcctgcccacagtgccaagggattgtggctgctcgggatgatgctggccttttactttctgcaatgttatatccccctgatgtagcacgtatgatcttctggaggagggaagggggcccacatcctctgtcccatctcatcttgtccttaagcagagaatatcaagccttcctcctatctgcccagttctgcaccatagctcctgctgtctccttaggttaggagaggtggcacatgcctctgaaggcatgttacatccttgatgagtgctgggggaaaagggagtaaagaaacaagtctcaagtttatagccaccccttccctttgaatctgtagcttttacccagtattgagtccactgttctctcttctactgtgggtcacagactccaagaccatggtggtgtgaggcagaggcagtgtggcccagtgggtatccaggtggaggggttggtctgacctaattcagaacccacaggacaccccttcccctcttcctctgagccagttttcccatctgcaaaattgggaatagtaatacttaccttgtgacactcaagatgcatcccccatcttgctggtctgtcacgagtaaaggccaggtaaggtggccagcaagggaccagggtcagtcag

SEQ ID NO: 81206 - DNA, 1040 bp, Homo sapiens
ttcacagaattttttttttaacagcaggaaggatgactgtagcctgtggattgtactgcagtaggaaactgtcctagcaaggctccactttgccccagcttcaaggtatatcgtctcaaaatgcaggggacttcagatgagttttgagcaccctttcttttattataaaaaaaattccagacagttcagccaatactgactaagggctgagaccagttccatgcttttctgtctccagaggaatttgcttccatctggatgcctgaaacggtattttacttcacctcctgtgtcaccggcagcagtcctgggagccctggggaggaggtttttgggagagccagctcacagcctctccatcaccttttagccaccccagtgctgggcagccagggtgtgggcttttgactgaatgcacttgccctcctgcattcattacaccattgtcagtgtgtgtgtctggggctgcctctgggtgtgcatggttttttttgtgtctgcgtgtcagtgtcaggctatgtgtgtctgtttctgtcggcctgtctaggcgcgctcagtgcaacaaggagctgggggaggtggcggtaaagaggaagggcatttcaaagcccagctgtcctcctcagggacctcaggagatgcgtgtgtgtgtgtgtgtgtgtgtgtgtgtgtgtgtgtgtgtatttttttccatgctgctcattgtgtggggctgcatgcgagtgtctgaccaggtgtggtgtgagcagccgctgggctgggtgagccccatctgccgtgagctcccagacttgccttctagccctctgccgccatccatggggagcctctcccttcgcagctcaccgtctcttctctaatttattagctggaaaggaggagaacatgaaacattgcttgaagacaatggccgagacagcaggtcccaccctgcacagccaccagcatctctcccctcagccctgtctcctcttctgcagttgggatctgcacatttaagcctgaagtaagaataaaacaaacccccaaaccaccctatt

SEQ ID NO: 81207 - DNA, 1073 bp, Homo sapiens
atcctccctgctggccttcctgctccctccttccatccagtaccaccccagctccctccttcctgcaggaaggcccccctgtctcttccctggacatagatcctcttcatgggtaaggtaaaggaaagatcccaataacaaggccctggttaccagcagaagaggtgtgtgcagagtgagagataaggatctggaggcagaaactgcatctggttggaggaaacaggaagacttcctgaaagaggaggcagtaaaaggaggttctggaaaagcaggtagaagctacagggcagggaaggaccccaaatatggggcatgttcaacaatagcaaccagaccacatggtgccctgagcccaagctgtctgcaagcagcgggggcctgagatgggctgcatgggaggtgggcatctggtgtgtgctgctgtactagtcctgtctcgtgtggtttcttttcattcttggagtagctctaaatgttaggtgcccattagtgtagatgatgaaactgaagctcagaaaggttaagccacaagcccaaatccatatatgaccaaagtccagggcctccagtgccactttttgctattgccccagcttctccactggcctgtctccccacagcctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgagcagggctcagaatggggatgaggtggtgggggtgctttgggggacagcagggtatggagaaatagacagctggggagacatgccagcctggcgagtcacttaacttcctgaacgtcactcagttttctcatctctaaagtgggagtaataatatctaccaggcaggtactacagtccacctagcccatcaatccagcacgtggacagagcagggcttccttgaatgttgtttttttccccctcctttctttcccacacatcacatggaatgaataggatatccctgcacatact

SEQ ID NO: 81208 - DNA, 1388 bp, Homo sapiens
caagcagccaataggagcaaaccttggaaactagctcccccaatagcagcagttcctggagagcgcgggagcctttcgaccagggtcccaaaggaaagcagtgagtggtgctgtttccctgaaggaagggactaagggacggtggcgcgggcccggaccggggccccggggcggcggcacggccgatatggcatgctgtcacaaagtaatgctgctgctggacaccgcgggcggcgccgcccgccacagccgggtccggcgggccgccctgcgcctcctcacctatctgagttgccgattcggcctggccagggtccactgggccttcaagttctttgactcgcagggggcgcggagccggccgtcccgcgtgtctgacttccgcgagctggggtcccgctcgtgggaggactttgaggaggagctggaggccaggctcgaggatcgcgcccacctgcccggcccggcgcccagggccacccacacgcacggcgccctgatggagacgctgctagactaccagtgggaccggcccgagatcacgtcgcccacgaagccgatcctgcggagcagcgggaggagactgctggacgtggagagcgaggccaaggaggccgaggccgcgctcgggggcttggtgaacgccgtcttcctcctggccccctgtccgcactcgcagagggagctgctgcagttcgtgtctgggtgcgaggcccaggcccagcgcctgccgcccacccctaagcaggtgatggagaagttgttgcccaagagagtccgggaagtcatggtcgcccgaaaaatcaccttctactgggtggataccaccgaatggtctaaggtaaggaaggttactgtcgtctcagatggcgtgcacggtgctttccttgctaaccagaacttggcagcgtccttagaacagccacagaccccgaatgagactaatatgactatgcgtcccttcggaaggaaacaaataaataggaacagttttcacaacaaaatgggtagttcctcactacctactgtttaagacccctcacaatttgggccctacctgccttcccagacttgattttcctacacactacatctactctagcatattgaagtccagtccagaaaatcaacaggtctggactgcttgttttgtgttatgtgtgttgttcaatctgcctggaatgccagttctcactcttccaggccagtcttaacttcacttaccctttaaggcttcttctcccagtgacaactgctcagtccagcgtctgaattgccatacacattttgtgtggcacttaaccatttctccatatgttttgattatgcacatctctcaccctccatctagtctaaaaatacctcagaggcaagcagcaggttttaac

SEQ ID NO: 81209 - DNA, 1227 bp, Homo sapiens
gctgaggcaagagaatcgcttgaacctgagaggtggaggttcctgtgagccgagatcatgccactgccctccagcctgggtgacagatcaagactctgactcaaaaaaaaaaaaaaaaaggttatttttattaatgtataatggttctatgttccttctaacattttatgatctatacccagtgatttgtgtcacttctttctgttccttgacaaaaaatataaatgaggtactatttttactaaatgaatgctttctcaaagggatataaggtagtaatttgttctggggctgcacagtagcttgatgctgaccattatttctatttagctcagcaaatacattggttgtgtaattcgatcctttaatattggtatcaactttactttctcctgatttcctttacttttatttgtgaatgcctaatttatagtaacctaaggttgtttgtcgttttattttagttgtgggaatccccagaccaccttggatactggactgtttgtgaactgctccaccacggaggtggcactgtcttgccatctgaatctttcagctgggattttgctcaagctggggaaatgctgctcaggagtggaataaagctgtcaagtgaacctcatctttctccgtggatttcaatgctgccaactgatgccactttaaaccgtttgctctacaattctcctgagtatgaggcctcgtttccacgaatggaaggaatgttatttctccctgttgaaggtaagcaaataatattttaaggtttttttttttttaaatctcagttacattaatttcttcaaagaagcttttaacttctttggcatttctcacagcccaggcactcaacgaatgcttgtcatgaaagaattaaaagacatcaaggcaaaatcagagatactgtaggaaagagttgaactcttaattcagtacaactgccagcctttgtacaaaaaaacaagtgaatgattgattttaaagtttaccagctgttcccaaagaagggtaatattattcaggtgcccaagcacatgggtatacgatttcattgcctcatagagtagattgataaattgaagaccatagagaaacaatggtcgactaaaagaagaaataaattagtctacagaaacccagaatgatgcttgttaccaggaaaagcaaacatgttggaatcttcattacattagtttcaccatatgatttgctatatggtaaatctca

SEQ ID NO: 81210 - DNA, 1019 bp, Homo sapiens
acttggcagtagaataagtgttgaagtgttcaactaagtgacagtatctcaattgacaacttgattattttcttattgttattaaatctctttttagtatctattccttatattggaattttaatctttttttaaaattttaatttggcatcctggtctaattaatctttatttctagcaggcaaagagattcaagaaacatggacagtcaccctagagcccttggccatgcatcagagacattttcagaaaccagtcagaatttttctaaaaggctcagtggcccagtggtctctcccaacgagcagcactttgggcactgacagctggatgctaggaagtccagaggagagcacagcaactcaaaggctgttatttcagcagttggtaagcaggctgactgctgaagagttacacctggtaggtatcctccacacgggaagttattcttgtctaacaacacactggtaaagtgaaataagtgtgtttataaatgccctacacaatatagtcttagtaaaactgattatgcttttgcaaataatattgttgacattatagtatcatgacagcaatgcttattagagaagaaatcacttataaaattgcatgtaccaagaatccaattaagttaaattatattcacatagggaagaaggcagttggccagatgaagtgcttatgttagggtagtaatgtgatgagtgatttctcattgttttttaaatattctgttacatatttactacttttatataagtatttaagaaaaagctgctacacagtaaaattagatgtaatagtataatagttgtgtaactatatacaatgtaatataattgtctgtgtaactcagcagttggacagtagttacacaaatgtagaaatgtcttctgaaaaggaacatatacatacccagatttgatttaacggtgagaattatttttaaactaccagcaaattccttaccttactttgtcttttgccttcatactctcaggaggggtctctattctggt

SEQ ID NO: 81211 - DNA, 1095 bp, Homo sapiens
gctttaacaggttacttctgcctcagcctcaatccctcctttataaaatggggataataattatttttacctcagggcgattgtgaggattcagtaagcacatagtaaatacctagtaaatattcctggtaatgtcaggttttacttatttgtaagtagaaatatgaggactctgtgattaataaattcccttctacctctattaatgatcaaatctatctttttcatagttttcacgttaataataattgggaaaatggttattctgtcttttagtacactacattcttctttaggcatattgacaataatattctcaactaattagggcttctcacgtaggttgctgatgtggaccctggtgaaggccggccccccatcactggagttatttccccactctctgccagtgctatgatcctcactgtgtgccgcaccaaggaggctgaatttcaacgacatgttctccaaacagctgtggctgacagcccccgggacacagcttcccttttctcagatgttgtggatagtatattgaatcagactcatgattcgcttgcagatactgcttctgctggtaagctcctaaactagtaactaacagagtctagggtggtttgcagtcttttcaagcatcgggactttttcactgtgcagttagtagaaccccaatatgttataacacagatgaaagaaagctataatacttcaggcagtttaaatcattattatttatagaattccttaagtacttctgaggaggctgcaggttccatgaaaccagtctgaaatcgaagtcatggtttttaatatatttaagaaatactgcatataaaactgtagtgattctgtctaccctgcattgcattgttactactagcattgcaactaaatgcattgttactactaaatctacctagcataaataaggtttgtatcatgttagtattacaaaccttatgtaagctaggtagatttaaatatacgtatacatatatatatatataaaatcaacttgatatttctttaattcattcattcattcaacagatttgagtacctgctgtatggcaggcactgtttgaagtactggga

SEQ ID NO: 81212 - DNA, 1004 bp, Homo sapiens
tttcttaacagaccacattctctgagtatagtctaataatattaaaaagtagttacaaaaataaaatactctcatacttaatatatattgtgagagtatgttagctagataatatgttaacaatatataaatatatacctgccaaaaattctttaaaatttaccaaagtaattcgtcaagttaaatataaataaatactcccttaaagtgagaaaatatttataactaagtatcaatgcaaatagaaaacagcaaacttgaataatgcagctgaatttatacttaaagaagtatttgcagaccgtttttgtaaggaaaaaagttaacaaccgattactaagaatccaacatgagaagtaaataagaaagtaacctccaccctacaaaagataacaacagaaataaatagaaaacaaataaatgtaagtgatcaagagaaacaaaagatggttctttgaaaagccaaataaaataatctatagcaagatcaagcaattaaaagacgaacaatattagaaatgtaaacgatatggcagaaattcaaactattattaagaggtatggttgacgtttattttctccacacatatatccattcagttgttccaacaccatttgctaaaagactatcttttcccactaataactgtggtaccttgtcaaaaatcaactggccacctttgtgcagattgatttctagacagaatacagtccagaaactatgttaataccacattatcttcaatattgcattatagcaataccatatactgtagctttatagcaccagtcactaaatcaggtagtgtaagtcctctaaactttggtttcgtttttttaaaatttttttggttattttagatacttcgcattttcatataaacttcagaaccagcttgtcagtttccacgcacacaaacatctgttgaaactctaggagtgcattgaatcatagataaatttgggaagaactgacatcttaacaatgttgagtcatccgatcc

SEQ ID NO: 81213 - DNA, 1480 bp, Homo sapiens
tcctgcctgccctacttcctcctcttctcatcaatcccaaattagtttattacaatgtgaaagaattattcgaagtcattgcaatacttactacaatgtgttaacatcattttgtactttgatatatggaaactgagtaaaaaataactatggaagcttgaagtgaaatagttgccataattagacttgcatcctaattcatgaagaatcctattaataaaagtcaatattatatgtaatggttaatggttttgtgaacaagacagctttggttcctgcattcgttcaaatcgaaaatgagaggagggacattttctctcctaagaaaatatatttttgaaggcatcttgtggggacatctttttggttagctttttagaggatagtgggtattttggtgttatttctaaagcattttgcaaaattagaatgttggttttattctagacatcttgacttcacaggttactacaggctgcctcagctaataaggaagagtcttccaaaactgaaggcgaattaatacattgccttgccgagctctaccagagaaaatctcgtgaagaatccactatagctcatcaagaagacagcaaaaagaaacgtatgtacctagaaaggctgtttcttaaggcattcttttttgagactgtatgttttaaaagatgggcatttcctgaaatgaggttgaaatggtaactaaataaagaagggcaaatttttatatttaaattttaaaataattacattagttcaatagtgatttttaaaaaatcaaccagtcttatctgtctaatgaataagccatcttcatttttaattatgatagaaattcaaatacaactttgtgttctgcttattagtattttttcttttgctaccttgcctttttagatattattccatctcattgcttaactaaatttacaaaattctcatgttgttgaacatttagattgctttcagttttcatcattataaataatactgtagtatacattatgcgtataatttgttttttaagtaattaccttagcagaagtttccaggaaccagttactgtgtcagggtatgaaaactggctctttatgtagattgctaaattgtcattcagaaattttcatcaccatttttcgtggccattgggtaacaccaaaataagtctgtttggcatttgccttatgggaaaaccatccattgagatgtttagttccaatccaatcacattgagatgtttagttcctaaacttcggttaaaagaaaggttctctttctaccctgtgtgtgggcagaaagagatgcaagaacttcctaattcaaatcattctggagggatatgcttcattttgatattctttcacagtaatctgaattaaagtagttcttctttccacagaagtggaaggcaatttactttccctcctctgatgttgttttggtaggaggggtccctcgtactccagtgagacagaagatgaat

SEQ ID NO: 81214 - DNA, 1077 bp, Homo sapiens
gcatccctggctcctacatactagatggccagcagccacccccgcccccaccaccatcagtcatgacaatccagacaaggccaaatgttccctgcaaggaaatattttccccagtggacaacaactggcctaagtaatacaaggacttgagcaagatatgattaatccattttattttatttttttctcagattttaaaactgaggaagagctgctatcatatatacgtgaaaattaccaaaagactgtggccacaggagaaatcatgttgtatgcatgtgctcgaaacatgatctcaaccgttaaaatgttcctaaaatcaaaaggcaccaaggaattagaagtaagagggtccagatattgttgtttgtcatggatgtagtggttggttggttggttggtggtggatttggttagtgtcttggaaaatgtctgttatgtcatatgtgattcaaaaatggtaagataagtaagggagtaagtacagttccagatctcagaaggtggatatggtgaactggtaaggcagaaatcaaagagatggggtgagcggggataattacatataattctctcctaatgaaaagcctttcctcatgtgagctatatgttagctgcatgattaagccagtggtttttaaccctggctatactttagaatcacttacagcatttaaaaaatatatatatgccaactaaccgtggtggctcacgcctgtaataccagcactttgggaggccagggtgggtggatcacgaggtcaggagtttgagaccagcctggccaacatggtgaaaccccgtctctactaaaaatacaaaaatcagctggatgtggtggtaggtgcctgtaatcccagctactcgggaggctgaggcaggagaatcgttttaacctgggaggtggaggttgcagtgaggcaagatcgtaccattgcacttcagcctgggcaacggagcgagactccatctccaaagaatatatatatatgccttgctctctccagatgaactgaaacagatctctggggttggcgcttttaaaaagccccctggataatccttttgcactgggag

SEQ ID NO: 81215 - DNA, 1454 bp, Homo sapiens
aatttgaggccatcctgggcaatatagtgagaccgtgtctaccaaaaaattttttttaattaggtgagcatggtggtgtacacctgtagccctagctacttgggatgctgaagctggaggattgtttgagcccaggagctcaagactactgtgagctatgatcccagtactgcactctagcctgggcaacagagcaagaccctgtctcaggaaaaaaaaaaaaaaaaaaaaaaagattaccaactgcatgaagatgcttttgtagccaattcttttttatgttataatatgcagcttgaatcacctatttatctaataactacatcagtttttagaaaaggcactggctctcctcctttttggttgttgtgtcttatataaatagatctatgcttacggaaggagctttttgtttagtgacatccaaagtagatatgaccaagtatttttttctctcaaggtgccagcttcaggtatttcttcgtttggagatgtgtctgcaatgcccttcaataaatgaaagtacagatgatatggaacaagtagtggaggaggcaagtatatagtttcgtgccattgaaatacgccctagatgctttcagcttccctgcagagggcatctatatagtaacgttctaaaatctccttcaggtgacagatttgctgcgcatggtgtgtttaactgaggattcagcgtacctagcagagtttctggaggaaattttgagattgtaagtttgatggttactaacttaactttaaaattgttttgtcaaaacctatgtatggtgttgtctctgaattttggagttgtaaggactactttttaggctgggtgagggagggaatagagagggtaagatggtaactgttccgtattcgatcaatctgttccacaggtatattgactctatcccaaagacacttggaaatctttacaacagcctagggtttgtgattcctcagaagctggctggtgtccttcctacagattttttcagtgatgactccatgacacaagagaacaaatcaccacttctttctgtgccttttttgtcaagtgctcgtagatcagtgtcaggcagccctgaatctgatgaactgcaggaacttcgtaccagatcagccaagaagagaaggtaagaggtcaaagaatcaaaggaattatttgcactgttatagttctgataaaagatgtgtttaaactacagtccagtcatctttgtccatataatttgttgaactaatagctgcccttatgtctgaatcagagaagccaactattagagctcctaataggagcatctgacaatctttatattatctaggaaatatatagtcatgttttgcttaacaacagggatacatcctgagaaatgcattgttaggcaatttttgttgtactaacatcagagtgtgcctaccaaaacctagatagtatatattttttcatt

SEQ ID NO: 81216 - DNA, 1369 bp, Homo sapiens
tactttctactttatttgtgaaggacatagaatttttggttgacaatttttttttcccccttcaggacttcaaatgtgacatccactgccttctggtctcccaaatttctgatgagaaatcaactattaatcttattaagctgcttctctattgctgctttccagattctctctttgtccttgggtttcaacactttgactacaacgtgtctcagtgtgaatctcttagagtttattcagcttggagttcgtggaacttcttggatgtatatgttcatgtctttcatcagatttttggaaggttttaaccattatttcttcaaaaaattttctgccacttttggtctcatttcctccttagactcccatgatatatgtgttggtacacttgatggtgtcctacaggtccctcagactttgttcattttttttttaattattttttctttctgctcaggctggataatttcaattaccttatcttcacgttcactgattcttctgccagctcaaatctgtggttgacccttctagttagttttttcatttcagctccagaatttctactggattcttttttatcatttctattgctttattgatattctcattttgttcatatattattttcctgatttccattagtttcttatatatggtttaagtgagctcattgtgcatatttagagaagttgatttaacatctttgactagtaattccaatgtcttggcttccttagtgacggtttttgccaaatttctcttttctggtaaataggccatactttcttgtttctttgtatacttcgtagttttttgttgaggactagttattagggatattataatgtggtaactgcatggaggtcagatcctgtcacccctcagggattcctgttctttgcttattaaggatctcagctattcatttgtgccttttctgaactatttgtgtaaagtatgtataccttgttgtgtgtggtcactgaagtttctgtctattatctctgtggtcagccaatgacctaagaaggatttccttaaatgtctgattcaagaaacgaggagggggaaggtgtgtctgtcccttaaacttctgataattgggagaaacccactgtagcctaagagagctgaaaccaaggcagtgtctgcactgctcctacaggaatctgcctggttgaccaaagcatgcaacccccaatttttggaggacgaggtcttcactgtctgccctagcaccagccagctgctcctggaatgtgggctgctatcccaatagctacagcagggatgagaaaagggaaatggtagccagttcatgcacatcattcccttcctaaagatcatcagtctctcccatcatcaa

SEQ ID NO: 81217 - DNA, 1315 bp, Homo sapiens
ctctgtcgcccaggctggagtgcactggcatgctctccgctcactgcaacctccacctcccaggttcaagcgattctcctgccacagcctcccaagtagctggggttataggcacccaccaccatacctggctaatttttgtatttttagtagagacagggtttcaccttgttggtcaggctggctacaccattcttaaggtggcagtaaataagacttctgaaggtaatagtctagtgggtcagtgtttttttaataccttgttgggaccatgtatcaaacccctcttagtttgttaagagacacttcagaagtctcttaaagctaatagcttgctgaatttccatcttatatgtggtactatgtaaattttgcccggttttggacaacatgagaaaatgtcaagcttgtagttgtctttggttacttactgtggttctgattttacagaaataagtctgagacgaagtcctcgaatcaagcagttgtcatttagcaggacacattctgcctccttctattctgtgtctcagccgaagtctcgaagtgtgcaaagagtccactctttccagcaagataagtcaggtaacatacgggcccctctgccttcacaagtccgtgctgacttggtgagaagtgtttttgggaaaagaagcaagaaatttgacattttctttcttgacattggagaagtagaataggtatgtctagttgaggttcagggtgatggctagatggacagtccatgactttgtaatcagtcatccctaggactcctacaactggtcatccatgctatcattataggtagctcattcattcaagaggaagctacccataatttcccataaggacagaacctacacatcattatcttaggtggaaggtgatatctgtgtttacgttcttcattcttctatccatggttagcttgctaatagatttgtgtttcttattttatctttttttgagacaaggtctcactctgtcacccaggctggagtgcagtggcacgaacacagctcactgtagcctcaacctcccaggctcaggtgatcctcccaccttagcctcccagggaggtgggactacaggcatgcaccaccacgcccagctgattttttgtttttagtaaagactgggtttcaccatgttgcccaggctggtcttgaactgctgggctcaagtgatccatctgcctcggcctcccaaagtgctgggattacaagtgtgagccaccacacccagccagatatgtgtttttatatttacaaattaaagtagttcagttgtctacattttctaacataggagc

SEQ ID NO: 81218 - DNA, 2931 bp, Homo sapiens
tgttgaatgagggtgagcagcagatgaggtggctcctggaggctgctttaggcaaagatcagaaatagctgccttatctgaaaagaaggaagagctagagagtagctgcagtggtagaatgattccattagaggcaaaaagcatggtttagcaatatgtagattattaaaattatttgttctaggacaaactaaacttggatagtgtttggtcctagaaaaagtagacaagtaaaatctgagtcatgttttggagagggaaacgggtcactatttgagatttccatctttagatcattcctttggctgactataaatctcccatttggtcttagagattactaaaacacttcagagatcatgagttataatattcaaggactgaaataagcatttctcttttcagactcccaagaagagtcaccagaaatctctgagcttttctaaaactacaccaagaaggatctctcatacaccacaaactccgttgtatactccagaaaggctgcagaagtcccctgcaaaaatgacccctacaaagcaggcagcttttaaggagtccttaaaagactcctcctcacccggccatgactcaccattggattcaaaaatcactcctcaaaaacgacatacccaggcaggagaaggtacctctcttgaaacgaagacaccaagaactcctaagaggcaaggtactcagccgcctgggtttttgccaaactgtacttggccacattcagtgaattccagtccagaaagcccctcctgtccagcccctccaacttcatcgactgcccagcccaggagagagtgtctcactcccatcagagaccctctcagaacacctccgagagcagcagccttcatgggcacgcctcagaatcaaacacaccaacagccccatgtcctcagagctgctcgggcagaggaaccagcccagaaactaaaggataaagctatcaaaactccaaaaagaccagggaattcaactgtgacttcttccccacctgttacgccaaagaaactgtttacctctcctttatgtgatgtctccaagaagagtccatttaggaaatctaaaatagagtgtccttccccaggagaactggatcagaaagagccccagatgtcacccagcgtagctgcatctctctcctgccctgttccctcaactccccctgaactctcacagagagctacattggacaccgtccctcctccacccccttctaaagttgggaaacggtgtagaaagacctctgatcccagaaggagcatcgtggagtgtcagcctgatgcctccgctactcctggggttggcacagctgacagcccagctgcccccacagactctagagatgaccagaagggactgagcctctctcctcagtctcctcctgaaagacggggctacccaggccctggtctcaggagtgattggcatgcatcctctcctctgctcattacaagtgacacagagcatgtcactctcctcagtgaagccgaacaccatggcattggtgacttgaaaagtaacgtcttatcagtggaagagggtgaggggctaaggacagcagatgctgagaagtcttctctgtctcaccctgggattcccccatctcctccttcctgtgggcctggctctcctctgatgccttcccgtgacgtgcactgtaccacagatgggagacagtgccaggcttcggcacaactagacaacctgccagcatcagcttggcattccacagactctgccagcccacagacctatgaggttgagctggagatgcaagcttctggccttcccaaacttcgaattaagaagatagaccccagctcttcattagaggctgagcccctcagcaaggaggagagctctctgggagaagagagcttcctccctgctctcagcatgcccagggccagcaggtccttaagcaaacctgaacccacctatgtgtcacccccctgcccccgcctctcccacagcacacctggcaagagcagggggcaaacctacatctgccaggcctgtacccccacccacggcccttctagtaccccctctccatttcaaacagatggggttccttggacaccatcccccaagcacagtgggaagacaactccagacataattaaagactggcccaggaggaagagggcggtgggctgtggcgccggctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggtgagttcgtttttgaaacccagtttcctcatggtttcttttggtcagagtgcttgacaaggaggcacttgggagttgcttcttgggaggcctgggcttcccggttgggggtctggggacgctgctcttactatgtgggatctctttaggctccaccccacctcccagctgtgccgtgcggagctgcctctctgccagtgccctccaggctctgacccagtctccgctgctgttccaggggaaaacaccttcctctcagagcaaagaccccagaggtaatgtttgttgaaggtctaggaccctttcctgtgacagactgtctgaattcaccagggttgccaggcagctcgattctagaggag

SEQ ID NO: 81219 - DNA, 1010 bp, Homo sapiens
cgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatggtcagtgttcagattgccattagaatgccttagggttttctaattccccttatggatccaatccatctcctggccctgccccttgttggggaagttgcaggaggagaggtggatggcaatgtgattggtgctataactcaggcagcctgggagtcaggaacccagacaaggaatcccattccagcctcaccccaaccatgaccttggcaagtcagggggccactctgcctcatttatgcaaatggagaaaggcgccctccctggggtcccttgagctgctgtaaggctgggctgctgcgacacaggcagcgctttgtaaactgtgaagccatatacgtgaaactgaagagtgcattgggcagtggaagctattttttgccttccctgtgtaacagtaaaatcatctctagtgactgagcactcagtacatttttgtttaatgttgggcctgaggttaactgtgaccatggtccagcttgagtggcttctggagcagccacattttcaaggactgtccaagagccagccagttcagggctcaggcctcacccattgcccactcctggggagaccatcacctggctcatcgtttccaccaagagtgccccacaggagtgccccacagacccgctggaccagcctgctgcgggtcctggccaggggtctggctaacggtgagggctgactctgaactgtctctcagtctccagaaagtgttcaagcctgttgtgttcccaaatctgattcctcctattgtcttgtaaatcaaactctaagtgaaaacttcccatttgtcccttcaaagatttttttttattaaatggttttttaagatcctaaagtctcccagt

SEQ ID NO: 81220 - DNA, 1091 bp, Homo sapiens
tctgaacttcctgaatgtagatcattcacagaggcttgcagttgagcaggccacctctgagcagtgcccccagctcaccctggggttggggctgtgacagtgagcagggggcacctctctcgatgggctgacttggcccttgggacgaggggacccttaaggcccagttgtggctacgtgttggctgttgcatgtctgcccaggacttcagcattcaggcagtgggtgctgttcctccacgcgtgcccgtctctgcaggaggagcggacgctgttccagttggatgaggccatcgaggccctggatgctgccattgagtataagaatgaggccatcacatgccgccagcgggtgcttcgggcctcagcctcgttgctgtcccagtgcgagatgaacctcatggccaagctcagctacctctcatcctcagagaccagagccctcctctgcaagtattttgacaaggtgggccagcagcccatggccccccagctcctcctcagcggcacgtgtggggaggtgtctcatggcagctgctccagcggatatcccgtttcctcccagactgggggacagaatcaggaccaactcatctgcagggccgcctgaccttaaagcctattttacttgtgaaactaagacccagtttcctacccgccccccacttctgctctgattggctaacctcagggtggtccatggccacaatagtagctctcagtaggggaagtttttgcccttttgtgacatttggccatggctggagatacttttggttgtcacagtggtgggggtggaggccagggatgttactaaacatcctataacacacaggacaggcccccacaaccaagaattatctggtcccagatgtccatagtgctgaggttggtctagatgaaatcccacaacttgacgctctgcccagctccatagtgtgtggctaggaaagggtttgtggcagagatagcagataaggtgagagccagctctgatcgttggaagataactagagcactgctgaggtgtctgaggctgagtcttggctcagcagggaagaccctggtgatttcttagtgccgtggtggcaa

SEQ ID NO: 81221 - DNA, 1033 bp, Homo sapiens
cctgccaggtgaggtccagtgaagtgaggtccagccaggacagatcttgccaggtgagctcctgccaagtaagtttctgccaggtgaggtctagcaaagtgaggtccttccaagtgataaacctgccaggtgatgtccctgccaggcgaggtctagacaggagagtttcttctaggtggtatctctgccaggtaagttccagacagaggaagctctgtcctactgggttctatcctgtgcatccccatgagctgtagggcttcaagatatttatgacacagttacagatgtatgcatagaagaacctctcttaagtgtccatcctccaattcatttcactcattaaccccctcctcagggcctgtgcaggaagaatgaggaggcgcaggtataggaaggtggtatagccaaatagaaagagacttctccgcctggcatcattactccatctagaataggaaggtcagcttctgagccacagcgttgtcttctgtcagatgggatcataatgttaccatgatggctggagggggatggccgtcattgatgcagggcctgttccagtacaggggcttgggccacacgcccagtgtcctaggcccgcagaggccaggagccttgctcctgccagcacgcatcactctgatgtccaggaggatccagggtcctactggaatgatccgtaacttccctccgccaggagagccctcacttcctcccgcatctggctcccagaaaggcctttagggcttggccaattcctatcactgtccagtccggtcatctcagtgacagatcattcctcccacccctacccattgcctgttcttgccaggagggccacgtccctctggtccttatcctcctctcgccatctctgagtgcccctctgcaaatgctctggtccctttagccccgcctcctggagtctctgtgaactaagtctggtctccctgctgagcagaacatttggagtgttggtttcttgagggaaggacgcaagtcctccttaacatccggccctttctgtccc

SEQ ID NO: 81222 - DNA, 1051 bp, Homo sapiens
accacacctggctaatttttttctttttttttttttttttaagtagagacagtgtttcaccatgttggccaggctgctcttgaactcctgacctcaggtgatccacttatcttggcctcccaaaagttctgggattgcaggcatgagccactgtgcctggcctatcctatttttttaccttcatatgatctcgcccacctagccatctgtccctcccacccttccatccgtccatccttgcagatgcccacccatccttattttctcagttcaaatgtccaagagacaatatcgtggagtggttgagagcatgggctctggagcctgactgctcaggtttgaatcccagttctaccacttactagctatgtgtcgttggtcaagtttcctaacctctctgcctcagttttctgatctgtaaaatagggataatcataattacactttttgtaggctcattaggaccatttaatatacacagagctcttagtgtggtgcctggtgcgtaaatgtcgtagtatttaccattattagtatactgttattattattattatttttaatttattattattatactttaagttttagggtacatgtgcacaatgtgcaggttagttacatatgtatacatgtgccatgctggtgcgctgcacccactaactcgtcatctagcattaggtatatctcccagtgctatccctccccactccccccaccccacaacagtccccagagtgtgatgttccccttcctgtgtccatgtgttctcattgttccacccccacctgtgagtgagaatatgcagtgtttggttttttgttcttgtgatagtttactgagaatgatgatttccagtttcatccatgtccctacaaaggacatgaactcatcattttttatggctgcacagtattccatggtgtataagtgccacattttcttaatccagtctatcattgttggacatttgggttggttccaagtctttgctattgtgaataatgccacaataaacatacatgtgcatgtgtctttatagctgcatgat

SEQ ID NO: 81223 - DNA, 1464 bp, Homo sapiens
ataactgagcatggattaggagtaatcaaggcaaggttatttgataatctgttgaggatgcagtgaaggggatgcttacagcatgaaaggggttgattgaatcaggagaggttgcttccaactcttaaattttataattctgcctgaccacgctggagcatggccaagctcaggccacctgtcccatcctggcctcggccactgccttctccatcctagagcaccatcctccagctctggcaggggcctatgagcttccgggcctgggggccatgggccgtgtccagctgaagtggcaggaggccctgcggtgtctccccagcctccctccttgaggatgagcagggcattgtcccgagggccatggccgaggccttcaagctcatcgatgagaacgacctgcttgactgtctggtacatgtgtcctacctggaagtgtacaaggaggagttccgagacctgctcgaggtgggcactgccagccgtgacatccagctccgggaagatgagcgcgggaatgttggtgaggaactctggggtcctccactgacggagaggggcttaggggggcttcacctgtttggagtggagtgcttacctgtctgggaatggcaactcctcatggaaaacccaagccctgggaggttttgctttagcttcttgcctccactgagttcagtacatgcttctatacccagagtgagaggcactgaggtgggccagtgggaagccggagcccctcaagccggaactaggaagggcagtaccccgtgggcatggggagggagcagtgggtcaggaagggcaggtttggggctagttctgctctgcctgccctcctggctggtcagtctggcggcccctgccctggggctcacggccttctgtgcccgcagtgctgtgcggggtgaaggaggtcgacgtggagggcctggatgaggtgctgagcctcctggagatgggcaacgcggcgcggcacacgggagccacgcacctcaaccacctgtctagccgctcacacacggtcttcaccgtgaccctggagcagcgggggcgcgcccccagccgcctaccccgccccgccccgggccagctgctcgtctccaagttccacttcgtggacctggcgggctcagagagggtgctcaagacgggcagcaccggcgagcggctcaaggagagcatccagatcaacagcagcctcctggcgctgggcaacgtcatcagcgccctgggggaccctcagcgccggggcagccacataccctaccgcgactccaagatcacccggtgagctgccccctggctcctatgtggcctgggggccggggaggcggggagtgtccagcacaccagtgggggtggaagcccaggtcccctgaggtctccagcccacgggaaccgcgccaggagccggtcccaggtctggcccgctggccctgggcctggagcgtcggggcccct

SEQ ID NO: 81224 - DNA, 1030 bp, Homo sapiens
ctcctgagctcaggtgatccgcccgcctcggcctctgaaagtgctaggattacaggcatgagccaccacgcctggcgaaggatatgcattgtataatgctttgtgtattcaaggaaacttgtgcaccatctgtattggtttcctgagcctgtcataacaaagtaccacaaactgggcagcttaaaacaatagatatttattccctcagagtcctagaggccagaagtgtgaaattaaggtgaccagaagattactttttaagaaaaaaatttagccaggatcccataccatgggagaacaacctttcctaggttaacatatatttgctatagaagctgagcatgtttctttgacaagataaagtcccacagccaacccatgggttgttatctcctcaaatattggtcagaagaattctttaggtacatctttcccaattctaacccttcctcagacacacttctctcagttgctgattctgtatttgctgccctcctccccagacaggtaaaactgaaggcaaaatgtcagtggatgtgatcacttcagcagcacatatactaaaactggaacgatacagagacgattagcatggcccctctgcaaggatgacacacaaattcatgaagcatttctttttttttttgagatggagtttcactctgttgcccaggctggagtgtaacggcctgatctcggctcactgcaacctccacccactgggttcaagtgattctcccacctcagcctcccgagtagctgggattacaggtgtacacatcaccatgcccggctaatttttgtatttttagtagaaatggggtttcaccatgttggccaggctgagaactcctgactgcaggtgttccacccacctcagccccacaaagtgctgagattacaggcgtgagccgccatgcccggccccatattttttttaatgtcaatggaatttaccatttgcaacaaagaaaatgtgggggctgggcagaacaatttggttaaaaagctgttgcatgagtgctgttag

SEQ ID NO: 81225 - DNA, 1075 bp, Homo sapiens
atgcacctcacaggtaagaatgctagacccatcattcctccaggaaaggccttctgagcacctgctgtgtaccaggctgagccctgaggacacagaggcgatgcaggtgtgtcctcttagagtttctcataggagcacagggtagtcgaggtctgccctgggggctcgggagctggggaagtgagaggagattcctctcatcacagttgtgtggccctcagctatcggaagctggagaagaacccagagaaggaggaggagcactgggcccggcttcagaggtactccttgtcgctccagagagagaacttcaagaagtgaggctgccaccgccctgggatctctgaaaaggaggtttcagccacgaggcagctgctcccaggacactgaggccaagagaaatgtaacagagccacagctccacaggcctgcactcggagtctggggcctctgcagagccagcaaggggaaaagtataatctgggggaccttcaaccactaagcctcttgtcagagccctcaggcaggcagatgtgtcacccaaataaacagtgatattgtctccagactcccaagttgctgtggtatataactcatcgttcccacgcagtccagaccccagcagggcccagatgatggtttcaaccagagtcctcggcctggtgaggaccactcacctcctaggccctggagagccactgtcctcagatgagcaagacaccccgcccacctgttttccccacccatttctccctcccacggctggctcacacctttatagaatagctttgaggaggtgaggctcaggatggtggcgtaagggcctgaggccacacaggtacgagaggcagagtgggagggagaggtggcaggcaggagctgggccactgctgcccctggcctgctggctcaggaacgctagaggtggctgggcagagagatgccttgttcttctctagaaactgtcctcccccaaaaaacagacggaggggtccccagcagcccaagggatccgtgaggaccctgtgtggaaccttggaggctgagggggctcaagtgtcccagcctggtccta

SEQ ID NO: 81226 - DNA, 1021 bp, Homo sapiens
acccgggaggctgaggcaggagaatcacttgaacctggcaggcgaaggttacagtaagcccaaatcgctccactgcactccagcctgggcgacagagtgagactccgtctcgaaagaaaagaaaagagaaaagaaaagaaaagaaaagaagggccaccctcagtgtcaaagacgggagtgaccacccacctggtgccagggcttggggcgctaggactccttccttcattgattcattgtcaaatatttctatgtcaggcatgacactagcttagccagtgaccctgtgaccctgcttaggtgactcagttttccatctatagagggaagaaggaccaaggggtccctcagcccctggcaggccgaggggatgttgagaggatgcaggcataggtgatgtgcgtgggacagtccaagttctctcctgagtcacctgaattagcagtagctgagacagcatctggccctcttaggtacctgagctacaccctgaacccggacttaatccggaagcaggacgccacctctaccatcatcagcattaccaacaacgtcattgggcaaggtctggtctgggactttgtccagagcaactggaagaagctttttaacgagtgagtctgtggaatgggtgtcagggacagcgagcgccgaggctggggccccggggggtggcctgtgcgggtaagacacgccgggggcactaaccagaagtggacaaaaatcagccaagcctgggggctagggtggggcaggaatggaaagacaagctggggtatgggccgtcccttttcccatttggaaggaaaacgtggcgtgtgggcgtattctccagaagagaggggagtgaggaactcggcagtcagacctgtgttcaagctgtgactcccccacatcctagtggggtctcccagggcgtgtcatttcatctcctctataatcatggctccctacccagtaggtgtgaggatgagcctccttagttcccggcctccctcacagttcacctctctccctccct

SEQ ID NO: 81227 - DNA, 1024 bp, Homo sapiens
ggctgctttggggaccaaggaacctcaggcccaaggcacaaagcacatacagcgggggtcagagggccagttaggccacagagccttaggcagggtgccggcctggggttgtgtgtcaagaggtgaatcttggctggagttcgccaggtgtgctaaccgcgtgtcacccctggggcaggtacagcgaggttaatgccatcagcaccgcctgctccaacggagttccagagtgtgaggagatggtctctggccttttcaagcagtggatggagaaccccaataataacccgtgagtgtctcccctgcgcctcctctgccagtcttcatctgcccccaacagccccgtcctcagcagaaccctgtcccaccctccccgctgctgttccacacctgacctccctaccccacaccaggatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtgagtcttggcgcagggtgggactgcgagagccctctccccacctggagaaccaggcaggcctccacactcctcgccagatccttcacgtgacccccacagacctgttgaggtggaggcagtatttccaaagtaaccggtgcagactggaagctttaataagtgatagagacaagatatggactcaggtctgggtccatgtcctctgttcctagctgctgtggcctcttagcctttacctgacaacaactcgtcttcccttctgtcaaaggctctggtgtagctggacctgggtcttttcaaacatccagctgggcaccccctcaagcccttggatgagggtccccacctcccaccatgtgcctcatatgccattacctggatgcagtaaagaagagccacccttgggcagggtgtggtggctcatacctgtaatcccagca

SEQ ID NO: 81228 - DNA, 1016 bp, Homo sapiens
ctcaagcagatcaatgcaatgccacctggccgcttgctttgcccactgggcctacagccggaagcctgcccttcagccctcgggcctgatcccaggccgcctgcagcctgtaaccagacactgtttgcttccagcaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaagtgagttccggctgggctgcccggtggggtggatccgaggtg

SEQ ID NO: 81229 - DNA, 1153 bp, Homo sapiens
caggaggctgcggcaggagaatggcatgaacccgggaggcagagcttgcagtgagccaagatcgcaccactacactccagcctgggcaacacagcaagactccgtctcaaaaaaaaaaaaaaaaaaaataggttaaggttgtatagaatactaggctttcctttttttgtgagatgggggtctcacactgtggctcaggctggagtgcagtggtgtgatcatggctcactgcagcctcgaagccccggggtcaagtgatcctctcacctcagcctcctaggtagctggaaccacaggcacgcaaccaccactcctggctagttttatttttttagtagaataaggtctcactatgttgcacaggctggtctctaactccttacctcaagccatcctcccgccttggcctcccaaacatgttgggattacaggtgtgagccactggacctggccaaatactgggttttcagtgctcactgccactaataaaaatctgaaattctttcattatgcaatttctaagtgcctggtgagggccaagctcagttctaggctctgaagattaagagagaaacaaggctctgtctgctcctgttgtctctgtgagcatctttgacagagtgctcagattgttgggatatagtgcatcggactggcagcctgaatttgtggagaccgcagtcagtaactttgtgatatatggaatatttagaggacagtaacccatttccctacgccctacctgatcacatcgtgccctgctgggccataccccaaacagcccaccttcctctaggcctggccatggccctgtgcctgccacattgaggattaagtcaggatatcttgagccctctcaaatccctgtttattcaggcctctgccacatatagagccagccttctgtccccaccacttccactaccatggagcccacttagtaaaacgctctctgggcccagcttcgccagaaaagacaccaggggagcaaggctcaaaccaggggcagctaaatctgatcttgtggaccagtctctagtaagggctttcagcgtggctgtctgtccattgctttccaaataggatgcagcaatgattggtacatgggtattaagatcggtagtaggggctagtccaagtttagcaatagcca

SEQ ID NO: 81230 - DNA, 1065 bp, Homo sapiens
ttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttgaacagcgctccctgtggtttgtgcccactgctcaatacagcctccgatcctcactcttgaaagctccatgataagcacagagatgggcagtgtgggtcagaaggtgggccgcttcctgtggaagagggaagtgtaggtgaatagatatcaaaacccctgatgtcattcttttgaggggttggatt

SEQ ID NO: 81231 - DNA, 1056 bp, Homo sapiens
aaaattaaacaggtaacaagtttgaaatctcagattttcagggtagaagagcaaatagaaaagccagatggcagaggaaggcaaacagcttctggcttgggggttatggcccatgtttgtggtttgtaattcctcctttgaaagccactcgttccctggagggacccagaaccctcttccctagtccagtgtggtttcctagtttgtgtgctctaagagtctgatctcccagcagccatttctcgtggtgtctttcagacctcagagttgccaatttccttatttccagttagctttataaaaaactacagtagagtttgggctaggcttgaaaataacataccccagtccacccccacatggtgctgggcttgatagagatgttcacataaattctgtcctatccctctgaggtctcgccgtccccttcctcagccttcccagagcacagaggttacagacgtatactttcacatgcagaaatagcagaacaaattacctctttaattatctgagtgtcttaaagagcttctttgccttgtatacggaacttgatcttgcgaaaccaggaattcttctttctgtgaggactggcagtcctgtggaagaagcttttccagaccacagctattggtggcagctatagttcttttagaaatgtaggctgggaagattccaggaatagtaagtgagtcagaggcaagggggttggaaatgagaagaaatggagacttgctgggtgagggcagaagcagagttggtatccggaaagaaggcaataggggaaaaatgattgtgagagagttttcatccacttttgccgttccctccacgtgggggtgagcctgccaggtgggggttcactgtagatgtgcatactctttgcgttttgtcaccagctcttctttatctgtgataccccccaccttctcccagcttgttgccacatgacacttccaaagccagctcttttcatctcacattattagttggcaagcagttgccctagagctgtgactgtccttttccttttaagaacttcccggtgactttgca

SEQ ID NO: 81232 - DNA, 1056 bp, Homo sapiens; identical to SEQ ID NO: 81231

SEQ ID NO: 81233 - DNA, 1056 bp, Homo sapiens; identical to SEQ ID NO: 81231

SEQ ID NO: 81234 - DNA, 1056 bp, Homo sapiens; identical to SEQ ID NO: 81231

SEQ ID NO: 81235 - DNA, 1096 bp, Homo sapiens
ttgtatatttatatagatcctgtttagattttttgtatacttatctttaaataggcaagtttttcagggaccagctgttttgcaggatgtttgttggaggagctaccaaaactctgttctgggctagctacagttgttcccttgatttagggttctgggtgagtccgtttacccttagtctctagccagccaatcgagataggcaaggcgtctcttagcatctccacaatgcaaaggatgtcttctctactaccacagacaccacctctgtgaggcaaatgtagcttgcgtgatttctcatttagcctcaacttcaggtccaaggaagttcctgccttccaaaaacaaggaattaatttggtgctggagtgtgtcctttacccacaggaagtacatatttttgcagatctttctgagatcaccagcttccctgtcctctccctgtagcatcctttcttctttttcttctgtgaagcaaaggagtccctgcctgagctccctgcttttgacagctttttcacctgtttgggggtttggaattttggatatcctgtagttataacaaaaatggagtttgcatttttatttcttctttttgcatttggaacatattttgaacagcatttgaaaatgctgactttatgatgcagtgttaaataagaagttttaactgactttttctgttaaccagccactagtctccacgacatcatgtgttaggccttttactataccttctccagaaagcccccaccaccacactgttgtctatcttcgaagtccctaaagcccaaggaatatgctacttagatatatggaaagcctttcattcatttagcatgcctactctgagcgttgttctaggccttggagataaagcatggaagaattaatacaagatattgacacaccaaagacaagtcttaaatgatttcatgtggactaggggtcagggatgaatagagtggaagacatagtttgggattctgaggaagtatgatataaagggtagaacatgagctccggaatcagcaccattctgctgctaatatacatgacattgggatcattttattgccttttcctcatatataaa

SEQ ID NO: 81236 - DNA, 1096 bp, Homo sapiens; identical to SEQ ID NO: 81235

SEQ ID NO: 81237 - DNA, 1096 bp, Homo sapiens; identical to SEQ ID NO: 81235

SEQ ID NO: 81238 - DNA, 1096 bp, Homo sapiens; identical to SEQ ID NO: 81235

SEQ ID NO: 81239 - DNA, 1364 bp, Homo sapiens
cccagatggggcagcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccctcattgattctttagactcactttttgggtaccatttataattttaacatctcaaatcaagatttttcttataatcaatggtatgtcatttttcttttgtagtagcacataaaaatagtatgttttacaatcagtgaagtcttagatttgatataatacagtaatatccaccattcaattatttgaggatcggaattagtgaataattgcttagttcaataaatggtgaatttgtctttatttttacttttttcctactagtctctctgcctcctatattgtgccttaagactatcctttacacaccttcctaatgatatatttaaaaatgtattttttactaactcccttgctgatgtatacccccagctgcagtgattcttaaggagaaggacatgcctcactcccctccaccaccttcctcaaaaccttatgatagttcagtgacactgagtgattgagggaagtgtgttatttaagtgaattttcatgaatttttttttaagttggggaccactgccaaaagggtgaagctgcagccccttcttatgtacaaagacctccatgagcatgcccagcctgcctgtctagcctcacctcttgctttgaactttacactccagtgatactgaactatttttgtaacttgtgtttagggatgttacagctttggaagtctttgagccagcatgtaaagggcgagcaggtggactggggcacagggctgttccatgggcagtgatttagaaggagcaggaactgtggggatggagatggtctccttagaaacagttttatgggatctaggtgtggcatttggactttttttctttttttgttttatggccaaattgtgcttcacttatctgcctgcctatgtggttgccttaggcagagtgatagaatcccagggtagagggcagggacttactctgtgttgctccagaagacacaggtaggatcgggggtggaaattatttgatgcttgttgtagctcagtacagttaaaaactctctgacagttgttgctgctcaacagcccactgagcagcttggaaacagtagtgagctctcttcatggaggcgaaggatctgtcaccagagtgaaggat

SEQ ID NO: 81240 - DNA, 1364 bp, Homo sapiens; identical to SEQ ID NO: 81239

SEQ ID NO: 81241 - DNA, 1364 bp, Homo sapiens; identical to SEQ ID NO: 81239

SEQ ID NO: 81242 - DNA, 1364 bp, Homo sapiens; identical to SEQ ID NO: 81239

SEQ ID NO: 81243 - DNA, 1055 bp, Homo sapiens
ctcttgttgcccaggttggagtgcaatgacgtgatctcggctcactgcaacctccacctcctgggttcaagcaattctcctgcatcagcctcctgcctagctgggattataggcgtgcgccaccacacccggctagttttgtatttttttttagtagagacggagtttctctatgttgatcaggctggtctcaaactcccaacctcaggtgatccgcctgtctcagcctcccaaagtgctgggattgcaggtgtgagccaccacacccagcaaagcagaatctcttgattcctaactaagaacccttttccaggcttgatttttgtatcaatcaaggtaggctaggtaatgcattactccaaaatcccaatggcttatgagagcaaggtttattttttcactcgtgctatgtggccattgtggtgtgtctgctgactgtagttcctctgaggtccaggctgatggaaatctcctcaacatatgcttctacctgggcatgtgtgtgttccggctcttgaagtgacacatcctcgtacactcacatttcagtgatcaaaatcagtcacatgctcccacccaagggatggggaaatgatcctattatgtgcccaagagggaggagaacctgaactagttgaatattaccaatgatgaccatggttttttcatggattttcttagaggaaaagttaatgtttgatttttattatcactttgtagaagggaagctagaaattttagtaacagaaaaatagaggagtgctctaataagaagaaaacatggttgaatcttaggaaaggtatcccacatggcagcttttcagtttctctgattattgggcatttatatcttctatacttcccaaatgaatttaagatgacttaaaataaaatttcttaacagaataaatggtttttatatgtgggaggcgagtgcctccctccttagaggctttctgcaaatcatttgtctttaccttggctctctgaccttgatgaagtactgatgtctgagagtgtttttgtcttttctctgattaccaaacaacaatcat

SEQ ID NO: 81244 - DNA, 1055 bp, Homo sapiens; identical to SEQ ID NO: 81243

SEQ ID NO: 81245 - DNA, 1055 bp, Homo sapiens; identical to SEQ ID NO: 81243

SEQ ID NO: 81246 - DNA, 1055 bp, Homo sapiens; identical to SEQ ID NO: 81243

SEQ ID NO: 81247 - DNA, 1027 bp, Homo sapiens
ctttcagatgtgacattgataaagctgtgaatgtgttcctatttctcttctttatctatttctccttgttttctaggtttttgtggaaactctggataagtgtttcgaaaatgtgtgtgaattggatttgatcttccatatggataaggtatattctcttgcagttctcttccaaactagggttactagaaaaccaagagccttgggcatctgtagccacctctacatcttcatattgtttcttgtttttttttactcttaagatagtcctagaacatgttttatttaatagatttaatagtttgggttttgttttgtttttgctaagatctactaacagttttaacgtgcataagattattactaggcctatatcgtggttcatctgttcacagactgatttcttgatataggagaatgatgtcactggctacttggccaaaggtgagataaatagttttatgctgattataaaattagtttcctagtcataggccagtgacaatgaaactttggaataatcatgacgcaggggctttgacttagatagtaaaatttatatctttcctaaagagtaatatagtgactaagagatctgtaatgtaattcaaggtcaggtgatattctataggaaggtagactatcagaggcagaattaaaatggccccaagtaggtgttctcagatttgttttgctaggataactgtgacatggcctatgtcctcatatgccaaattaaacttgggcaatagccagcaagggaataggaattgccatgtttattttattcaacttaccacatgctgtcccctgtgcagtttactggtgcgtctttggtttgcttggtcctggtttttcttcaactgattgttgtcattatgatccctggcccttggagagagatgattttttaggagactgctgctcattgctaagccatgatcctttattaaccttttcatcatgatgaagtaggagtttttagatccatcgttgctagcattgctgtctaaaggactttcttgtt

SEQ ID NO: 81248 - DNA, 1032 bp, Homo sapiens
tcctgctgtctaaagcactgtgtccaaagggtatggcacacttatatggacaggtcaccattccaaacaaggaggcccagtgtgtcaataggagaggtcctaaagcaacaaaaagggcggggtgtcttggatgggcttcaggaagggaaagaccattgtgtctggagctcagagaatgggggctggtgtttgagatgaggctggagattgggcatggcatcctcacgcatgttaaggaattggggactttatccttaacatcctggaagccagtgatcccatggagagtgagaagatctgatctgtgtttcaaaggtcacttgactgccgagcagctggaggcgagttgctcctttaggagactgctgcagttgcctgggtgagaggctagaggggtctggtctatagcagtggcaggggagatggaaagaagagaatgatttgaggggcattcggggggcaaaatcaacaggacctggggggagacgaagggatcaagaatgatgcccagattctgggtgagtggcagtgctgtggtgcacaagtagtgatgttatgtttccgggtgacctgctgtttagcaggagcccagcctgtggctaagaagtatagagaactgaaactagctccctagggatgggaaaaccaagtgggctgaggataagaacagggccccagggctgggtgcagtcgctcacgcctgtaatcttagcactttgggaggccgaggtgggcggatcacttgaggtcaggagttcgaaaccagcctgatcaacacagtgaaaccccgtctctaccaaaaaatacaaaaattacccggacatggtggcacatgcctgtagttccagcgccttgggaggctgaggcatgagaatttcttgaacccgggaggtggaggttgcagtgagctgagattgccactgcactccagcctgggcaacacagtgagaccctgtctcaaaaaaaaaaaaaaaaaaaagaatagggtcccaggctcagcaggtagggacactgaggtaaaatcctattccc

SEQ ID NO: 81249 - DNA, 1503 bp, Homo sapiens
tctcactgtgttgcccaggctggagtgcagtggcaatctcagctcactgcaacctccacctcccgggttcaagaaattctcatgcctcagcctcccaaggcgctggaactacaggcatgtgccaccatgtccgggtaatttttgtattttttggtagagacggggtttcactgtgttgatcaggctggtttcgaactcctgacctcaagtgatccgcccacctcggcctcccaaagtgctaagattacaggcgtgagcgactgcacccagccctggggccctgttcttatcctcagcccacttggttttcccatccctagggagctagtttcagttctctatacttcttagccacaggctgggctcctgctaaacagcaggtcacccggaaacataacatcactacttgtgcaccacagcactgccactcacccagaatctgggcatcattcttgatcccttcgtctccccccaggtcctgttgattttgccccccgaatgcccctcaaatcattctcttctttccatctcccctgccactgctatagaccagacccctctagcctctcacccaggcaactgcagcagtctcctaaaggagcaactcgcctccagctgctcggcagtcaagtgacctttgaaacacagatcagatcttctcactctccatgggatcactggcttccaggatgttaaggataaagtccccaattccttaacatgcgtgaggatgccatgcccaatctccagcctcatctcaaacaccagcccccattctctgagctccagacacaatggtctttcccttcctgaagcccatccaagacaccccgccctttttgttgctttaggacctctcctattgacacactgggcctccttgtttggaatggtgacctgtccatataagtgtgccataccctttggacacagtgctttagacagcaggatgtctaaagacactgggtgactctacccccagtcagtgtccccagctatccttctgctcaaccacctccctggccacccccatggctgaggtcccagcatggcctgcctgtgagaaagtcccattcagacacagaacaccagtgaagtggctaccacatcctctggcccctgtttccaagacctttctgaagggcaaggaagcaggggacagtggaaggaacataaggtttgcttttgacagctctgggtttgaatcctgattctgctactcattagctgtgtgactctgggcaggttgcttaacctgtctgagacccttttcctgctctgtaatatgaatagtccggtagttaagaatgtgggctttgaaatctgagtgcttggatgtaaattcctcttgccactgtatactatcctagagctctgagctttagtctcatgagaaaatgggaataataatcagtacctcatggactgttgtgagaagtacgatatcgcaagtgcttagcacaagtatgagtaattattatcatggaaatcatctagcattgt

SEQ ID NO: 81250 - DNA, 1051 bp, Homo sapiens
gagagaccctaggacagcctgagagtaactggacctggtattggtgcggagtggggaatatcccttgtctaaatgcagagcagctgagagaagttagcggggctcttcctccgttctcattgtttcctgctttccttccccacccaccccttcctcagcactctgtgttgtagcctgtactatcctgcttcaagcctccgtgtcccttgtaccttccccctaccttgagttgccagttctttactccctcaaatgttcccatgccacctctggggtttctgttatctgacatccctggctgctttcctggtagatgccattcccagagaggccaacagcgttcccaggcgtggctggctggtccgcatctctcagactcactctgccaggctacagttttgagaataccttttttgttgttgttttgtacctggagaactttttatgaatgagtaaatcttcagaaaggaattcctccacccttactgggttattgtcaggtgtaaacggcctttcagctgagcaatgttcctatgagaaggaagccatttctcttggctcatgaacactgccttttgggtagtatacccacacccagatctgtgaagagacctggaattgaagtctccatgtcgtcaggacttggtggcatgtggatcttgcttgacttgggaaaagagagggtggtggtgaactaataattatggagtccccctaatgtgtcgaacacaatgctagatgatttccatgataataattactcatacttgtgctaagcacttgcgatatcgtacttctcacaacagtccatgaggtactgattattattcccattttctcatgagactaaagctcagagctctaggatagtatacagtggcaagaggaatttacatccaagcactcagatttcaaagcccacattcttaactaccggactattcatattacagagcaggaaaagggtctcagacaggttaagcaacctgcccagagtcacacagctaatgagtagcagaatcaggattcaaacccagagctgtcaaaagca

SEQ ID NO: 81251 - DNA, 1100 bp, Homo sapiens
atgaaaagaaaagcaactgtgaataggctgaggatcaacgtggggactgactctcatcaaaagaaaaaccagtaaggaccaggtcagccattctccagacacttcaggcaaggagcccaaaccaaaggaggaaaaactacgcattcagttgttcaactgcctcagcatggttaatgtattcacttgaagtagaaatgttttgagacttaatgaccatgattaatatccctctgcaccccctccttcctaccacttgggaatctttggggaatagttaggttcagagccacctacaagaaaggtcccaggttgtcattcttcataccttagaggaattctcctgatgctaacacattcccaggtgtttcacagaattccactaaagctggggggtaagattcatcctgtcgtcttctcatcctacccacaacctcaaccagtatgtaccatgctcctgccaggagatacaactgcaccaacaccaggtacctacccactcctcgtcctctgccccatccccctgctctcggatctccgctgcagcccccttcgaacacttttgggccatgatgttgtctgtccaggatgcccctgtctttccatcaccagtgaaattacacttggtcactgttccagcctcaagtttggccaatgaatctgaaagaagagatgaaattgaatgtcctctgtccctgtggcagaaacatagtgagggctgggcccattatggtggggtcccctaggcctgggttaaaccactgttttctccaggcatagatgtggtcaatgagcccctgggtgggacccccaaggtatggtgggagagtcgctcacaggaaccatgggattgggtggcacccggggatccaggctgtcgagcccaatggccctagggcacttgtgcagggatttaggagtaaatctcaagggcttggtcgtgtccccatggaggccagcccttgcctgctcccatgagctctaggcagaagggaggccaagagcccccatgggccacacaggaacagtgggccacagtgagggttgcattgctcacccaggaagggaccatcgccccgagtcttcagccgtaccccggcccc

SEQ ID NO: 81252 - DNA, 1019 bp, Homo sapiens
tccaccccttctcctcatcaattcctcccacacttccctgctctccctggcttttcactgaagggtcccttctcccagggaggagcagatgctgagccccattgtctctcccccagtgactgcagcctcccggggacacgacctgccactcctcacccctccccccagccctgagccctgggcctttagaaacgagagccccaaggccacggcccctcgccccaccctaaaccagctcctggtgctctgagctatgactccagtcactcagaacacatttgtctctgacgaggagtgaggaaacagtagcctgagagtttggttcaacaagaaggacaccatggtcttttaacatcagcaccctgagcccccaatgaccccagggcctttgcccaggtctgcaggaaaccacatttccgtcatcacttgcagcctcccacttagtacacccaagctgcatcctccaaaaaagcagaatgcagctcttagagccaagcatgcacttaacaaatgcctactgagtacctaccccgtgccggcgaaggtgctggctgctgaggaccgaatcatcagcaagacgcagtccttgctttggcctttggctttgcaggcgaaggagcaagaaaagaagacagcaacctcagtgccatgcgatacaggcaagagtgaaccaagaaagctcctaagagggtgcttggactaaggtggtcaggtgtggcttcctggaggaggtcgtgtctagattaggctgtgctagccaaatgcatgggagagaacagtctgtccaaaggccccagggcaagacggcacattattacaggttcttagaactgtcaagagttgaagtgtttactgcagcttagaatacaagtgggtggggggagagtgaggatagagcacaagtgggaaaaaggggagggtgtcagggaaatattcagattttagcccctcccacttgctaacttcatgaatgtaaatgaataacataacttcagtgaataacttcgacttaatttcgg

SEQ ID NO: 81253 - DNA, 1197 bp, Homo sapiens
ccaggccctgggctcggggaccccgccagcccgccgatcccagcagctgccctgagccccttctccacccgggccctggcgctcggagcccgcgccgctccctcgagtcaggccgtccagggctctgctaacagctgtttaaaggcttttgctgttcagtgctctgcggggatgtttgttccaggcccatctgcctactttaaaaatacataagtgaagcacacacacccagcttgccacctctggctggggaggggcgggctcggcggccctcgctcgcacttgggaaggaaccggcacccaggagccgcacccgtgccccaacacccgcaccggctctcctctccagaggacgcccctggcttcccttggggggggcggggcgcagggcccccgggccccctttgtaccggacagggccgggccccccatttccaagcgaggtctgcctcttccccgcttcagttaatctttgttccccttttctgctgagaggagaaaaaaaaaagagagagagagaaagaaagaaaagaaggaaaaaaggcgtgacttgattttcaaacgaaactcccacagcaaacaaaacccttttagagaaataagaaaggaggaagaaggaagaaaagagggaagaaaaaaacaggagaaagaaaacccttcaggctttcaattcgagtgggagagttgaaccgaaagaaagagaaagaaaggaagaaaaatcctctgcggtagaaagagaaaagaaaacttgggctgacaagagggaggtgttgggggtggaaggaagtgagaaaacaaaagagagataaaagggctgcttttctgtctctctcttcctctgcgagctggcttaggaggagctgttttgcatcccttcacgtcagccctgcctcattcccttcttccagggagggagagagcgcgagcgagagagcgagcgagaggaggggggagagagagaaagagaggagccggagggagggcggcaggagcaggcggcgggcgcgcgtggaggcgggcggcgggcgcacagcagcagcccgggcggtgggcagccaggagcccccggcccggcccggcccggcccgccgagggccccagcgcaggagccgcgcccggacccagggtgagtgtcccgcgcggccccccgccccagccccagccccagccccgcagccccgcgctgccggccggcgg

SEQ ID NO: 81254 - DNA, 1179 bp, Homo sapiens
tggaaagatttaagaggccagggaggtgcttgtgtggattttaaccaacctgaaagggtcattcatgtatctctaggatttgcgagacggttagggcaaggcgtagcagtatccggggtgccttttcttttttcttgatatggagtcttgctctgtcgcccaggctggagtgcagtggcgcgatctcggctcactgcagcctccgtctcccgggttcaagcgattctcctgcctcaacctccccaatagctgggactacaggcgcacgccaccacgcccgtttaatttttaattatttttaggagagacggggtttcaccatattggccaggctggtctcaaactcctgacctcgtgatccgcccgccccggcctcccaaagtgctgggatcacaaggactcttcgaggtactcgtcctactgggtctgagggaggcctgccgggcaatccagtgagggaccaacgtcatggcccacccttgagctgcaggccgagtgcccacctgcaaagggcaccctgagcacctttcttgctgtgcaaaatggaaactcccggccggtatcgacctgcagtgtacataactagtccctgtgggcatctgggaaattcacaaaactcccccacaggtgtgcggagaaggactttgtgctcttgggggtcactcagccagctttgaagctgccctctcagtcctgcatttgtacacgtgtaagtaaaaccagtcaaagttcatttctgccaagtagagggctgggggtctgtgtccctattgcatcttcaccagggggcctagagaaccaatggggccacgtgggagaagggaagaagaaaaccgttcttaactcgttagataagagacagtgtattcctaatgtgatcaaagccgatggggctatctggttttgacttctgaaaacctagagtggccattcctttctcatttgttttaaagagaatgttattttctatactttctcattggttttattagctgaccctcaggccagggtaactgtgctgggtacctgccagtctcggagcagaacctctgatcggtcatctgtagctccagagaggtgcccacctggtgccccagtgaccttctggagctggctttcctgcatgagggccgtggggatagagctgctttcttttgggtagggggaattggatgtttg

SEQ ID NO: 81255 - DNA, 1806 bp, Homo sapiens
ttctcagagctgatacctgggtgagtcctcagcccacggtgtgtggtcagcgggccatttttccagggcttgggtcatttccattccaaccaggcatttcctaccagggagacttattttaggctcactgtctagagacaaggagacagacaaggtctggaatggtttttgagttggaggaagggagactaatgggaccaccagagattttgcacttctattttaggtttgccttgtggcccagagatatttctagcagagttgtgtttggaaagaagcacaacttctttctagaagggagtaaataaataaataaaggaggagtccagcgcatcttggaggagacaagtgaagtcagctccctggccccaccagtgctgatgcttggcgcaggctcataatctggcttgctgacccctcccataccctcgttcctcaggcctagccagggcctagcccgcggcaggactcattatgttgaaataaggaatctgtgaatgtgctgggcctgctgttaatggtgcttgctcccagccctttgacttcaaagctggaagaaggccttagagattgtctgaaagcaactgaggcaggaagaaagctctgtacccaggattacacagtaagtggcagagccagcactcaacctgagctttcagagcctgttcccagtgctgtttctacaaggccactgtctctgctactgctggggatcccgaatcaagctcacttcaaagaatgtagctatgagagcatgaaaccgtgcgctcacgccgcacacgagttgggtaaatggagcgcctcattttccagatgtgttacagaaactgtgctggaggatgtgactggccagtgagacaactagggggaactgggtgattcaggctgtttcaacactgacttcttcaaagtccaacaatcagagaagcagtttagtcatcgggattttctcacatcacaccattttttgatctggaatgctttcttcatactttgacttgtatgtgatttatttaggattggtcaggagagaagagaaggagtgtaaggacccaagacctgaactgatttccatctgtgggttaaatgtactagaacgtttgtgagggtagacgtctttgctttgttcattgcggagcccctgtgcctagaatagggtctgatctatagtgggccctcagtagatacttgctgaatgaatgtactggacattagggaagatttgcctgccagaaggaacccatgaatgacacaggcagggacagggaggtgattgatgggagctgcagagttgtgctgtgagtcattgcttcaaacaagctccagacaggtgaggcaggagggggctgggaagagaggatcctgaatggggtggagcccctgggtggagacttgtgcaaaacaataggtttttttagattttttttttctttttttgagacggagtctcactctttcaccaggctggagtgcagtggcgcgatctcagctcactgcaaccttcgcctcctggcttcaagcgattctcctgcctcagcctcctgagtagctgggactacaggcatgcgccactacacccagcctaatttttatatttttagtagagacggggtttcaccaggttggccaggatggtctcgatctcttcacctcgtgatctgcccgcctcggcctcccaaagtgctgggattacaggcgtgagccactgcacccggcctaaaacaataggttttgaattggactcagaatatagggagaataataataatcatgtgtcttaggccagaattatgctacgtgctttgt

SEQ ID NO: 81256 - DNA, 4622 bp, Homo sapiens
ttttaggggcctaactgttcctcaagcagagtggctgttgtgagattagggctattttgcacttgataaagatgtaggagatctttttatgggcaaagattgcttttcaggttaaagtttagttggcatatatttgaaactagtgggaattttaaaactaagaaatgtcctttttggccttgataccaccagaggctgtttgccacatgtgtaaacattacctgcctgctccaggatgctggcccagcctgttccagaccacagcagctcctcattcattggcagtctgtgatgtgctagacactgtgcaggtcccgtcctcgtgaagcttgcagtctccctgggaggcaggcattaaactaataattacacaaatactctttaattacagtggttataaatgcttcaaaggaaaaagtacagaggcatagaagccagtaatcatggagagggggaggggaggctttcctgaagaaaggacatttaaatagccacctgcagtgtggatgaagaggctttaaccagggtggtacagttcattaaccttgatgtgaaccttgccactccatatgtggtccatggaccagcatcagcgttacctggtagtgagttagagatgcagagccctgggctcctcagcaaacctactggatctgcattttaattcacatgcatggtaatgtctgtaaagcactgatggactcaaaagtactgaaatgacaggttctcagctttgctgggagctcattgggtgacgctgggaaagtcaccctggggtgacttctctgatgtttggctttttccagtttgtgctgtctacctgcttgttgagggtgacccacccctgtgttgctgttgatggagaccctgcagactctagtccatgctctggtctgacttctgtaagcactgaagatgggctgaaccatcagagcttttgataaggatcagaataattccctaaaagtgtgtggagctgcacacagagattgtcttaaggtgaccctgggaggatttggcctgaagcaagagaaaaactggcaagggtcaaaagggctttggggaggaaaggtgtaacgtttctgccaaaagcggaacctaaaacggggagagagaggcacctgctcaatagttccatgcatgggaacataatacttttaagaattgcctcagagttttatccctgagaccttcacatcactgtagagaagaccagacggttgaaatcaggggtcctggactcttgcagtgtgtgggtgggcttcaagggtcaggggtacttgaaactgtgcagaaggttacatgtgtgcacttttctgggaagaggagccgtagctttcactggcctcaagggagattgcggctctaagaatttgtcaaatgtcttactggactaacctcacccaactctcttgttatacagcacatgcgatatgccaggcataattgtaaacactttatacatactgttagctcatttaggttgaatacctttctggaggtcacagatctagtaagcctcagagccaggattagaacccaggcactggggtcccagagtcgctggttgcaaagcctaccctagtaacagggcaagcaggactaggggcgagctcttttttggtagcacagatgaagaggctcacccccacccccactttacaagtaagcatctccccagttgttcatgtaaaacatagaaagcattttcccaaggaagcaccttgtgaatagctccaggttgccaggctagcccatgaaagcctgtatcactgttgggcccaactcatgcttgtttgcaaagaaagtaattagaaaacaaaactgctgccgcaccaaaggctaaattaaaaattctagaattggaaagaaggcacttgaagaattgcacccttaaatcagggaggtaaggtggcaacaggaaattggggtagattctgaaagggagggattaaaggatgttacagccaaagcacagccaaatatatgttgaatcagcagcttcaaaaggtaaaacaactgttttttattacctactaattaatgtgtatggctcacagacctgacccttcccccatccctagtgcctaccccaagtacagaggccttttgtcttttctctcattcattttgtgttgtttgaatttttatccagtatgtattatctttattatatacatgtagtatatatatatgtatagtacatatgtgtatatatatgtatatgtgtatatatgtatatagtatacgtgtgtgtgtgtgtgtgtatatatatatatacatatatatatatgtatatatatatacatgaagtaaaagaactattagaagtgggttggaggccgggcacagtggctcatgcctgtaatcacaggactttgggaggcccaggcaggaggattgcttgagcccaggagtttgagaacagcctgggcaacatagtgagaccctgtctctacaaaaaagttttataaatcagtcggtggcacgtgtagctgtagtcccagctacttaagagactgaggtgggaggatcgcttgagcccaggaggttgaggctgcagtgagctatgatggcctcagtgtactccagcctgaaaaccctgtctcaaaaaaaaaaagaaaagaagtgggttggtctctttcgcaatcaccattgtaaaggattttctgatattaaatacatatgctctattgtgtgtttatttctgggagaactaagaaaactgttggaaatgtgaggatttttagtgtagtcggaagctgagaataagtgatcatattgcgacccaactattttccctttcttctttccctgcccccagcatgttatatatatggaatcgaaatgaagttagaatggtcactacagaaagcaggaatgtccaccctccgcatttaaatgggaaactataacttttgtgataactcttggttatgtgtgtttttgtcttctggatggtacctgaaatgccatcccggaccccatcccgttctcggtgggactgcaaggatatgggcttccagactgggaagactgtcctgcatgtgtttggtaaaagacaacggctaaaacctggggcacatcagaatgtcctcgcaaggaccaagtccaagctggccccttgagaagcatcaggtaccctttggaagctggtagtgctggtcagtttaatctcactctgtgatgtccgatcctcgggccctgggctcacaagccatcgcttcccatcgtggctccattctgtagctgcaaatcacaagactgtagacttgccattacccagaagcaggtcacctctgaaattcagaactcttcctgtcctcccactacacagcactccttgaagcagccctgcccacccctgccccaacctgggaaatctgtgcccacttccctggtccattccccatgtgcccaccatcagccccactgcttgttcctctgtgtcctgccctggcttcctccctaggtctgggcaccccacatcctcctatgccttaattctctacctacagctacagtcacacctctctctccctccccaaccccaacctgtgtcacttctctttaccctaggatttcacaaagaagagtccactctgtccccacttcctctctccccctcttctccttgccagctcaacaacagtggagcgtttcagcccagcccactctcactccagctggctctcctagaggtccctggccacctactcatgcccagtggcccatcttgtgtgacttcctcttacctgactgcccggtggcccatcttgtgacttcctcttacctgacttctccatagcagttattgtcatgaatagtcttctccaccttgggtctggctcatcactctgggtccttttcctacctctctcatctgtttttttgtaccattctttcctgttgctatgctttggtgccttggccacagttcattgctacttgcttacctaccatgactgtggtttcagcctgtataggactcttggcctatgatccctgtcctcatgtctcctgtagacagcctagggctggatttccttttgtttttaatctagtctgatatctgtgctctttaaccagagagttcaagccatttgcatttgttatggttttggaaatagatggatttcttttttttgagacagggtctcactctgtcacctcggctggagtgcagtggcagatctcagctcactgcaacctccgcctcctaggctcaagtgatcctcccacctccgcctcccaagtagctgggaccacaggcatgcaccaccacagctggctaatttttattttttttattttttgtagagatggggtttttccatgttgcccaggctggtcttgaaccctgagctcaggctatccacttgcctcagcctcccatagcgctgggattacagtgtgagccaccgcacctggccaaaacaggatgcagatttctttctaccatcgtatttggtgttttctatgtgttctttttctgattcttctgttcattcttttgaattgattgaaagatttttttctttccttcagtccgttttttctctactgctttgaaactcatatactctttttaaaaattttttatttttagagaaaggatcttg

SEQ ID NO: 81257 - DNA, 2980 bp, Homo sapiens
taagagatacaaaatcatccagctccggctgtccttgtgtgtggtgccatatttattttctaacttggagtcatcattctttaagaaagaagcagggtccttttgggctgaggaatgctctcgggggtaggaagttttcgggatctgtgggcctgagctggcatgtccaacatcctgtcactatactgcttggcatcttgcaagggatgcatcctaatgacccatcctgtccacttttgtttggttacttggtgaaggtgggagtgtcttgaacagcatggtgctgttcccctggaaagtttatactcatcagtgcccagttgtttgcagaattcgagaatggatgggaagcacccaggaaacggttcccaaatggatgcattttgatatctgaaatagactttaaagcttttggcttttgatcataaagggaccggcaacattgagacacctccccactgctcctcaggttttcctggtgcttgaataattaaggccatgccctatggaatctccttccttgggctccagggcatctctcttagcaaaggctagcttctcactcacagtgtgctgtgagcgctctggacgtcctacccagcattctgctccatcatcttcttgtgttctgtctcccccagaaaaacttctgtgtaacatcagctgtgttcttttgcttcaattacagagcttgttagaatttctcttccaaatccctgttttggggcttttcttttcttttttcttttttttttttttttgaaatggagtcttgctctgtcacccagactggaggacagtggcgtgatctcgactcactgcaacctccgcctcccggattcaagcagttcacctgcctcagcttcctgaatagctgggatcacaggcgtgtgccaccacacccagctactttttgtatttttagtagagccggggtttcaccatgttggcaggctggtcttgaactcctgacttcaggtgatccgcctaccgtggcctcccaaagtgctgagattacaggcgtgagccaccgcgcccagctggggttttcctaccgtggttgtaaaaattcatttcttgtcgccacctagattaacaaatctcagattaagaactggccttttttcgcctcctctttgaattcactgtctaaagaaacggccattgccctttccgtaaaccaggacagaggtcatgtctgctttgcctttttgcaccttggcccctgcctgcccctcacctccccactcagctacagtgactggaagggcccacacaggaaagctgggccctgggtcttcatggacgttgctggaggatgtgtctccctgctggtggctctcagtcttcctgtgctcagtagggccttctggaggattctaatttccctgtcctggaaaccaccttgaaaatattcttaaatattcttaggtggatttaagatgtctctgtctagtggttttttgtttgtttgtttgttttttaatccatcttagatttgaatgcccaaggaatgaacagtctcttggatcttgtatctcttccttttgttttttagaaaatagcttttattgatttttttttcttgctacaaagaggttgatgattattgcagaaaatttagggactataagtaggcaaaaaagataaaaaccacctataattattaatattttagtatattgtatagcccccccagaatatttttcaatttcaaaagatgagatcatactgtttgtaccatcttattactttttctttcttttttttttttttttttttttgcttttactttacaacatgtgattaaaatttccatcaggttaagcagcctccgtcaagtcactttaaagggttgtatagttcttttgaacagatggactatcatttatttaaccaatctcctacatttagcttgtttcctctgtttctgtcttgtaaagaatgctgtggtaaacatccttgggtatatttgcccacagacttggttatttccttgggatacatctccagaagagaatcactgggccaaggacacattctaaaggctgttcgtctagatgggtaaattgcccccagacacattgtatcatatttggattctgtttagccaaatactaactcccattcttttaaacatggttgtgagtctttcagacctctgtttcctaatgtttctcacgggtcatacaggttggctgagagtaaatggcaaggaagggcctgagagactccgggcacagctgacctaggaaagggagtctgtcatcctggcccgtcgctttacaatgggagtgcgagggctgggcccagagaccctgtcttgcctcccatgaccccaggaagctgcaggcctgtggctccccagggtaaccttctctggtgccagccgttagggtgcccgggacagagagctggctttgaggattccagagtctgtcagagaacttaggctggtctttcttccaagagaatgctcctaaacaaacatcctgccctaatccagagactaggttggtgcttattggggggcggtgagtgggggagccgaggatttcctgtggaggcctcagactctagcccaggagtccaggccaaggaagtgcctctgcccagactttcagccccttgaagcccagttcttcgtcatcacttggtgtggggaacagagggaagtttgatggaattactgaggaagtagcatttacgtggtctaaatcggaccttcctgttcccactgctgaccggctcttcctccttttccgctgtcttcctcctgcgtgacagcgcattcttcatggggcctctggggcccttcctgtgggctgagcttctttcttcccttttctctcctgccgggacctagactggtgcccaccttcaggactgggcacatccaggcacctcacagccccttccctcctccagctctgctaccaacgcccctgcacccttccgtccaggcagggctgtcccagct

SEQ ID NO: 81258 - DNA, 1743 bp, Homo sapiens
ccaagcccagcccaccctttcttctcagttctgccaagaaggccatgggggctggtggaggcccgaactgcctccccgcccccggggagacacagcatgccagctgctgccgggatgggttacaaaaaacaaaaacacaaaccccagccccttgagatgagggacgtttcggtttctgtgaacctgacgcctcatgtgtgttggaaatgagaggcgcagtttgggagaaggaggctgcatgtttcccctggggtgggctttgtttaaattttaatatgctcttcctttttctcaaagtgccagcaatggctcccagctcctttgtcattttagccccgttatctgtctggggatgagatctcttatctgcccggtcctccctctcctccctgaatggcgggtcccccacccgcctccccgcaacttgtgacagtgttacagatctcattctgcaaccttagattcagatgaaacttgtcactttgcttctttaatcaattaagatttggggaaagcaggggtccatttgtgatagtgttggacccaccaagggcatgagtagtgggcaactttggagtcctgtgagagagggtgtggcacccccccccccttagcagcctgggggacgtcagctccaagggtgagggtttcagccctgggttccttgctatggagtcaaacgtttctccagtgtgtgttcagacttctgacctggacccgccttagccttggggagctctctcaactgcgtcctttgttggatggaaactgcattagacacagaaacacagagctgctcttttccccacaggcaggtgcagacctgaaagagccccgctgaagcggctcagaggcaaggggaggacctcatccttaagtcacaggactcaggattagaggacctacagctttcagcctcggctcaccatctcctagccctgatgacccacagcctccccaagccttggtttcacagcctgtaaaatgggttcatgagcctacttttcatagctacactgtgtgtttgtatataacccatggctatcactattacctgcggaccgcggtgctatgaagtcaggagacaggcctgcaccatcctgaatcctctgttctctgaaaaatcgccctttgttctctcttacttccttcattcaatcagcaaacatttaccaactacctaccatgtgttaaactctgtcatattaaggtgaatggcatggtctctctccccagtgagcccccagtccagaaggggtactagatattggatatagacacaaaagcacaggaagttagctcttcgaatgtgctgggggcagggggctgtagggaagactgcttggtggaggtggtgtctagctgagtcctagcagacaaaggcggcatgggggaccaggcgtggtggctcacacctgtaatcccagcactttgggaggctgaggcaggcggatcacctgaggtcagaagttcaagaccaggtgaacatagcaaaacccgtctctactaaaaatacaaaaattagccgggcatggtggcgcatgcctgtaagtcccagctacttgggaggctgaggcaggagaatcgcttgaaccagggaggcagaggttgcagtgagctgagatccagccactgtacttcaggctgggttacagagcgagactctgtctcaaaaaacaaaacaaggctgggtacagtggctcacgcctgtaatcccagaactttgggtggccgaggcgagcg

SEQ ID NO: 81259 - DNA, 1249 bp, Homo sapiens
cttgaacctgggaggcagaggttgcagtgagccgagattgcgccactgcactccagcctgggggacagagtgagactctgtctcaaaaaaacaaaacaaaacaaaaaggaggcatgggggactcaaacatgcaaaggcagcaagggacacacttgaggagtccgagggggattgtgggtgagatggtagaagatgaggctgcaggtataggtagggaccaactgagaatgtgtcaaaaggctcgggcttcatcctgaggcctgggaggccactagtgggttctgagcaaagaaacactatggcggatcactctggcataagccgggagacttggggcttgtgttgttaaatccctatggggaaatccctttggaaatgttgacctgagagacgagaaacccctcagaggaatacatatggcacttttacttgaattccttttcatttcgcctagaatttctgctttgcaccagctgtttacatataatttacaaaagtacattaatgggcttgattgtgtttcttaaaactcactgagaagtaaccccaagtaaaatttttccactggggcatgttcttaatacatatttatagttactgaatccatttgagaatgtagaaagctcttttgaaatgttgcgggagtacatgacatcttcaggtagggttttccccagtcctggcaaggggaagagaaggagaattaatgtctgtcaagtagctgctataggccggacactgatctagattctttgaattcagtgacccactgagaaatagcattcctctccccattttacggacagggaaactgaggcttatgaaggtggctgctttcccaaggcctcgcacctataaggagtggtagtgggatttgaacccagatgcgatgagtccaaagctcacactccatccattgaaccactctgccacccagctcctaagacctaccagaaaagtaaagcaggagctacagaggtaggtgagccactggacagcctggtggcttctagataaaaatcagagctaaaacaccagctcatttccattctccttgcacaagttcttctgctggctgacaaactggaagccagcccttctttgggtagcactcttccaaagagtgatagctgcaagttcttggctacattctgagttggaggttcagcccactgcatggagcagcaggtaggaagttggtgcctgtaggtggcatcaaattgaacataaacacacttgcaggtgaacc

SEQ ID NO: 81260 - DNA, 2699 bp, Homo sapiens
caccgggtatttggccagagttcctctgaattcacttggtctctggcagttgaccttgggttgaaaatgcagttttttgagtgggctttagagatcatgctgaggaagaaagaaaatagcgtgcacggatgtgttgctgtggttggatttcactggctgtttttcatatacctgtcttttccctgtgagagaaaacagccatgacagtaagcaggggaagctcatttgagagtaggggacgtggagggatgagggcagttctccggggcacccctgaaaatgaatttcctcctccagagccagggtgaccgggtccctcacagggccaccgtctgcaggcatcaacactcttttgggtctaaatccaattattcctcaagttcttcttggtggcttccttcactctctggccagggggagttttgcagaaatactgttctaacagcagagcatgtctgtgaccaaaccttgggcaaatacatatttaaagaaatcttattattaaaatagtcaaccttatggtttatgtagacaatctgataaacacagacaagggtaaagacagtacaaattgctccataatctcacaagctggaaattaccaacaccatttagtacttttgtgtatttcctcacagcctttttcattgcatatatgtaaatacactgtattttaaacatggttacaagcacattgaactttatatcatttttctttttcatttgacataacattatggcaaacaaaaactttaaaaaagcacatgggctttacaagtgagcatatgctttgcaaacatttctgtcagctaccagtaaccaactgcaaaaactcatattctacccaaaacagaaattgtgccagtcggggagtcctttgatcaccatgcagtaaacctcgccaaaatattgtaaatttaaacaaactaaaacccaaccacttgaaaaaatttaaagcacttaaattgctattggttcaaggaagaaataaagaatgtactgacaaatatttagaaagcattgaaaactagaatgccacatacccaaacctatgggagacagctggcactattctcatagccttaaatgcttttattattaaaaagggagagagaaaaggcaaataaactaagcattcagcctgagtgcttaggaaaaaaaaagaataaaaacagcccctaaggaaaatgagaggggaaaaaaatagtaaagataaaggcagaaatcaatgaattaagaaacggaaacacagtgaaatcagcaaacgtatccaagagctgattctgtttttaaacaaacagtaaagtagcctaacccctggcaattctatttgagaaataaaagggagaaatgagaaaaaaaacaaaacaacaacaacaacaacaaaaaaaaaaaagggaatgagaaaggggacattgcaatagatacagaggagattttaaaataatagaaacgtatgcacaatcataggcataatttcaaaatctcaattaaatgcatgcttttctgaaaatatatatgttgctaattgagaaaaaattttcaatccttatcgaagcattgcccctctacccaccaaagacactggtcccaagtgtttttgctagttaattattttgaatttgataatactgataatgctaagctgttccacagcttagcaaaagatggagagctctccagttcattctacaaagcaaaataagcctgatattaaacatggcaaagagactattttgaagcatgaaaatgctgggtaggaaatagaattcaataatatattaaacaagtcatccaccataacccagtggggcaggaggaaagaatagtcaatattaggaaagcttaatatagtaactacgtcatgctaatgcattaaaaaagtaaaaccgtattgtttccaatatgtgctggggaaaaatgattaaattgaacaaccatgtctacctaaccaatacagcaaaaaaaaggaacagaagggtgcattcttagcataataaaaaatatttcaaaccaataaccaattctgtaattaacttaaacactagaggcattcttgtggaaaccagtaacaaaataaggaggtctgccatcaccatcactatttaacattgcttttaacactctagtcaacatgataatactgaaacagaaacatataaatattataaagaaagagtaaaagtattaaataacagtaagtacaatttaccctctgccaaatcttaggctagaggtttatttccaaagtttagaaccaatagcaaaagtcatcaaaaaattcaacagatttgactaccttaaaaaattgtaacttctttttcttcttctgttttttttttggagacagagtcttgctctgtcgcccaggctggagtgcaatggcgagatctcagctcactgcaatgtccaactcctgggttcaagcgattctcctgcctcagcctcccaagtagctgggatcacaggcgtgtgccaccaacccggctaattcttgtatttttagtagagacggggtttcaccatgttggtcaggcttgtctcaatctcctgaccttaaatgatccacctgcctcggcctcccaaagtgctaggattatagacgtgagccatatgcccagccattgatattttaattctaccaagatcctatatatagattagtttttaaaaatcaagatttaaatttgaaggccttg

SEQ ID NO: 81261 - DNA, 1917 bp, Homo sapiens
gtgatggagtgagacactgtctcgaaaaaaaaaaaaaaagatttaaatttgaagacaatatgcacagacgatataattagcaaacaaatgcccgacctaaagaaaatgccaaatggtgagctccatgaggctaggaaccaggtcagttctgcgtaacagatactaaattgagttaatatttgttgactctattgaattaatatttgttgaagaaattaatgaatgcaatacaagttttgaaagtataccatttttaactttttaaattagaagagtttttaaaagattttattatgaaagaatttcaactattgagaaaaattgaaagtatataacagtaaatacccatacaccaatggctgagatataatagatgttaacatttgccatatttgcttcatctgcacaggtatatatattttttcctgaaccattttgaagaaagttacagagcacacatcatttctcccttcaatagttccgcatacaaatcctctgtcacccagaacttagcaatctgaatgcagggtatgggaagctgctgcactgtgctccaagggtgtctctgcagattgtcccagtctctgagaaggtatttaggagtcaccaacatgacctgctgatatgtaagagaaaagaaaacatgcatttattgtggatcatgccctgtgctgggagtttaccaatggcctcctgtttaaatcctttttacaattctgcccatattacaggaagttgaggttcagagaggttaagtaacttgccccagttgacacagtgtcattattcaccaagtcccttctgacaccatcaaattacctgacatttgcctcttccctttatcttctctgtgcgtgaatgcatggaggtgatttgttgggcagtgtggacagacgggaagcaatctcaatgtcctccagtgcaagaattggcaggcaaatggggatgtgtgtgaacggtgtgactatgaacatgggtgatcgattacggacatgcaagatggaaaattgcttgtggcatccagataagggaaaacaagtaggacaccagattgtatacactgtgatcaaaaccatgtgaaaaacacatgcatgaagaggactgggaagaaatacacaagaagtggttgcattagggtgagaaggagtattcatgtttttctcatccgtctttttcaaaccttttgtaatgggtggttttattaattttataatggaaaatgttaatttaaaagcaagttatttacagtttagtaagctcatggcagggaaaggctgtgctctgtttattgctcttactttttcccaacgcctactcccatgcctggcaattatagagataataaatgtgggtgtggaatgagtgcccactgggaaacctctcagaggactttgacccaggaacatatttgcacagggtttccctcagctggagaaggtttctctgggagagcaccagccaggtgtgtgtcatgggatatatttacagggtggtgagctctcctggtccaacctaaaaggtcccagcaaggtgtaggggcccttctggccatttgacatcaccagggcagttagtgctgatacaaaccacagagaatgaacaaactccaactcaaacgggaatggattttatgtcattctgggactttcaaacttgataatagaccaagcatggtggctcacacatgtaatcctagcactttgggaagccaaggtgggaggatcgcttgcggccaggagattgagaccagcctgggaaaggtagcaagacccagtctctacaaaaaaattttttgttctgttttgtttttgagacagagtctcaactctgtcgtctaggctggagtgcagtggtttgatcttggctcactacaacctccacctccgggttccagtgattctcctgcctcagcctccc

SEQ ID NO: 81262 - DNA, 1050 bp, Homo sapiens
cgcggtggctcacgcctgtaatcccagctctttgggaggccgaggcaggcagatcatgaggtcaggagatcaagaccatcctggctaacacggtgaaaccccgtctctacttaaaaaaatacaaaaaattagccgggcatggtggcgcgcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaagaaaaaaaaaaaaatgcttaatggattgtttggtaacaaatggataccaacaaatacaaaatggccatttctttttctttctttaaagaaacatttgaattggaggcttaggctcatctcaagaggttgtggacccgacagttggtggtgatgggttttgttcataaatgagaataatagttgtgagtttaatccaacacattgattgaagtgaatgaaaaagaacacataagctgtgtgaatatagtgactaatcatagactctcgggattgaaatgtaccctggggggatccaggatgcagcatcacccgggagcttattattaatggaaacgaagtatctctcacagcaccctagacctgctgaagcagaatctgcattttagcaagatccccgggtgattcctcagcacatttgagaagcagcgctctcatttgtcctgtctcctttgaggaaatcggaagactagagaggttaagtgaggacacacaggaagttctaaaaaactgtaactctggtctctcaacaccaggtctttgcacagcacttgccccatgggagaaacccggttggttttgtttttgcttgttttgcattcccaagaccaattcttgtgagccactggtcatagcccatctctcttgttttcatgcagcaggggcatcttcagtggccacgtcatctctcactctctgctggggagcttgttaaaatgcagttgcctgggtccagccccaaatccactggatctgggtgggtggga

SEQ ID NO: 81263 - DNA, 1148 bp, Homo sapiens
tcaaaaaaaaagaaaagaaaagaaaagaaaagaaaacaggtgaacgacagtcactcctggaggggttcttctgccagatagaaacaagatatcacatgcaagaggctctacacatggtctgcactcaggaaagggaggaattctttgtgctgttttgtctatgttatttgaaaaagtggattgcattgtgggtccccagaagttgccagctgtccttcctgtttccaaattcctgtgtgtgtgtgtgtgtgtgtgtgtgtgtgtgtgtgtgtgtgtgtgtattctgtgcctgtggtggtggtggccatggtgtcggcagcagcagggttgtcaggaaacaaccatcggtttcctgctgattaactcagttcctggagggccctccctagcagcaggggaagcctggcagcttggctgagcctcctccggcctctgcctcacccgccagctcttctcaccccttctgagaggcccgcctgctctcctgctaccctagagcccaggacacccttgcaggccttctgagccttctttgttctggccgtgggtggggcacccggctccacctgcctcaggttttgcctgcaggtgcatttcctttgcacacctggcgcctgttggggacttagacctcttccacatcgccccaaggtcgggctgaagagatttggatcttctgagttgcaagctcccagaaacgatgctgttaggaccctctgttcactcagagaaagaggcttgatggccggagccccagggcttccctgctggtagaaggggtgtctggagggcctctgccttccgtcatcagaaggaggttctagcaaggtaaagaggcccgtatagtactgggattttggatcccttgagtgaaggaccaggcagagaaggggagcactgctggaggatgtcgggggctgggccaggctgggcacaggcacatggccatggtgattgaccgcatttgcctcaccacttcacgtggggacctggcaaccacacaatggccctggggcatggtgtgggggctgagacatgaggcaatggtcttggtctcaaacaccccagcttccggctgctgggcgtcactgacttgctgtggcttcctggcctggctcagcattggccgtccggctcctgcagcagtg

SEQ ID NO: 81264 - DNA, 2958 bp, Homo sapiens
atgagcccatcagctcttggtggacaggtttgcacagttgcccctgctgcctgtgcagtgagctggctgcggaaggcaggactcccagggctaggagggtattagcaggctggctttcgggcctcagcaccatcgtgcttcttatgtgccgggacaggatcaggaccatgttgtgcctaacatccggcagaccctggtagcttcttaaatgatgacactttccagcactcacatatctcatctgagttaggccgggctctctagctggggcgggaagccccgcacttcctaatacctggtggctgagtcaacaacatggggacgtgtatttggatagcaaacagcgatcagcagcggagccagcctgctgccttcctgcacccgccttctagcaaaaatgtcctctggaaaggtcagccaggactggctacataattttcaggaccaggtgtaaaatgaaaatgcaggtctcatgtttaaaagtcagtaaaatttaaagaacagcagagcacgaaaccaaatgtgagcccttccttctacacgtggggccccaggcagtggcaccattgcatgcccccaaggcagcctggagtcagcgtttcccagccttgtgaagtcctcatgcttccaagggtggcaggattgggtcctctttggtagaagagctgcttggcatcctgagacgcactcgccccatccggccccacaagcagctttctcaagagctggagtgacttccacttcgaagcgcaagcacttcaccttctcctttttgttcttctctaccctgtttccttctttctttgtgaactcagaaagctttgagactcccctcccgttcctcctttcttcccctccactcttgccgcccgccccccaccccctccgcctctgtttctctctccctctttcccttgcttttatctgggggaacccctttcacaggtttgctgtataacatttctcttccattcacttggcgctgttcgattttaatgttcctttgaatgacaccaggcgagtgctccttgggtttccgaagcctctctctgaagtggctggagccagcgtcttccccaccgagggacgtcccttcagtggcctctggctctgtccagatggtctctccccattgggagcctggaatgaattctcattgtgagcattcatcactcaccacctcctccccacattcagctgtcagtcctactggccgcagtggaaagaaagcctgctccattatttctagtgacagacctggccatcattcccaaggtctgtggctcccatgcaggcctcgagctgggggtggggcagggcatgggaaagggttaaatagataagcccaagacacagtcctggcccccctcatcctcttcacacaggaaccagaagggtcttcagcaacatgcatgggatcgtgttacttctggcttcccatgcctgagaatggcatccagacatggccttcaaggctctgtctgcctcggtgaccccatctccagccactgttcccagttcacatcggggaattctccggccctcctagagaggcagcccaggttgctaaagaggcacttcaagcacatttcaaagaacgcaagaattctggagaggtggagagcaggagaatagcacaagcaagagccagctccagggtcaggctggagatgggaggtcaggcatggtggggaggacgggaagtggggctgggttcaaagcctggctcagcttggaggacctggcaggggctcggggtgggggtggagtgtctcaatcctggtgcacactggagttattcgaagggcttttaaaaattatcaaagttgttccaggttcattccccgggtggcccacacgctgtttttaagtttagctctccaacccttcttcctggttctccccttcccttggaagaaagtccctggtccagcctgggtgttggcactggcatttgccctcccagggccactgggactgggaatccccaggagggctttcgaaagtgtcaggaaccgctccttccactggggcttttctccactgatgggaaggctgccttgctcagtcagccccaggcccctggacagaaggaactaggggagcactaagcataggtgtccctagagagtcagctggaagggacctagttcagaagaggaaactgagtctcagtcaccagcgagtaccaccactggtggtactcagagcttgggtagcagagcttgggcttttcagccttggacaccaccagctaggatggagtgagggctgagctggaatgcttctgaggaaatgatctctgacccaagcatgccacaattatgagagcatcttcagcactcataagcatcgcaggctggatctctttctctgacctttggatgtggggtgccagaatctgtgcttaaagatgagggatgtcgggcttctgccctcaaagaactctggatctcgagggagcagtgggcctaagcatagagtattctaatacggtcgctaggcttccagagctgtaagagacaggcttgagcagggagagacgaattccccgagggaggccttgatgaggaggtgaagaggcagtgagggtctggtgtctactcccctttaaccacaggcctggccttccagccagggtgctgtaccaaagtgagtgctggggccgctaagtggtgcccaggtactgatttcccctcgacccgcagtcggctgggctgggtgggtctgtggatggtttggaccagccttgcccgattaccccagtgtacggtccaaatatgattttctatgtgtgccatgcagatcaggagcactgtagcaggcccctctctctatcaccagtgcatcactttcatcatggagcaggttgggaaacaagccaaaggctggccccacagacacaaagaataagtcacaactcacccacgtggtgtgtttcctcctaactctttagtt

SEQ ID NO: 81265 - DNA, 1867 bp, Homo sapiens
gccagaagttcaagaccagcctggccaacatagtgaaaccccatctctactaaaaatacaaaaattagccaggcgtggtggcaggcgcctgtaaccccagctactcgggaggctgaggcaggagaatcgcttgaacccaggaggtggaggttgcagtgagctgagattgtgccactgcactccagcctggatggcagagcgagactgtctcaaaaaaaaaaaaaaagtgcttctgatgtgtacagatgatttcacctgatgatttcactggcagggcagatgttctcttcatttcgtgggtgggattctgagaggttgaggccatgcccaggtccactatcttaggcaaaagtggaccagatccctgccttgtgacccactgtggggctttctgcagtgacagctgggagtcttgccccacgactggatgaggtggtctcacctcatttcactcctggatccaatacgtgcttggctgagtgctcaaccgagtattgaatgtaatctaatacagtccaatccatcttgatgactgcaagtcatgattaggagccctcggtgctgagctcaggtatggaggtgtccaagctgcttgccccacccctaatggccataaactgtcactgggtcattttcagcctgcaccctagccagccaccatcatagcctccagcagcgagtggcacctctttcacctccttgggtttcctctgcatctgccgtggtctgggaaactggataaccgtgcttgttagaactgagtccaaagcctccaagcaaggggcgctgtcccataaagaaaaaagtgcctgggacaccaaagtcccctcttcgagtcacccacatctgtttcattctggactctcaactttttcatatgctctgcagttctctaagtcttttgggggaaatttgaggtggccagagaagagatctctggacaagtgtaatcttgctatcacatattaggaaagaccataatgtacagcagaggtgcctggtgaggaaacagtcagcatgccagtgagaaccagagcctgggggcactttgtgcatggtggccatactgctggatgaccatgccagcttgggctgtggctgggtgaggtcacccaggcctcaggcctgtgcactgtggccactgcctcctctgcacgtagatcataccgcctttgttgaggaagtcgtgtctgaggatctggtccccagctctaggcaacagcagaaaccctggtacccagatcccccagtctccagggaggtgtccttagtgctccggatggggttgttaaagccacatgtgaacactccgcagattttccctgcaaggtacaagccctccagcctcttccacccaaatgtgtcaccttgggcagcagctccctgaattctgttctttcttgaaggaatttctgttctcatcagttcataagcacagtgccccttctgtttcttggcttaatgctccgggagttcacagtgatcccgatttgacttcacagtgactcctttaccaagccttttttgcttgtttgcttgcttttaattttgttttttatcagagtaatatatgcatctttttttacatcaaacaatactgatgggcttctagtgctaaagcagcaggccccgccccacctcgctccccaactccagccctccagccagttaaccatttgcaaactgcttacttcctccttcctgttatttacgtccatgttctgaaataatatgttactccagtgatttcttgatttatcaatttcggacattatcttttgcctccatattgttgcaagtgaggacttatctctccaccaccctatcattcctcctcctcctctcttagttttatcattaggtcgca

SEQ ID NO: 81266 - DNA, 1093 bp, Homo sapiens
gggcccgagggctctcatagaggagacctgcgggcacccagggggccgagctgcctttggagactgagccttgtgcacagcatcacaggccagggctctctcccttggctcacccaggaccctatgggaggaggccacagccaggcggccagggcagggagcagccgaccctgtaataaagctgatggctgccggcctgtggcgcccctggagagggagcaactccccttgggggtgtaacctgtttcggggaagcctttacagcagctctttgatgtttctccagtggaactgaatttattttttgtacttttaggaattaacttgcagtgctcagcctctccctccccagaaaggagagaaggagaaaagaagaaagggtttgcattgtcaccgtgattggcaccgcctgtgaatgaggggtcactgcttcaggctgctccttttcaagcaggcctttctcccctgcacgctgcattcacgctagaacattctttctttcaaagcttctgtctttctctcccccgccctttgtgtctctgccttccttcccttcacttttgcctttcattctgagccctcaccacctcccttaggcttcactctctttccctcttttttcccctttttcttcttctattcagttcctttttttttcccctcttgcctctctctctcccttttaaatttcttttttctttttctttttgaatagtgcttctgttttcaagggaagagaccagtagggaagtgggtttatttgagagagggagaatatgttttttctccattgctctaaatgtgtaaaacaacaacaacaaacaacaaaaacctgttgaagacactgttttcttttaggctcctgctttaaagagggaagggtgtttgggggtctccaccagccgtagggacctgttcgtcacacaggaggagtcctgagtgggtcagcagggataggtgactgaaggcgtgaggtgggactggcaggatctagacatggccttggcatccttcccttctgcctggcccaatatggggctcaagatgagggtgaaggcagaggcggatgtggtcccacgggcctccccactct

SEQ ID NO: 81267 - DNA, 2403 bp, Homo sapiens
caggtgtcacctccccctttgactcccccacataagacttaatcacatctccctttatccatctcctgggagttgtatgtcatagctgtcaactcactaaggtaatcatccatttactgtggctgctggagggcggagactgttgtcttcatctctctagctcctaggagaatggtgtgctgtccatgtttgccaggcagaaaagccttgcaaaacctcagtcactctacagtgacctcagagcttgagcctggtcaactggaacagcagaaagaaggaagctggaaatggcggatggcttcaaggacgtgagccatggagaggttagacagtgacggctgacaggtttgccgtctgggaactgttgcggacctgggtaagggtgcagctctagtgaggtcaacactgaggtgagcgcagaagccatgagagatggtttctctgagggagtccactcaggccaaggcctgagcccaggggccgctgggatgcaggaggccagggagtggtggtggtgcgtggcctgtgagctcagagagggttgtgtggctgctgccagatgaggaggaggcccagctcaaagctcctgtgtttggcaaagggctgccaccttccagaggacagctgagctctggtggaggggacagatatcatagagtagagcttgaggaggtgatggaggacatagatctggccccagtttagggggtggagagaaaacaagaaatcggacattgccagggttgcagcgggctgtggtgcatgaaagctttgagctggaggccagagagggaagagacgcgaggtagcaggggccaggtctcttctggaggacctaccgcatgtctcggcacatttctgccctgtagaaggggcacgtcgggcagcgggcctggaagaccctgggtacctcctcaaagcacagaaaaagggacctggtcacactctgggtcccccagggccacagagaaagcttgtggggctcccgtccagccagggttcccaggggccccaggaaaaggcatggtctctggggggacacagggctctctgcagaaggaagctacctctgggagggagccctgagatgtcagtggcctgggctatgtgagatgagggctccaggcccaggtgtgctggcacaagccatcaggcctggaggtgtggccggcaggaccctcccaaggcagaaccctgtgtgcccttcctcctgcgtacccagctcagtgcccagcccatagtaggcgcttcatgaatgtttgctgaagtgtgaattgcatgttgttagcagatgtagagtggaaacagtacagctcacagccaagtgctgtgtaaattgtaaagccttatgcaaaggggagtcctatccctgccccgcagagcccagggcctcagggaaggggccatatcctccccaagaagactagaggagggtggaggagggcggagggacgagtcagtgccaggtatggagggcggcaggagaaggaagggctagtgaccaagccagacacccagacgggtggggacaatgagcccactcatcagtagtgaccagacccaggtagaggaagagtgtcagttggatgtggaaatgagggaggtggatctgaagccccgtgatatggtgctgagcccctactatgtgcaagttgggtgctaacacccacttcccaggaggagggtctggggctccaaaggggttggggaaaaggctgtcctccctctgagtctgggtgaccaagacaagatgagctgtggtgtgggtaaaggtagcagggagtctgcttatctagggacgtttgggatttatgctccaggaaagggatcaagatggctttggggcaggcaccatagagatttgagcctgggcccaggggaggaggccaccattgctcttcctggccccacctgcttctcagcatactgctggcaacccggaagctgccagggcaggcctgcaaggccatcaggtttttccagtttgggcaagaacgtctccttacgcccatgaagatgcccacgcacagccacgctggcctagagatgaaagaggttctgggggtgggtggggacaggacgagggtccgagtttgaggcaggcatgtttccagggccccagtttcccaggtggcagggcacctagcagtcgattctcccctaagaactggcatcaaggagtccagctcctcccgtaactaacgtgtggcccaggcgagctgctgagtgctaataatagcagcaaacaccacaagcgtgccaggttctgctttcagcactttacatattttaactggtgaggcaggtgctcttggtaccaccccactttagtaaggagaaagagtcatgccattgggaagtagcagaggatgcaaactcaggccttcaactctagagtctgga

SEQ ID NO: 81268 - DNA, 1023 bp, Homo sapiens
ccctgtgacatccatggtcctgccctcgagaccctcttccgtctctccttcccaggccccactgccctctggttctcctcccgcctctcctctaccctgcagccaacaggctgccttggcctcctcctttgtgagctcctagtaatgagcagacccaggagctcctggctgggatgcccatcatgtggctcccgccttctctgaacttcttatctgaggcgagcatctccctccgcagctcaactgcagggtccagtgtgggtacccaggcttccaccccttgcataggtcctacccctcagctcactgcatgaaagtatcattgttaggtgactgaggaaggcatggctttgcgcgctgctcctgcctgcctctgatgatagcctgtgtggacggccgcatgtgtctgatgtctgcgtgtgtacgctatcagctgatacgttgcaccagctgtccctccccccaggagatacatgaaggcattacgtgaatgagagaggcattctttactcctcctggcataaatccgtactcgagctgggtgtgtgggtgactgcaaaataaatgttgattacagtagtggcttcgggaggcagctgctgccaggggctctgctggcatggaggcccagggaggagtcataacactgccatgagaacggagagggcttgtgcccaggccatactcttcacctgccctcagacctcagcaccttccctacctcctgcgcttctgtccgctttcccttcccttctccgtcccatgcttccagcctgggcaggccctcctctctggctgggtctatgggggaaggggtcttcctaatcagcttctcccttctctaggcctccctggacccctccacccaacctttgggtaataaacaccacagatcatcctcatttgtctaacgggctcagttaaaccccctaacaactccaggaagtgagaaccattatctcatgccacagatgaggagactgaggcacacacagaccaaggtgtgagtggtggggccagact

SEQ ID NO: 81269 - DNA, 1076 bp, Homo sapiens
ggaagggctcagtgattagacccttctcctgtcactatacagacaaggaaaccaaatcccagggaggttgagacacttgcctgagggtgtacagctcctaagtggcagagctgggggtggaggacaggtctgctggactgagaaccatgtatccctcccttctaccacctgcagaggaaggggctgtccttccccatttcctccccacctctgctgcttctcatctccccctcctcggaccttgctcctggggcccaggaggtgctgagccagccttttagtggaggactaccaataccatggcccctccctggcctgatccctggcgcagcaacgcttctcacctgcagccagacactcacacagctcgagggctcctgaagacctagggcccctttcttcatccccatgtgacttttttttgtcgcaggggacttgatcccattttccaccagtgcatctcttctcttggtcactttgagatgctggggccacagccatcatcggtttgcttcattttctgcagtcaatctccattcccagatctttgtttctcctgtcatttctgatcactcgagattaaaaacagcaatggagaagccaggaggaggctgagctaaggaggactcggagtgatgtgacctcagtcctcccaggaacacaggaagaagaggagtaaatggggaagaatgtgattataatcagctccaatcctgcctttatctcttactggctctgtgacgtagacaaatcacagcttctctaagactcagtttgctcatctgtaaaatgaaaattaaaacgtctatcttgggcctggttcggtggctcacgcctgtaatcccagcactttgggaggccgaggtgggcagatcatctgaggtcaggagttcgagaccagcctggccaacatggtgaaaccccatttctactaaaaatacaaaaaaactagccaggcgtgttggcgcatgcctgtaattccagctacttgggaggctgaggcaggggaatcgcttgaaccggggaggcggaggttgcggtgagctgagatggcgccactgcaccccagcctgggc

SEQ ID NO: 81270 - DNA, 1039 bp, Homo sapiens
gggggctgcggggccggagacctgcattctagcccttgctcccccaccgtctcactgtgtgaccttggaccattcccttcccctccctgggcctcagtttcctcatctgttaacagggccgggtatggtgcgcatcacgggggtttgtgggttggtggccctgtgtcaggggcccagccactctgactcccagaggtggggctcagtgaatctgtccacagagaaaggggaagcaaggcagagacaggatcgcaggaggaagagactctcgaacttcccctgcccctcccccgtgccggcggcagctccctgggcctctggctcctgaggcctgtgggctgggcagaagtgagactgtggcaaggggccccgaggcacaggccttccagctctcgcttcctcttcccttctgcgcatgtgagtagagtttcccttgaagcctcctgcgaggaggacaacaggggaaaccaagaggctggtttccttaggcggtgaaatcccgtgcatgtttttcacagcgggtgtacaggcctggaacttcctcttctcctcccacctggttacctgtcccgcccactccagcttcagcctctccagccccagggccctggactccaaggggcaaaaggcccagagccacatcctggagggcttgaatgccagacccagggtcaggagccccctccccgctcttgctctgttgggtcctgaactgcctccacggaagccagtcctcagtccctgtccccaccccaccccacccccatactgcagcccccgcctcccagagatccgggtgcttcatgtggactgagcttacgcaagtcaactccccaagggtgagaactttaatttgccccttctatctacccacaagcaagcacctaataggtttagtaaatgtgcattaaatcagtggctcaagcctggcacagtggcttaggcctgtcatcccagcactttgggaggccaaggtgagaagatcgcttgaccccagaagttcaagaccagcctgggcaacttagcaagactccacctc

SEQ ID NO: 81271 - DNA, 1029 bp, Homo sapiens
tgagcctccgcgcccgcccttcagttggtgtttgagatctccctggtggtgggaactagtcaaagagtgtccaggtggccacaaggtcctgttggttcttccttcaaaatggctcctgtcgtgcgagaccaggttttgggtgtcttcacccactctctgccctgagatctgtgtcccaagggacaccagccaccctgatcccacccgaccctcctctgctcctagagtgatggggtccccatgagaggaaaggagcactgttgtgagcagtgtgggatgagaggaggtgctgtcacagcttggggaagggaccctggtaaccagcaggtaggtcaatagttcccgttccaagtaggctcttgtgcccattttacagatcaggaaatggagacaggtggaggagccaggcgacttgcccagcctttacaggacccatggggcaaagccgtaggtgaagtcacagttagagattccagagctctgaggagacggcgtccctgcttgggtggggaaggtcccctgctggcccccagacgatgagtctttgttccctccccaggggctggcctggccctcaggcctgggaggtggaggtgccgagccctgggaaatagggcagtcctgggcttccggtgtcactgcacgcccctccccctcccgcctttgtttcttggcctccacagcctcattctctctccctccccctcactcaggctcctcctctgcccccccttccctgtctcttcatttcttctctccctctccctttctctctctctctctctgatatgtcctcccttcccccactcccagcacaactacaatcaggcagctcatctgtgtctatttccccgcctttcacattgactttctccccaccctggggaccgagggcatcctggtgggaggccacgccacatcccagccagtggtcgcccctcatcttgccagcctggggcagtctgagctcccctttctcctggacatggggggagcttttgttctgagtccttagcacaagtggtggga

SEQ ID NO: 81272 - DNA, 1071 bp, Homo sapiens
tcctggggcgtgaggtggggagcgcactaccccacccctgccccccgggttgttcctagtattaaatggctgactggggacctcgtgagtgtctgtaatgagaagctgtaggtcttccgtggtgtttgtcgtcagttgttggcagctctctgtgcccctgccctgcccccacttaggcacaaaccctcaggaacaaggactctgggttagtccctttctacagccaagcacaggctcctgacacagacgcaccttctcaagtccaaactacctgttcatatgggaaggggtttgcttcaggtgtcctggtgtgactataaggagtggccccttgtagaaaggggcccggtgtggacggtcagctccatggttacccttgctgtagggaaccacacttcagctcccacaggcagttcgctggctgacgtttttgccctctcctcacctctaaagcagtgttaactgtttccttatgcccgcgcccttgaggttggcgggagggggctgattcctggtattaggctgcaggggaaaggagagggaagggaactaacgacactgacatcctcatctcactgtcccatgagtcaggagcctcttcccccccatagagatgagaatcacctgatgtcacacggctagtagacggcagagcctggattgaactcagcatccagggccaagggggaagcactggcttggccattgatgctcagttcctccttcttgctggtcctgcctttggggaagtttacaaaaactgctgaacacatcatttgcccaaaccccacaacagacaggagggttgccgctgggtgctgtgtcagacggactgtcgcgacaggaggcagccatgctcctcagcgtgctctgcaaaactgacagtggctggagggcactgggggtggctgtggtgggccccaaggggcaggacccctgcctcattcaccttgctgtctccaggcacaagccctaacccatagcagggatttagcggctatttattgtacaaatgaatgaatgagttctctagtggttgtcctcagaatcacttaagctttgctgaatttg

SEQ ID NO: 81273 - DNA, 1040 bp, Homo sapiens
ctcactgcaacttccgcctcctgggttcaagtgattctcctgcctcagactcccaagcagctgggattacaggcacccaccaccacgcccggctaatttttgtatttttagtagagatgaggtttcaccatgttggccaggctggtctcgaactcctgacctcaagtgatctgcccgcctcagcctcacaaagtgctgggattacaggtgtgagccaccatgcccctgccaacagtgattctttacagttggttagggccttataatgaaccaagctgcttcacctgtgttaggaccgtgggccctcacaacccttccatgggtgagtgttttcatccccgtttttcagatagggaaactgagccactggcatgactttgcttagtcacttgcaagtgactgagctggcactcgaggtcctcgctgactgcatttcccagcagctggacattggggtggggtgtggtggtttggaagcacgtttagcccctgcggcctattccagatgcaccctgaccccccaggccgaggtttccttctatctgatcccttccacgagagcctcactctaagcttaatagtttaatctttggtgtccgtttcaaggaggctaaattcctgtctggggtatttttagccgtcctcaggaaggggaagctccgctgggcgctggggggagggggacgccttgcccggagccggtttcctgaggaagggccgccgaccgtgtgcctgaccgtggccctgggagaggctggtagttggtccgttgggagccctgggagcaaagcaggcgagagtcgccccagtaatgccatcccctctcctcagatgtgccaggtgttgaaccagggcaaggggtataggcccaggaggaggtcgccactgcctggcgtgctgcagtccttggaagcctggagagggcacgagggcaggccaggagagccgggatggctccaggagcaggtggacctcgagccacgcctcggaggctggtgggaggagcaggggtcagcagggttgggaaaaggctgccccag

SEQ ID NO: 81274 - DNA, 1060 bp, Homo sapiens
ccggccaccacgcccagctaattttgtatttttagtagagacaggatttcaccatgttggccaggctggtctcaaactcctgctgacctcaggtgatctgcccatcttggcttcccaaagtgctgggattacagatgtgagccaccatgcccggtctttttaaggaattcttgaaggacctgtagaacacaatttgagaacaattgaggaaatcccacctccctgttgtacagatgggaagactgaggccagcaagggggcagagcttaccccaggatctcccagggagatggaggagatggtcagatacacagcaggaatcactgctccctataataacaagtgtgccctgttcccaaggccaggagtagaaaagacatcagagccagacacacccaaaatcagccaagcccttgtctgtgctgtgtctgttgtctgtctgtgcaggagtgagccagcaatattaaccttcccttctccacccacagcgatgccctcctagctagccgtcacgggatggagggcttcatggactcagggacacagacggacgccgtggtggtgctgtccttggctcaggccgccgtgcttggcctggtctccgaaaatgagctctttggagctaccataagcgccgaggccttctacccggacctggggcccgagctttcaggggcagccatgggagagcccgagccaccaggccccgacgtctaccagctggcctgcaacgggagggccttggaggagccggcggaggaggaggtgctggaggtggaggcagcctgtgagaagcacacccggcggaagacgcggccacctgtgcggttggtgcccaaggtcaagttcgagaaggtggaggaggaggaacaggaggtctatgaggtttctgtgccaggtgacgacaaggacgcagggccagcagaagcccccgccgaggcggccagtggcggctgcgacgccctggtgcagagcagcgccgtcaagatgatcgacctcagcgccttcagccgcaagccccggacgctccggcatctgccccgaaccccgaggccggagc

SEQ ID NO: 81275 - DNA, 1059 bp, Homo sapiens
accttgtgggtgagggagtgctgcttgaggtggtgaatctggctgaactccatgccgcattcagtgcacacgaagggtcgcacgttctggtgcttgagcatgtggttctgcaactggctgcggtagtggaaggacttgtcacactcgaggcactggtagagggtggggccctggtgggaggccaggtggcgcttgagctgggtcagggtggagaagtccaggccgcactcgacgcagacatggcagcggccactctcatgcttcacttcgtgggccttgagctcgctggggtaggcgaagccgcggccgcagaagtggcagctgtagggcttgacctccgagtgcagcagcatgtggcgcttgaggtggctggtctgcgtgaaggccttgtggcatacctggcacttgtggggccgggtgccctggtgcgtcagcaggtgcgtctgcaggtggctgggctgcttgaagagcttgctgcagtgtgggcacgagtgtggcttgatgccgttgtggcccaggatgtgcgtcaccaggttgtacttggacgtgtaggacttctcgcacatgcggcactgccagcgcttctggcggtcgcccgcctccaccagataggagtcgtcaatctgcacgttgatgtccagccgatccagctgggccttcttgtggcgttccacggtcgaacccgccgtgtcagcctcgaactcactggcctcctgccacacgaagccctgttccggcttgacaggctccggggactccatgctgggggcctcggggtcactcaggggggccaggtggggtggctcgaacccacactctgtgggcaaggcctctggcccaggcagcgccatgctgggctcggggaagccatcccgggccggggccgggaagtgagggtcatatggggccacgttcagctccggcctcggggttcggggcagatgccggagcgtccggggcttgcggctgaaggcgctgaggtcgatcatcttgacggcgctgctctgcaccagggcgtcgcagccgccactggccgcctcggcgggggcttctgctggc

SEQ ID NO: 81276 - DNA, 1377 bp, Homo sapiens
cacatggaaaagcataaagagagaactgtccataaagaacaggattctgggccaggcatggtggtgcatgcctgtaatcccagcattttgggaggctgaggtgggtggatcatttgaggtaaggagttcgagaccagcctagccaatgtggtgaaaccccttctctactaaacatacaaaaaattagctgggcgtggtggcacgtgcctgtagtcccagctactcgggagactaaggcaggagaatctcttgaacccaggaggcagaagttgcagtgagccgagatcatgccactgcactccagcctggacaacagagtgagagtctgtctcaaaaaaaaaacaaaaaaaaaaaacaaaagaataggattctggcccagccatagaggtgggagtgggctggggtccggggaaagcaggttccccacaggctcaggacaccgggttgatgtgttctaggtgtgcgggaagtccttcaaccgcatgtacaacctgctgggccacatgcacctgcacgccggcagcaagcccttcaagtgcccctactgctccagcaagtttaatctcaagggcaacctgagccggcacatgaaggtcaagcatggcgtcatggacatcggcctggacagccaaggtgggtgggccaagcgcaatggacagagcaggaatgataccaacatgacgcactcaggagcctcctgcccagttagaggagtggggaggctggccaaggctgagacttcgttggggtgggctcaggtctggaaggggggtaccctggaaggccatgatgacaataacgatgggatatttatgtcttcttcaaaggacttaaatgagatcacgtaaacaatataataaaaatcataactaacatttattgagtgctaactgtgtgccaggcctttattaactcatgtgatcctcaaagcgaggttggctctgtcattgtcatcgttttacagatgcagaaactgaagaacagagaacttagatagctcatgcaagatgacaacacagcaggaggtgacagacactttatttcgttaccgtgagataatatttcaaataagtgtatgggaaagaaagttagaaaggggaaaaaatggcagccggaaagataagggagagccaggtgaggtcccaactccaagtacaccatgggaggtcctaagcaagggacatgcagaggggagatctgagcttcccagcaaccaaggcaaaaaagtgtcaatcagtcacactcttcacaagtgcctgccagagactataacccacatactcatgaaagggccagacagccctgacgttaagatctgggagaaattttaggagaggatcctatgcctcagcagttcgtagaagtttcagaggctgt

SEQ ID NO: 81277 - DNA, 2090 bp, Homo sapiens
tgacagtctcttcatggtcccagttatttccaaaagggcacgttctgctctggttccttctggtgggttagcaacagggcagatccactagaatacagctctcaaaatctactgcacatggactcacccaaagtgctttacaaaaatcctgatcccaggccacattccagatcacttacatttgaacctcaggtccaaactcaggcatcagcatttaaaacattcctcaggtgactcccaacatgcagctgatttgccagccagccctctgcagtctggatcaaaggttctcaacatgaggtccctgaaccagcggctgctttgctaagaactgggaacttgtgggaaaggcagcgtctcagaccccaccccagatctactgaatcagaaactctgggggtggggccagcactttgtttcaacaagccctccaggagactctgaggcactagtctggtccagtgggtctcaaacttgactgcaacaaatggcccagagatctttttgaagtgtagagtctgactcagcaggtgtgggtggagctgagaggccagcaagatcccaggtggggccgaggctgctcatcctcctaccacattttgagtagcaaggagctaccaagagcagccgacggggtttcattctcgtctactggaagcaaccttaatagacaactgaaaaacaaaacaaaacaactgagatacctgtttctgccagaaaacccaggccattcactggtcagctgttccaaaaccagagttaagctactgcagctgttcccgcgtgcctgcctgcattccagtaaataatcccacgtggcaagtcagctcacctggttactgccaaagcatgttcccagctggtgtgactcagaggcacaccagaatttctttattataatttggcgatagggtcttgctttgccacgcaggctggagtgccgtggtccgatcacagttcactacagccttgaactcctgggctcaagtgatcttcctgccttagactcccaagtagctgagattataggcacacgccaccacacccagctaatttaaaaatatttttgtagagaccaggtctcactatgttgcctggtttggtatcaaactcctggccttaagggatcctcctgcctcggcctcccaaagtgccaggattataggtgtgagccatcatgcccagccagagcaccagaaatagctcccaactgtagaaggagcctccctgtagcgctgttggctccctccttcctgtggagtctccacagcagtccctccccaccatgaggccagagaggctaacagctttgctgtcacccaacagaaatgctttaagtactgaccactgctggagggaaaggctaccgctaacacttgggatgttttctgacagcctctgaaacttctacgaactgctgaggcataggatcctctcctaaaatttctcccagatcttaacgtcagggctgtctggccctttcatgagtatgtgggttatagtctctggcaggcacttgtgaagagtgtgactgattgacacttttttgccttggttgctgggaagctcagatctcccctctgcatgtcccttgcttaggacctcccatggtgtacttggagttgggacctcacctggctctcccttatctttccggctgccattttttcccctttctaactttctttcccatacacttatttgaaatattatctcacggtaacgaaataaagtgtctgtcacctcctgctgtgttgtcatcttgcatgagctatctaagttctctgttcttcagtttctgcatctgtaaaacgatgacaatgacagagccaacctcgctttgaggatcacatgagttaataaaggcctggcacacagttagcactcaataaatgttagttatgatttttattatattgtttacgtgatctcatttaagtcctttgaagaagacataaatatcccatcgttattgtcatcatggccttccagggtaccccccttccagacctgagcccaccccaacgaagtctcagccttggccagcctccccactcctctaactgggcaggaggctcctgagtgcgtca

SEQ ID NO: 81278 - DNA, 1015 bp, Homo sapiens
tggtaggaggatgagcagcctcggccccacctgggatcttgctggcctctcagctccacccacacctgctgagtcagactctacacttcaaaaagatctctgggccatttgttgcagtcaagtttgagacccactggaccagactagtgcctcagagtctcctggagggcttgttgaaacaaagtgctggccccacccccagagtttctgattcagtagatctggggtggggtctgagacgctgcctttcccacaagttcccagttcttagcaaagcagccgctggttcagggacctcatgttgagaacctttgatccagactgcagagggctggctggcaaatcagctgcatgttgggagtcacctgaggaatgttttaaatgctgatgcctgagtttggacctgaggttcaaatgtaagtgatctggaatgtggcctgggatcaggatttttgtaaagcactttgggtgagtccatgtgcagtagattttgagagctgtattctagtggatctgccctgttgctaacccaccagaaggaaccagagcagaacgtgcccttttggaaataactgggaccatgaagagactgtcagtgttacagctcttttagaatttgttaggctgggcgtactggctcacgcctataatcccaacactttgggaggcaaatcccaaggtgggcagatcacctgaggttgggagttcgagaccagcctggctaacatgatgaaaccccgtctctactaaaaatacaaaaattagctgggcgtgttggcacatgcgtgtaatcccagctactcgggaggctgaggcaggagaatcacttgaacctgggaggcagaggttgcagtgagccgagattgtgtcactgcactccagcctgggtgacagagtgagactttgactcaaaaaaaaaaaaaaaaaagcattcatttagcaggttttccagtttttaccagaaatcgccccacccccatcccaccacccaaacaagattttttaaaaagactgt

SEQ ID NO: 81279 - DNA, 1069 bp, Homo sapiens
caactggggtgatgctactggcatctcatgggtagaggccagggatgctgtcaaacatcctacaatgcacaggacagcctcacaacaaagaattatggccctaagtgccaaggttgagaaagtctgccttagacctgtcagggctgcccccagcctggggtctgtttcccccaaaacacgcacatctcagcggacagggccagaatgcactttgggggccagccacagcccctgccagcctcccagttcccccagatcctaccctgggcttcccctgtaagagctttataatgagatttcaattttataaaattataaggggcctcttaggagtttttgcctgacatatctttatgaacctaccctgagtgtttgtccctggagagccaggcccaaggataccaatggctagaaccaacagaaaagcacagctgccggcaggaggcctcaccctcccgcagtgtgaggcagagcagcacagtggctcagaacaacagcatgtgctgggtgacctttggcaagttgattcacctctctaaacctcagccttctgagctgctaaatggggctgttgtgattgctggatgaggcgaggcctgcgaagtggctggcatgcagcaggtgctaatgagtgctgcaaaggtgatgtcacgcaggcagcttcccgtggccagagaaacattgcagagaagggataagtagggcttagtgactttgacgggtcaatggaagaatgacccaaagaaggcttcaaggccaggcctgcagttctccaccacaaaggccctcactgatagcacccactcccccacactcagctttggggcctaggtctggtcacccagctagaagccacaggaccctgaggcgtccgagggtgggaaggctgagaggcagctgagactcctggaggccgtgactgggaagccctctctttagaaaggccatcagcttcctgcgtgggggtgactggctcctcccgagagatggcagccaggtctgactgtgcccctctcttacagaccccatgatggagctgacaggcactgacccttcagagctcgacggc

SEQ ID NO: 81280 - DNA, 2196 bp, Homo sapiens
cccagaagacccctgtcctacatccctttctggaagtgagtgtccctacagtggattgcaacacatgtcgtccacttcgaccctagctggagtgcctcaccagggggccccactaggaacaaagccaggacaggccccgcgtcaggcacacactaacaaaaccagaagcatggggcagggcagggcggagtgagggcatcacaggggaccaagaagggctgtccttgggggaggcccaggaccacctgtcggggagggggaccgcagtcatttctcattcctcagtgtccaccttgcgacggggatagccacgagtcagcagcttcccggaaagagcaacgtattttaaaaaggaaagtaaagcccacagagggaaatcaagggtttttttgagcaaagggggtcttctgaaggtaacttattatttttttctttccaactgtgtgtcacctatgaccttttctgatggagatgcattttctttttccaagcgtaagcttcctaatgtgctgtgcgtgcttcctacccacccaccccgagcagcctggccgggcaggactggggctccatggggactgtcaccctggccctggaggtgcagccgctggcagcagcctcagcaggctggggtgggaggcaggagaaggcagagctgggaagccctccacccctgcctggctcctgcagtcgctgacttgctctgtcccatgtcccatcctcggctgtcagggctgctgactctgctcagccaacagctagctccctcgctcgcctgctctcttcccctctgttcccacgccagctcctgcccctggaaccagagatgacaggcccagggcagtgaaatagcacattcaggaactctagggcacccggacccccccacccacttgcctcctgaggcctcagtggggaggggcaagcaggggtcttccccaaaggcacagatgaagccactagcttcagcctagaaacccggagaagggaacagcctgcggtgggaggaaccaatctgcagcgcagccacccccaaggctggatccttaagtgaaggaccaagccaggcctcagggtgactgtgatcaggactgaggggtggacaaggtggcccaagtatggcttccagaccccgaagccccacgacctcccaggtgcccgccatgatgaccctcaggtggcagtgaccccgtcactgtataagacattttctcctgctgagcagaaggcatcatcccctgcaactacctcttcccacgtctttctcccctggtaccaaaaagaaccctgtacctctcctcctcctcctccctcctgccagtgcagtggccttggtcttggaaactgaagggagaaggtctggcccccagggtggggctctcctttccctcccccagccccgccgtcagcactggccctctgtgaggttcgatacttgaacgccccctgccctgtgccttggacctgggcaaagctaggaggaggaaacagcacaactcacagtttgagctggggggtggtcttggcaaggctcctgtctgtacccctccctaaccttctcaaaagaggtgcacagcctctcgggtgacttggaaactcctggacaaattccattctaacttattttgacatgtatacaaaccaactgtttagagattccacttgtgcaaagccctactgtgtttttatgttcctgtttaaaagagaagtttacttagcaataattataaataaatgaatattctttagtgaggtgactgcaaatgcttctttccccagctcttggggacctggccctcactcccagcaggaactcccagcaaaacttcccagccccacacagcagggctgcactctcccagggcccgggggaggctgagaccatcctctgcactggaatggccccctgcagggccaggcgcctatagccagctgccccgggcccaagagagtggtgtgggccacggcccctgtattcccaccacttgcagagaaaagctgcttcccctccctacccacccacatggcttcaggaaagaagccagctcccgatgccaggctgggcttcagaggctgcgttctgcagagctgccagccccgtgctggtgacaggcaagaagaggcaggaagccttgagcttcctcccaggggctgggcctgctagagccagcagtccacgtttcttcttatagccctgag

SEQ ID NO: 81281 - DNA, 1040 bp, Homo sapiens
ctgcaagtggtgggaatacaggggccgtggcccacaccactctcttgggcccggggcagctggctataggcgcctggccctgcagggggccattccagtgcagaggatggtctcagcctcccccgggccctgggagagtgcagccctgctgtgtggggctgggaagttttgctgggagttcctgctgggagtgagggccaggtccccaagagctggggaaagaagcatttgcagtcacctcactaaagaatattcatttatttataattattgctaagtaaacttctcttttaaacaggaacataaaaacacagtagggctttgcacaagtggaatctctaaacagttggtttgtatacatgtcaaaataagttagaatggaatttgtccaggagtttccaagtcacccgagaggctgtgcacctcttttgagaaggttagggaggggtacagacaggagccttgccaagaccaccccccagctcaaactgtgagttgtgctgtttcctcctcctagctttgcccaggtccaaggcacagggcagggggcgttcaagtatcgaacctcacagagggccagtgctgacggcggggctgggggagggaaaggagagccccaccctgggggccagaccttctcccttcagtttccaagaccaaggccactgcactggcaggagggaggaggaggaggagaggtacagggttctttttggtaccaggggagaaagacgtgggaagaggtagttgcaggggatgatgccttctgctcagcaggagaaaatgtcttatacagtgacggggtcactgccacctgagggtcatcatggcgggcacctgggaggtcgtggggcttcggggtctggaagccatacttgggccaccttgtccacccctcagtcctgatcacagtcaccctgaggcctggcttggtccttcacttaaggatccagccttgggggtggctgcgctgcagattggttcctcccaccgcaggctgttcccttctccgggtttctaggctgaagctagtggcttca

SEQ ID NO: 81282 - DNA, 1984 bp, Homo sapiens
tcccagttgcagctgggggaggctgagtagagccacgaactatggcagctacaatattgggttgtagagggcagcagggctcagctgggtggccccaggagaggcgaggccctgagagaaaggctttctaccctccaggctttggctcccttggcctgatgacgtccgtcctggtctgccctgatgggaagacgattgaggctgaggccgctcatgggaccgtcacccgccactatcgggagcaccagaaggtgagtgcagggcatggggcctcacaatgcccctctaccccaggggcctaaagcccactgggctgagggctggaaggacgagcctgacccaccagcccaggggcgggcagctgtatctgggcagcctcctcactagctggctcggctcttgatctccctgcaacccccgtccccagggccggcccaccagcaccaaccccatcgccagcatctttgcctggacacgtggcctggagcaccgggggaagctggatgggaaccaagacctcatcaggtgagcatggagggagaggccggagctgcccaggacaggctctgggtcctgcccttgcacagatggggtctcattctgccccatccccataggtttgcccagatgctggagaaggtgtgcgtggagacggtggagagtggagccatgaccaaggacctggcgggctgcattcacggcctcagcaagtgcgtggcctggggtggtaggcagaccctggggccatgtgggaggaagccaggggacccctcctaaagtccccctcatgagtcagcttagctgcaagggggcctggggcaggacatgtccacagccctgagagactgctcaggccagcctctgtagaccaggtctagtgagttcctccccatccctgaggctggctactcagagctccttccgaccctgcccacacccctttcccagcttctctcaggagagcagttacctggcaagacagaccctgcgggtgcctgccgaatctcggtggcctcatggtagggggctatagctggcctctggcctgtagtctgggtggcaggagatggctgttctgatgcccaagctcaggctgttccctggaagggcctggctgatggccttggcaaggcctggagccacccctgatgtgagtggtgctctctctgcagtgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaattgtctgctgtgtttgtccctgaggggaggaggtagtgggaccctgaggcagaggccctgctagagctggcaggttcccctggggcagaccagagcacctcaggaaggggctgccacggcagggaagggaccaggcagccctgggagcccgcattccacaggggcccactgcggagttctcggacactcagggcacaggcctgtgggttccctggaattttctagcatgatccagtttctgtgtccagttctccattctgagagtcaatcagttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtg

SEQ ID NO: 81283 - DNA, 2493 bp, Homo sapiens
cagctgctcgggaggctgaggcaggagaaccgcttgaacccaggaggcagaggttgtggtgagccgagatcgcgccattgcactccagcctgggcaataggagcaaaactctgtctcaaaaaaaaaaaaaaaaaaaaaaaaattggcagactccagagcccacacatttgcactctagactctactgccttcctcatgaagaattttaggacccccgtctggctgtgttgttgcttggggttcaaattctggttgaaagatggcggctgcagtgggaccactattatctctgtcctcacagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccaggtaggccagggtggagaggggatccactgacctgggcaccccccgactggagctcctcgcctagccatcctcttgtctctgcagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgaggtgaggctggcttgggcatcctgggcccctcctctcccagcttgtctcttcatctctgtctcgtggctttcctttcttctgtaatggcctcattcttaggccacaaagaggcagaaatggccaccagggctgggcatggtggctgacacttgtaatcccggcattttgggaggccaaggcaggattgcttgagaccagaagtttgagaccagcctgggcaacagtgagaccccatctcttgaaacaaaaagaaaagaaaagaaaagaaaagaaatggccacgagcagctccaggcgtactcctgcctgcttggctaccctatcagaagagaatgcctctttatccccagttccagctccaatgccaggctgagtcacatgaccacctctgagccaatcacagaggccctggggagaaaggcttctgattggataagccagggacacactgtcaaccccagcgctaggcctgggaattagccctgccccagccacatgtagtctaaggcggtgctttccaaaaaaaagttgtttccaaaaaaaaaaaaaaaaaggcggtgttttccaaaaaaaaaaaaaaggcggtgttttacaaagcaaagttgagagggagaggctgggccagcagaaacatcgtgtgcactgcacggaggctggtgttaaacagtcgcgtgggcggcggggtaccgttcctggagagctgggccttgccctgggaggtgggaggttgccggcaatcgccaggctagggcaccacgccagggccctgtctctccccctgcagtccatctcaggttttgcgcacagctgcttccagtatgccatccagaagaaatggccgctgtacatgagcaccaagaacaccatactgaaagcctacgatgggcgtttcaaggacatcttccaggagatctttgacaagtaaagcctcatccatgtactctgtggcctttcttcccttccccccatgctgttcccatcctaccctgggaaggtcgctattagagtgcatttggctcagctccgaggctcagggagggatccccaacctgtcagccttctgccctctccccataacagacctttttactcccaggcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggtacgctgggaggacgctgctccctgtgggggtggactgttggtcttctctggctggagggattttcagacccttttggtagaaaactctagtggagcaggactcattgcagggtcctctgtggacagcagggggcaggagctccctggcatctgagtgagagaggatcacaaattaggtttggactggtgtatgactgaggctgctcttagagagaaaggagggcacaggaattccagggctaggttgacagccctaaggttgctccagtccatgatggagcctcatgactctttggttccagtaggaaaatgggatcaagcgggactggaggttctttaaactacagcgaatgcattttgcatagtgaacctaatggatggaagagaatgttggggaagcctgcaaacccccaagccctagggtgtcctaaaagacaaatcagattgcagtaaaaagtataggtgatgaggtcaggagtttgagaccagcgtggccaacatgacgaaaccccgtctctactaaaaatgcaaaaaaatttagctgggcatggagg

SEQ ID NO: 81284 - DNA, 1701 bp, Homo sapiens
ggaggaagaaccctccaaaagactgcggcctggcctgccaacctctctccaaagccccagcctctgccagctctggccaggccccactgagaaatggctgactccagctttctgctgcgcccctccactggccttcactcatccctgttttgactgactgtcccctgccatggcctgcagacttcttatcctgccctttgttgtcatgtccctgagtcactggggtgacgccttgctctggccctctgtccccagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaaggtgcgagggtgtggaggtgggcgggccagggagggtcacaggcttctcccaccggcctctccagacttggggtggggcagttggccatgtcactcatctcgggactgggaggttgggaggctccagagctggggctttcctgaggccaactgcacctgaggccagtctccctgtgtgtgcctggtggacagtggggcctcagaggtcacctttgatgaggctggggcaggcgtgggtaaggggctggcctcaggttccacggttagggcacagcagagctgagaacagaatccatgtcttccatctcccaggccagtggtgtttctgcttcactctggctctgacagtggtaggtgtcatcggtgacagggctgaggaggaggaggaggaggaaggtaatgctgatgtggtcacagtaaggatggcttctttgggcagtagtccattctggcgtggacagtcttgcaggcaggtatgcagagagattgtgcagaggagtgctgtgtgtaaggcctgtgtccttcagagcctcagcagcctctggggaacattgctgttgccctcctgccactggcttggccttgcaggtctgcctctgtccccatggtcatgcagggtcactgagaggtgcccccaccaggcctagactggcttctggtccttggctgttggggccgctctcgagggttccatgaagtcacagcagtgtgtgtgcagaggggccaggtttggataattcgagaaaggatggttgaggagttttctgagctctctcttcctactttccacagttggagggagctggcggaaagtactcgagatacatctgcaaattccccaggcctgcccctgtcctgcaggtcatgcctgacccacagcactgggatcatttgagtgttgagctcttcatttcacctgaaccttgggagttgtgtatccccatttatggacaaggcaggagagggtcacagccttaggaactggggtggcgttggggccaggaccggagcatgtggagtgggcagtgtgttgtcaggcttcgtcagacaagtccttcccccggactgtactccctccatgtgtgatgtgggaatcataatggccaacagagcacttagcatggaccgggcaccgttctaggccctttacacacgagctcatttcgtcctcacgacaacacttaggctggttatttttccagtaatttttttttacagctttggttgagccacttttgtaagcctcaccattaaaactggcagacttgctgggcatggtgg

SEQ ID NO: 81285 - DNA, 1030 bp, Homo sapiens
ggggtcctgagcttgctttcctgcaactagacagtcccatctggaggtgctggaagacagtgacagatcatcaggcattagattctcataaggagtatgcaacctagatccctcgtgtgcgcagttcccaggcatgagctcaggtggtagtagtgctcactcacctgcagctctcctcctgctgtgtggcccagttcccaacagtccgtggacctgcactaaaggctgtggcctggtctgctgacctctctccagagcccacggtactagtccatggcctgggagttggggacccctgctctaagcagtgagggagctgatttgcagacgggggagtggacaccgggcagctggagccctggctttctgccactgtctcctggtgaagggcgggcctggctgggaggagagggcccccctccagcctccccaggggcatgatgcgctgtgtgtccctgcttctagatgccgacaaaaggatcaaggtggcgaagcccgtggtggagatggatggtgatgagatgacccgtattatctggcagttcatcaaggagaaggtagtgccccctcctgaagtgggtggctctccaggtgggctggccagggattgttctgtcccacagggtcttctggactgcaggtccctaggacccccccgttgtcctggtaggcagcagcagctctgtttctctccctctgtctacccttctttcacatctggtccactaattgttcagaagtcgtcaggcgggggcctgtccccagcagtccgtgttgtgatggtgccagatcccacacgttctgtcaactttgagaagcttcaaggttaatcctgtatcatttccatcttgatcccctacgttttgcctcacttcttgaaaaggagtgaaaagggaacagggctggtgtgtagggcagtgacccagcctgcagttgtgacgagccaccatggcaaaggggtcccagagtggccgcttggcttctccaaagttgccgtggtctatgtatgtccaggagagcatgtagtcct

SEQ ID NO: 81286 - DNA, 1053 bp, Homo sapiens
tgactctgctgttttcaagctctgtaaccttgggcagtaagctgttaacctctctgagcctcagtttcccacacttaaaatggagataatggccaggcgtggtggctcacgcctgtaatcccagcactttgggaggccaaagtgggtggatcacctgaggctaggagttcgagaccagcctggccaacatggcaaaaccccgtctctactaaaaatacaaaaattagccgggcctggtggcgtgtgcctgtaatcccagctactcaggaagctgagacagcagaatcgcttgaacccgggaggcagaggttgcagtgagccgagatcacgccattgcattccagcctgggtgacagaccaaagactctgtctcaaaaaataaataaataaataaataaattaattaattaaataaaatggaggtaatgatacctccttggggttgtttttgggattaaatggaatcacattgtacagcattggtacactgtaaggcacatagtaggcactcaatacctatctatactatttcctttatcaccacaagttagttgagggctcttgggttgcacgcaacagacaaagttagtgactggttaacttggagaggattttattatgagctacacagcgtagctcatagaattgcagggaaaactataaagaactaagtcttggacaaaagtaatatcttggcatgggcctgtagccccagctactaaggaggctgaggtgcaaggattgcttgagccccggagtctgagcctggcttgggcaacagagagagataaagagaccctgactctaaacaataagtaaatacataaaagaggacccaggccctccttaggaactggatggcaggagcccctggacaacctcttactgatttggtgctggatgaggcagccgcagctagccagtgttctttgtgttgatctcctctgccttcatattccagggggagagggtctgacaggccagactggcccccaccctcttggccactggtgggctgggcatgtttttgggtagttctacctagccagatta

SEQ ID NO: 81287 - DNA, 1086 bp, Homo sapiens
tcttgaccttgaactctcctagccatgcctgcctgaagcccaaccgtggagcccaggctgaggctgaaacctgaagaactggccccaagtgagtctctccttagggctcctgattatgatagttcatttttttttttttttaacaaatttgattagctgtcctcaaattaactcataggagatgctccccagaactaaactagctctgcaacagctcaacagactttccgcaggttctgcagctctttccactcaagcttcagaaaaaagtgaaggaatattgtagattgggttcaaaatccccatcgcgtcttgggaaaggcagtagagccagcagccagccaccttttgttctctagggaatggaatagtccaaggctgtgtttgtgttctgcttctctacatctgacccacgggtcttccagaggctgcatttgggtcagggacctgggctctatcttgcctctgatgcagaccacactctctgagtctcattattccccctaaatgatctctaagattatttttagattaaaaaaaaaaaacaaactctttgcatatctttggaaagtcagttgtttgaggtctgttaggctttaatcacttttgttttaaatgtgccgaggtggtttctaggcctgcttttcacaggtattctgtcccttgtcagttcttcccacccagttttttttgtttgtttgtttgtttttttgagatggagtctcgttctgttgcccaggctggagtgcagtgccgtgatcttggcttactgcaacctccacctcccgggttcaagcgattctcctgcctcagcctcctcggtagctgggattataggcacgtgccaccatgcctaatttttctatttttagtagagatggggtttcaccatgttggccaggctggtcttgaactccttaccttgagtgatccacctgcctcagcctcccaaagtgctaggattacaggcatgagccattacacccagccccaacccagtgttttcaaataatcattctcttcccttcacctgatttgctgtgtctaatctagagtggagctgaagacacatcaccacctctctaa

SEQ ID NO: 81288 - DNA, 1078 bp, Homo sapiens
gcatcttttcctattttgcaacgccataggcttccagcgactgctggtgatgtttctggtaagttagagcttggggcagtgcggaccagttctgtgaacggctcagtggcagaattacttatctagccttccttcactcctaacccagaaacttcttaattcttgccccttaagtgtgcagatctttctgccacgtcagataaggccctagctgccctgccagagctgattggggtggttgtgtttaggcctagtaggtactgaggaaaagcctctttggaatggctgaggcctgctcccacatcttctgtgtgaagttgagggcccttgggctggttccattcagggtatgaggtgctggaaactgctctcagattactggaagccagggtctgtggccttccctggggtttatactctgtaaacccatgttaaaaataccagcagattgcaaatattagtacactgtaggttgtaagcttcttcagggcatggggcctattgctggagagagatgccacccgtgtacatctggtgcaggctgctggtaagaactcactggcccctgtgtggcaatgcataccagatgggtgagaggggaggaaacacattcagtgaaacagaaggtgagggcagggcagccctgaccacagatggagttgacttcaacttgacctttatttatgtctttgacaaaagtagtatactcctactttgtgccagacaccatgccgggtgctggggatagagctgggaataaaaccagcagagactctttcaaaacccttaggagctcaaattctgatgtgggagggggcagacagtaagcaagatagatgttgactagtatgatatatgggtacaagagctaaggaaggccaggcactgtggcttacacctgtaatcccagaattttggggggctgaggtgggaggattgcttgaggctgggagctccagaccagcctgggcaatatagtgagaccccatctctacaaaaataaaaaataaaattagccaggcacgatggtgcatgtctgtggtcttagctactcaggaggatcatttgagcccaggag

SEQ ID NO: 81289 - DNA, 1042 bp, Homo sapiens
ggcaggcgcgcgcccccagctgcgacgtggcggcttcccaggctggggccgggaagcacgtcccgccagcccgcagcccggggacggcggggtcaggcgcacaaagggccgcggggcagcttcgctccgcgctcccccgcccggcgcttcccggccgtgccaggcgctggggtggggacttgagggacggtggcaactggtggcccgggcgacggccagctctgcgcgggcgggggctcggggctgccgcgcgcccctaggtatttcgggagggggtcctgagagtgtcccggacccgaagggtggcctgcccgccctgcgcccctggaacgagacgagcacccgtggggggctggagcaccccgcgcgctcccctggcgagagggagggtcgtggctcggcccctgctcagacaaaggctgggaggcgggagacatgcacttccccttccttttcagccaggcgcgcgctgataccaggcccacgtcagctatttttggagccttttacacgacagctggaggagcgtcctttttaattttccccttttgtttggccgcccccacccccaccccttcgccttcatcgctgcacttgaggctccatcctggggcctctccttgacttgacctgccttggcaggcacatgccctccctgcctggctcactcgccgcagagacctggcagcccgcgcaaaatgtcactttgcggaatcgttcccacggcttctgggtacccttagttccctgcttaggagggaagacagtagtcgggtcgtaataagcaagacttagcccgagcctccgttgccaacgcaggctgccttgcttggcgtgtgggcatcggcctgccccctcaccctggctacccaacacagctacaaaaggcagggaacaatgtaggtcccttggccctgcctaatgcctgttgccatggaaacccctatcctaatctggccaggagccccttgcagtgagccaggagagtgaggaagaggggatggggcccgctggccctgacctggccagaggaggtaatggt

SEQ ID NO: 81290 - DNA, 1031 bp, Homo sapiens
caggggtgctgagccccccagtggatttccatgctggtgggactttctgggtgtccagtttcccatcacctcccctctcccaccagctctgggcccgagtacctctgcgttcccccggagtccacccacctggggtgttgtgatcactctttgccatcgtcactctcgggttttctccttaggccctgctcttctgaggcttgatctgtgatgccgggagaggtgggacgctgccagaaggggctactggcaggctgccaagaggctgcccacagaggcctttgccctgacaaattcacccctggggccctgggtctgccctccgcctggcagctggtggagaggagagccaggtcccagctgtggactcagactaatcaattgctcaggaggccaatatatacaccaggtggtaagtttccaatgcatttagcagggtgagaccggtttttgtttaggaaaatatcttgatagccacttttgttgaggaaggggaggtgctaaggacatagttgaaggaagatgtttaaacacaggaggaatcaaacggctttacagagaacgttaaccggaacttgggggcgagggaccccaaaagagaagaagaaatggaaagatggtcatagaaatgaagggtgaaggagggaggagggagggagaaaacaaaatggcaagggcagagcctgggaggtatgtgtccactgagaatttcacagtggcggggagaccaaagggctttttttttttttttgagactcttgttgcccaggctggagtgcaatggcgtgatctcagctcactgcaacctccgcctctgggttcaagtgattctcctacctcagcctcccgagtagctcggattacgggcatgtgctgccacacccagctaattttgtatttttagtaagatggagtttctcgatgttggtcatgttggtcttgaactcccaacctcaggtgatccgcccgcctcagcctcccaaagtgttgggatcacaggagtgagccactgcacccagcctcgaaggact

SEQ ID NO: 81291 - DNA, 1169 bp, Homo sapiens
ggctgccacttggcctctggtttctgcagtcccttgacccgtcagttcaggccagctcagccacttacaagtccagaactggttgtttcagtaaccgccctgaaagctgccgttgctttcctggaagatagcaccgggacgcaagagtggagagggaggagccaaggtcacctcataaatgcgggatatttataaccctatctttcacccctcctgcagatctccgtttcgttttactctctgagcacgcccgcccactgcatgttaagggagcagtgagcagcatttatctcgggtggagacgtgggtggtttcacagagtgtggatctgccctcctctctctcacttgcctccttctgtaaacaatattaccattcttgagagctgaccatgtgccaggtgtgtgcctccaccattgcatttcccatcacagccttgtgagatctctagtgttctgatgcccactttacagatgaaaaactccaggctcagagaggttaaggaactcgtcctacgtaacacagccagttaggtaagagtggatctaggatttcaacccgggccagcccagactccagctagtgaggccgccccctgtggcccaggtccagcgaggccgagtctcccaaggtgaaggaccgcacagtcccttgggctccacggctaacttgggccgaccagcggtcgtggggaggcggacccgacaggccagggtggtcgtggcatcgagtccatcgttggtgcaaatggccgggggccggtggcggtggtggggcggggggcacggcccgcatcaggcaaatcccggaggcgccctctggacaattcccgtaaacacgggcagagcggggcggggctgggcggggcttggcgggggcccagcatttccggggacgccgcgccggactgaggctgtgcgcccgagactccgggtccccaggggctgcgccgggccggcctggcaagggggacgagtcagtggacactccaggaagagcggccccgcggggggcgatgaccgtgcgctgaccctgactcactccaggtaggcgcggggggtgcctggcgaggtgggagccgctgcccgggaggtggcggaccaggcgaaaaccgccgcgcagccgctgcccccacccttgcacccgcacctcccgcccggcccctctcc

SEQ ID NO: 81292 - DNA, 1021 bp, Homo sapiens
ggctcctcaccacagcggacgcacctgggacttgggctgggcgggccggttctttctccccatgagagttgcagcctcagcaccagctttgcaggaggtggctgaacttgagggagtacccagaagggggtcctcagagatgggcatctaagatacttcagagttgttgacgccatggggcaactttcatggggaggtgaaccaataacatagcaggcatggccttgctcactgagcattcactacatgccagtgttgcccgtggctttatatgtactctctccagccacccatgaagtgctgttcatagcactccgtcctagatgaagaagctgaggttcagagtgattgtgtggcttgctaaaagtccacaaaatatggaaggtagtgaattcttctgacagaagaacctgtgtgctcaaccactggattctaccacttccaggagcaagaaaaacaagaggccggtagcggggaaaatggtttggggaacggagatgaagccatttatttacatctgttgccagaccctgggtaaaagctgccagtgagttttgaaggcagtgtaagtgctgacccggggtggatgccctctgctgcagaaggcgctgccccaaggaagctcccagccctgaggacttggcagccattggctgatttgaaagaatacacagggtgtgccagctggtgtcgcttcctcttcaacatgtactgatgctgcagctgagctgctgcccagcccctggggagaagacaccagcagcatgcccagccagggcagggtggagagctgcagctgcaggttggcataagaggagagctcagggctacaaggggatggtggtggggggccaaggcctggagagctgggctgcagccagtgtatgtctgcgaggccttgctgggcagcctgccagtcagcacccgagaatggggaggagcttgagtgctaccccaggagggggcgggtgggacctttgggttcaagctccactgggcttggcaggaggcccctccccca

SEQ ID NO: 81293 - DNA, 1809 bp, Homo sapiens
attattattgttattttgagatggagtttcgctctgtctcccaggctggagtacagtgatgccatctccgctcactgcagcctccacctcccaagttcaagtgattctcctgcctcagcctctcgagcagctgagactacaggtgcccgccaccatgcttagctaatttttgtatttttgtagagatgggatttcaccatgttgtccaggctggtctcgaacttctgaccttaggtgatctgcccatcttggcctcccaaagtgctgggattacaggcatgagccaccacatccggccttaaagggagttattaattccctcctgccccagaagtgccgggcgggaaagctctggacgcagtatttctgaagcagattggacagaaatctgcaggcctgcaaactgcagtcaacaaaacgccattgagcagagagaatggagcatttggcacaaatcagctgcttgccctctggccctggaggaggcagccagggtcaaggctgccctgggaagccctgatgctggtcgcttgttgagccctcagcccggttactggcttccctccttgacatggtctcaactggacatgagcctttgtccccagctctgtcctatgggccagcatctctttggctctgcagaggtgagtggaaggcgctctaactgcggatgctcagagcctggctttgtaaagtagcttgccacccttactaactgcacaaccttgggcaagctcctggccttctccaggcccattttcacattagcaagagaggaataatggccatcttcacagtgttctgagaggattacatgaaataatgtatgtaaagtgtttggcatggtgcctggcacatgctgcatccgtagtaaaaaggtagcttctgctctggtgtgctagaaaccccctgccagccttgcttggtgaggttatttgcatccatttttgtgcacactggtggtatgcaggccctctgctaggtgccaagccttgtcaggcttagtgcctgccctggtagaaaagacaaagcaaggcccccaggagctgattggaggtcattaccaggggtcctgcttaattatagcccagttattaagtgctcctgattcagccttttcaaagtcctcctttgcctgaagaacctcctctgcatggggctggaccatgcctctccctgcctgcccttcactggttctgctctgccttcagcacaacccacatccagctggtgttgaaatacctctgtgccaacccaggagagcgctaaacttgcacaacttttggggcatatctggatataccagcatgttcatcctctaggcaagagacagagggtggcacggggcctggagaaaaggctagactcgggtcatgtcatcaatcactccttcctttatcttcttagagcctgttgcctctcactccacccccatgggtgctcaggctggcgcaggactcagggggcctctgatgtggccctccctggggatcggggcaacaggaacaacacaacgcgagactcctgtggtcgaggcctgccttccctcagattagctttttgggaagtctgctcccttggactgcattctccatgcttttccccagctggtttccctgcccctcctcttcacattctgacctccctgtgctggatgtgggacagctatcctgtctgtaagataagataattaaaagcctggtggctctttccctgctgccaccaagtcatgcagagacggaggctcaggctcagttgcgttcaagattcggcttcacccgtaacccactgccatggccgaggaaggca

SEQ ID NO: 81294 - DNA, 1054 bp, Homo sapiens
gcagagctggcagacatgtggcacacaggagactgaggcacacatctcagacagaagtttgcaaactgaagggtagtgggccacagccagcctggagatacattttgtttgacttccaagttctttagaaaaattttaattaggccaggtgcggtggctcacgcctataatcccagcactttgggaggccgaggcgggtggaccacttgaggtcaggagtttcgagaccagcctggccaacgtggtgaaaccccatctctactaaaaatagaaaaattaactgggcatggtggcaggcacctgtaatcccagctactcaggaggctaagggaggagaatcacttgaacctgggagacaggggttgcagtgagccgagatcatgccattgcactccagcctggaagacaagagcaaaactccatctcaaaaaaaaaaaaagaaagaaaaattttaattagttgctgatatttaaaacttaggaaattttacataaaaatctaggtttccagcttttctgaaggtctggtaaggttggacccccattccgtgtagcagcacgtgtctggggcctaagtcttgcgtgtgaaaaagggctagagtaaaagtagaaggcaagaagcaaggggaggagtagggagcatggggagaacccatcttgattattgatggtcactgacccctaatctttgcagagctttgcactgccacgtactgtgtttatttagtcttctcagcaatcctgcaaggcagccctctcaggactgagaatttgttcggggttgcacagtgggtcagtgatcaagtgaggattcacacacatgtcttgtgccccttccagtccgtgaagcttgtttcttgtctccctaccatactttcagctgtcatacttccacctgtcatacttaattctttttttctttttcttttttttttttgagatggggtctcactctgtcacccaggctgcagtggtgagatcttggctcactgcaacctccacctcccaggcttaagcgatcttcccacctcagcctcctgagtagctgggacctc

SEQ ID NO: 81295 - DNA, 1036 bp, Homo sapiens
aggaagtgcacccaggttggcagtgtgtcccagtttcctgctgactgtggccccgtcagcactcctgccctggaggtggggctgctgctggggtaagtgggtccaaggttctggtgacttatcgtgacatccctggggacgaagggctacaacagcctttcaggaggctctctggggacttgtcccgcccagacccctctctgagagtgggggaggccactggctgcctccttgcattggaggccccttccccaccgactccacagggaagctggtgttttctggcctgatcctgctggggcctgtagagggtgggatgttagggccaggtcagcgtcttgctgccgtgcccggagccacagtagagagaaaggtggggtggggttctgagtcacagcgctgctgcagctagctggctggcctggggtggggactaaccagggtggggatggtgctgagccctattcctgtctcaccccagagagctccaggcttccggctgagtcacagggaaggaggacccttacatggggctgagggctgagtattcccacatcacttcctactcagaaccccacttcctactcagaaccccacttcctggggtggggagtggggaccctgcaggtgactcttatgtgcccattccatgtgccgtctccctccagggagggacagggcagccccagaccagccccggtctgcctttttgaaggatgatctgcctagtgggatgcactggccttggtgaagcccctggctgaagcctgtcggggtggagggagagggttcaccctgaatgggaaaaccggccgcagcctcggcgtgccctgctttcttcatactggactaacccactggatagatggatttagaggatgtccgagcagcacaggcagcccaggagagcgagcgagacactctttgacacaagggagagcataaaagcttaagactgaccccaaggtgcgccagcccctcgcaggaagtaaagtgcagaaacacctccacccctgcacaaagagcacctaggagt

SEQ ID NO: 81296 - DNA, 1048 bp, Homo sapiens
aacaagagagaaactccgtctcaaaaaaaaaaaaaaaaaagggctgagctgctgggcgtggtggctcacgcctgtaatcccagcactttgggaggccgaggcgggtggatcacatgaggtcaggagttcaagaccagcctgaccaacatggagaaaccccgtctctactaaaaatactttgccgggcgtggtgacatatgcctgtaatcccagctactcaggaggctgaggcaggagaatcgcttgaacctgggaggcggaggttgcggtgagccaagattgtgctattgcactccagcctgggcaacaacagcaaaacaccatctcaaaaaaaaaaaaaaaaaaaaaggctgagcttcccccaaatggctgatatgtgttcctccttatggacattgaggatggagtagcttcatttcccatttttctttggccaccaggaggcccagcactaaaggctcagcccttctctaccagctgtgcgaagactcattgacctactcgtgaatttttacttccttgctgatggagatgtttttcttcagatttgggttttctctgctcctgattttaatgtttatatttcactactttcttttcttcatgtctccccaccctttatggaaccaggctgggggtatgtaaaaacactccacaggtaaacacacatgaagtcatcttcacagctgcttgattgggcgtgttgcactttttgcttcctcagcttcgtgagactgtttgtgtggtcataacccactggtccgctacaacgtgcctgagggtggtcagggtgctgctctttgcttgtttttgtgttctcatcagctgcttagaattttaaaaataatttctctccaaaccctttagttacccaaagcataaacagtaccctggtgggtaagtgtgtgtgtgtttctttttttttttctttgatttatatatttcacattatataaggataacctgcttattagagaatctaaaaatgataacaagtaaaaaagaaaagaaagctacctgtaattctaccagggagcccatgttttag

SEQ ID NO: 81297 - DNA, 1044 bp, Homo sapiens
acctgtatttattattccattagccattggcagcagcttgtgacaaccctgctaccatattatgatgtctgtctgtcatcagttctggtttctgaggtcaaaattgaaaacactcccattctgtgtaataaccatcagtctcaaagaccagtgcttttttgggaggctgacgcgggcagatcacttgagttcaggagtttgagaccagcctggccaacatggtgaaaccccgtctctactaaaaatacaaaaattagctgggtgtgatggtgcatgcctgtaataccagctacttgggaggccgaggcaggagaatcacttgaacctaggaggtggaggttgcagtgagccaagatcatgccactgcactccagcctgggcaacagagcgagacttcgtctcaaaaaaaaaagaaaagcccatgctcaacatttgcattactctgtcaatgcaaatagcattcactgcagggcccacttaacatttccttctctttgggtctaatgtcactcaaaggaaagtgttaaatgtattttcctttcttaatattctattatgtgctcaaaactcatcactttatattttagtttgcttgatattttgaccatgcctttcttgcctgtttttctggagcttctaatacatcattttttttcccagctgtatagtattcagttggattgaggcatcataatttattttgacaaggtcccctctggttggacggactctttggttttcagttttttattaatgtgaagggtgccgtagtaagtatccttgtacatacatctctgcatcatttcttatgtaatgtttgagagtccaggaatgctgctcgcccatcaaacctgatccccctgcccccagccccttgccattgccaccctttgccttgctgattaccttcctttaaaccagtccatctaaaggttggtgttaagaggcttcccatgggaggggtggccccaggtaatacccatcttcctctccccaggctctgaagagcggccattcctcagattcgaagctgaacacatctcc

SEQ ID NO: 81298 - DNA, 1311 bp, Homo sapiens
agccaggatggtcttgatctcctgacctcgtgatccacccgcctcggcctcccagagtgctgggattacaggtgtgagccaccgcgcccggccaggctcacatcattttctaagcctcacctcctccgccaggtgggtctgataatgtgtcccgcgtcgggtcactgtgaggcagtgtggcactgtgtctgggtgaggcctctcctgaggccgactgtccaggttcaaacccttcggcaccgtgtcctggctgaggaggacggcgtccctgacacctgaccccttctgtcccacacacctcacctgcctgcagagttgccttctcctgcacgcctctctctttctcaccaagcctgctcctcattccctggagtgcccctgagcccatgtgtccaccctcctgcagaacatggagaacttcaccctggcaagggacgagaaggggaatgtcctcctggaagatggcaagggccgttgtcccttcgacccgaatttcaagtccactgccctggtggttggtgagtgttgagggcaggatggcttcattgaggttccatgtaggggcacacagggctagagggctagctttggacaggctgagtccatgccatgcttatttccaaggggacagaatggccaggggcttgccttgggtttggtttttccaagttccagcttccttctctgcccaccacaggcaaaacgggcagtgctggggtcactctgggccctgagcagggagaaggggccgtgctgaggagcccattcccatgggaatgttttcttggcagatggcgagctctacactggaacagtcagcagcttccaagggaatgacccggccatctcgcggagccaaagccttcgccccaccaagaccgagagctccctcaactggctgcaaggtgaagtcctcttgccaccacccagagggcagggatcctgttcacccagccctagaagggggcactttcccccagcttggcctgtctccagggttcctgggctgactctgagctcctgacctggtccctacagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaaggtgaggggaacgggctgacagggtggccaccccagggacctcaaagcctccacagctgcaagatcacccacatccatgcatggcctttcccatcccgccaaggagtacagcttggctaaca

SEQ ID NO: 81299 - DNA, 1021 bp, Homo sapiens
ctcaaactcctgagctcaagtgatccacccgccttggcctcccaaagtgctggaattataggcattaataatataagtaccatcccgaccttgtacttatattattaactcactcaggaacatggcattaggctatattggggtcctttggcttccttgtttgctcagcagtgaatcgcgtccatatttaggaaggctctgcttagttacagtaaggaccatcctcctgatggatgcgtacactgctcttcctgactttagatggaacttggtcctggccttctcctgcccttcagtcctggtgtctggggtgggtccattgaggcagtcctgtgccgtgcatccccgtcatggctcagcatgtgcctaagcccagcccatccgactctccctccagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggtagggcctccagacctcgctggagatggaagggtgaagggtggctgggactggggcccccagggctcctgggttaatctggttatttcctctgcaggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcggtgggtactggctccctgcacccagaaggggtgccgggaagatgtgggtccccacaccatgctgggagcaaggctgcctagcctcgggcagatcacttggcttctctgaatctcttttctcatctttaatatggggatataggcccaggcctgcttgtgtactgggttagatataagtatgaatgtcagaatat

SEQ ID NO: 81300 - DNA, 2250 bp, Homo sapiens
ggcatagcccagagggaggcaggggagcttggagctactgtggacgctggcacccccctaccccatgccttttctgcctacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccggggtcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaatcctggctcttcctcttcaaggacagttgctttttgaggtaggtctagtcttctgagttctgagaggttctgaacctcttctttgcaggctcaagtgagccagagtcagcctagcctggtcagcaacgtctccctgtggggcggctctgaggtggggagcttaacgcactgataggcggaggcagggggttcattgcgtttacctcaaccccttcattctgcatccccaattcagtttagcaagggtagggacacaagggaagggatgggatgggatgggggccctgtattaaagtttttaattcttcagatcatgcagtaaaatagactttactgatgtacggttctttacattttgatgcatgcagagactcatctaaccaccaccccaatcaggatacaggcgagtc

SEQ ID NO: 81301 - DNA, 1030 bp, Homo sapiens
ttagcctgggtttatcgctaggtgatgggtctgaaccctaggtgcggcccggggctggaggccatccaggagacaatgagcccctttcccagagaagccgagtgcccaaggcactgggctgtcgccgtcagaagactgccgagcggaagccctgcccaccgaggtggcggagacaggcaggcctgggcagccgctggggcggagggacggctcttggaaacggaatccgtactttaattaaagtttatgcagttttccaggagcgtcctgtacctcatttcggccctcacgtttcagggaagccctctccacagttacaggcagaaagggtgggccactgagcagcgtgagcccagatcttacccccaccaagtgaagcgggaaataacttgctactacccagcctccggcccgccccttccacttccggtcttacccggctacttccgctgctgtttcgtagccgactgctgaaggctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgctt

SEQ ID NO: 81302 - DNA, 1480 bp, Homo sapiens
gtcttcaatctggcctggagtacaggcctgcctcctgcctcacaactgctgctaatcaggatgtatactgagggtaacttgactctatgctcccagtttgcaatatctagcttggcccaaatagatcctctgtcttactattgttatttatttttttttaagagaaaaggtcttgctcctgttgcccagactggagtgcagtggcaggatcttagctcaccataacctcgaactcctgggctcaagcaatcctcctgcttcagcctcctgagtagctgggactacagacatgagccaccatgcctggctaatttttaaattttttgtacagatggggtttcactatgctgcccaggctgttctcaaactcctggcaagcaatcctcccaactcagcctcccagaatcctcgattacaggagtgtaccactatgcccagccccagataaattctctacttatattaattttgcttcagcttccttctaggttgacagttcccagttgactctcaaaatgtttgtgaaattaagcaatttcactggggcatggtggctcacacctgtaatcccagcactttgggaggcccaggtgggcagatctcttgaggtcaagagtttgagaccagactggccaacatggtaaaaccctgtttctactaaaaatccaaaaaaaaaaaaaaaaaaaaaaagtcaaccaggcatggtagcgcacgcctgtaatcccagctactcgggaggttgaggtgggagaatcacttgaacccaagaggcggaggttgcagtgagccgagatcatgccactgcccttcagcctgggcaacagagagagacttcatttaaaaaaaaaaaggcaatttatttagtgatgtaaaagttttcatggatatataagggaatcagggagtcctcaaggcggaagaaggtgaaggaacagagcaggggaggaagaggagggaggagaatctcccccaggctgagcagaccagggcactgagctccagatgtttgcacccctcctttgttttccccatctcttccctactctccaggccagtcagatggcaaggcctggacaactggaaggaaagagaatgaaggatggaactggggcggcagctgtgttggccacacaggcccttctgactgggcagcatggaggccacttctgccagcctgagagttgcagaagtagatggcagggaatcccctgcttggggatgacacagtaggtagattagaaagttggagaacaggaaccgtaagccactagcaggaacatggttgaagagccgaccgtggagtccagactgagggaggaggtagaaaaggaacaataagcaaggaagcagaggaggctgtggcaaggataatgggcagccccagttattctaagggaaaaggagagatggagttgagaggctgaaatggaagcagctctgtgatgtggctggcctttcgaggttactggagcagaggagg

SEQ ID NO: 81303 - DNA, 1049 bp, Homo sapiens
aagacaacctgggtcacctcaaagggtgtcttctccaaatattggtgcagaggttagctgggccggcaagagaagggagatgacccactattttgatttcaggcagcagacaccggcagcctttcggttagagttgcggatagggcagtggccttgggggcggggctataaacctgggcgggcattcccggcagggcaagctcagcgtgagcccgattggaggatgggctctaccttcttccttccgcctacggagaccatagcgggatgcagggcggggccgggctgagggggcggagttaggggcggggcacggtgactctggccccgcctctttccggccgctcagggcggtgtcgctggggcggtgccgctggggcggggcctgcggggtggggctgacggcacggggcggggcctcggggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctgtgagtgcggggctccgcggcgcgggggcttcgggctgggctaattgcagacgaggcgcgattttcctgggggctcggccgggcgggtggggcagggcggctgccggcagctcggacccggaagagccgtcccggtggggcggcgggcggcgggcggggaggcccctggttcgcgccccctcggggtccgaggcggcggagaggacccccgaggcctcccgccttagctggggccgcggtagggggagccccacccagcgcctctcgccgcccaggctcggccgagattggggaagacggcctagagtgaggtggcaggatgaccgcgcagggcgtgtcccggggattgggggtctgggtacgcgggctctgcccgtttcgtggaaaggcgctgccctagtgttgcctgcggggtagacccaagggatagaccagggtccagacctgtccggtcccaggctagctacgag

SEQ ID NO: 81304 - DNA, 1613 bp, Homo sapiens
gttcacccagcctcagtttcttcgtctgtaaaataggagtgataatcacaggattgttgtggggtttcaatgagagaatgcgtgtaaaatgcttcgtacaattactgccacttatgtctcaataactgctggctttggtcattaataaaagagggaaacaatattatcagatctgtatttagaaggagttctggcagatagggacagatttgtgccaaaatctcaagacagtatttttcaagattacactgaaacttagtacatatttatattatcatacatttttaaaaaggtcaagatgattatagttgaaaccacatagttctttttttaagaaagtcattgtagtacacctggctggctacacactcattagttatcctgactttctaggtgagtggcaggaaattgattctgtggcaatcttttatcactcaggaaggctacagatcctggtgtttacattctttcttttatgttgtagctgtcctggataatgaaagacttactgcagaggagatggatgaaaggagacgtcagaacgtggcttatgagtacctttgtcatttggaagaagcgaagaggtaaagattggctggctggagagaagattaagagaagggaactgataatagtgtgaatacaaataaagattgctttgaggctgaacacagtggtccatgcctgtaatcccaacacgttgggaggccgaggtgggggggaatcacttgaacccagctgtttgagaccagattgggcaacatagtgacaccccatctctacaaaaaaattttaaaaattagccaggcatggtggtgcatgccagtagtcctagctactcgggagcctgaggagggaggatcacttgagtccgggaggtcgaggcagcagtgagccgtgctctcaccactgtgctctagcctgggtgacaaaactcctgtttttggtggggggaaaaaaaagaaaagatttatttgagtatgttatagatgtaactgggaagctggtggttgagggaataagtataggtagggtatttatttatggcaataagtagccttgatgagagtttatcatgaatcactgtgatgggcatttaagtgtactgaacggttttccaggtttctattgttcagtcttatgcttattgtgcatgttttgggcgttaccaactgtggggtggaaatagcatttttaggatttgaagttattggctttaatgtttcacttatgcttcatgaattttgatttatatatgaattgagtctcctcctcctatgacctgcggagtggctgcttggtttgggaggcttagaagcgtggtgctgttggtgtaggtccatctgtttggcaatattcagagtcagcatcctctgcattctttgtgaagtgaatgtaaagctgctcttttcctttttcagatgccccacaaccttgtggtcttaattttagagtgtcattttgttatcagtgattcatttcttttgttctggtgcttgtgttcttttgcagagtcccagggtagatgtaattatagatcatgtattctataagtgagctttggtggaaaagtcaagtgagggataatgaaatatttgtaattaacgtttaat

SEQ ID NO: 81305 - DNA, 1963 bp, Homo sapiens
tgaaccggcctgtatcttgtgtgttccgagggcccctctttcccctctagcgctagacccagtttgcctttttggtttggttccatcctgtttcctccataacctccacccctcccaagttggaggagccccaatatctgggatttacagtaactctaaggccaggaataaagatcatagagattggagggagaaaagcttcccctcttcagttctatttataatacctctacttctactaaaagctccaccttttagtacagtggccccattgtgtatcctagggcactccattttctcctctgcctgtaacagagctctttcttgggaaaagagaggagtgtgtagagagtgaatatgactgtgtagaggcagtgagtataagtaagagagtataagtgtagagagacgaaagttttctgtggctgtgggtttgtgtttccctgaaaggttaactgggaaaatttaggggtaattcctataaatgagcactgggagtggttgagaaatagaaaatgtagagatttctgcttttcttcattgtttggagagcagcttcaatattgaaattaagccgctgttctaatgagatatcacctaacgattcaaggctttttgctaagggctgcacaatagatcaaggatacatcttaaattattatttatgcttaaattgaagcttatttttatccttttgcctgttcttattgagttttacatttgtttaggctaaggagcggggttttttttgtttttttgtttttttttgaaacggagtctcgctctgtcgcccgggccagagtgcaatgacgctatctcggctcactgcaagctccgcctcccaggttaacgccattctcctggctcagcctcccgagtagctgggactacaggcgcccaccaccacgcctggctaattttttgtatttttagtagagacggggtttcaccgtgttagccaggatagtcttgatctcctgacctcgtgatccgcccgccttggcctcccacagtgctgggattacaggcgtgagccactgcgcccggccggctaaagagcagttgtataggagcaatgaataccgtttcactcagttgaaggaggtaacatttaaatatgtgaggtatgttcagtgcttaggtcttggacaggaggaagtaacagatcagaataaggttcaggtgaaaagaaccaagaagagaacgtgtcaggcaggacagaacagggaattctgcaagtgagaagaaagtacgattagtactggaaatggaagaaaattcagctaggttaaaggtcacaggaagaaagttaattccagcattctctgagtttcagacaattcctggtgtgcgctttcaagtctgtcatgggccacctttctgctgctgagtgcccgtaccctagctcaaggaatagggcacacccctcttgtagaagggaaggtaggaacgctggctggttggagactgtcagcaactccacggtgataagtcgagcttagcactaagtagaagtatgtcactttctgtaatttagaggaattgaaaaggtatcttggaaagaaattagttcttgggaacaaagtcttttttgtgcatatgtctttactgttggcatagagcattttctgggatgggctcttcagatctcctctccctgtaagtgatttcagaattccatgaatgttgggatatgtccaggctggcaccctgggatcatgaaaatagaagttaagacatttaagaagcaagaaaacaaaatgggtaggtgaggtgactaggaagaatatcatgcccagcacttctagaattctcaaaatgaggagcatcacttaaattttgagggggatcatttttaggatggtgacccaagctctctttgtacagatgagaagtctagttatctcatgagacccagtgtgactaaaggaccatagcatgtagctgcgtaatggcacggtgg

SEQ ID NO: 81306 - DNA, 1034 bp, Homo sapiens
ggttgcagtgagctgagatcacgccactgtactgcagcctgggtgatagaaccagacattgtctcaaaaaaaaaaaaaaaaaaaaagtgaatataggaaatcttccttgaaaaaacaaagatactcctacctcagcttctcaagtacctgggactataggcccacttcacctcacctaactaattaaaaaaaatttttttttttgtagagatggggtttctctatgttgccaggctggtcttcatctcctggggctcaggctatccttcgctaaagtgctgggatacaggcgtgagcagccacacctggcctgtattgtcttaatttactattttcagtggccatctaatgttcataatttatttaggtttattcctgtttaaagttctattgctttgattgctggagagtttaaacattttcttacatatttgtttatcagtattattttcttatgcaaattttctgtttttgttatgtgcctggcttctagggtcatgatgttaacttttgtgagctcttttataacatggacttgactttctctcgtatttgctacaaacattttcccttgatgtttcattgtatttgttttcttcattgtagttttaaattttattgagtttaaatgtcagtctttcgatttgtaatttcttctatcaactcgaagtctagatagtttaatttctctaaaaccttgccaaaattttcagtttaataatcgattggcttactttttatatatttgtagagatggggtcttgtaatgttgattgtaaggggaacttatcccgaacttctggccttaggtgatcctcctgcctcagcctcccaaagtgatggaattacaggcctctaatatcctttaaaaaccagctgtttattacctattagcaattcatgtctgttttgtcaaatattatgtatatatatatttctagttctggacttttaaattatggtgaaccatatttcatttttttgagaaaaatatatatgactttgttatacttcttatcattgagaaacaacat

SEQ ID NO: 81307 - DNA, 1250 bp, Homo sapiens
catgttagggttgctattggcttagcaattttgcctgcaatgtggagactcttcttggtttataatgtctcttgtttgtttattttagctttaggaaattgtccattatgcctgtggtgattagttagatctgtgtagtctattttatggctcttcttcattttgtttacgttaaataagcgttctaggtatgtgtctcacatacatcttttgttgcactgacttgattttctacagtcttgatattttttccttggttctgttaatggtagttgctttgtcctattgtagtttatatttttaattaattccttttccgtctccattcttgttaatagcttaaatgatctctttttagttcatgaagaagagtgtggcacaaaagatcctttcaaggtgaaaaaaaggagcaggtagccaagatagttgggttacatagtttaccacttccctttataatccgtaggtgttgaaatagatgtggccatgaaaaaccagtgttaatcgggcagctgagtgtatggattgtccaccagtcaaggttggggaaaaaatctggctgggctaagtgtggcccgttagtttgacctcatttggcatgtatttcttctggtcttacaggtcagagcaactgtttttatatattttaatgtccctaatgacaaaatagtaaaaatacatttgaggacccaagttggcatgttctaggaatttcattttccggcttagtgtggtgacctgcctctgattgctgtacaattccttctgcttcacagtgtcacatctggggataccagttggtagtggaacctgttttggacatttttaagccttgtggtatctgatggactcttggttgtttctagctggtgctaaataaaccccttgacaagaagtatttgtgtaagaaagcgctggtaggcaaagtgagaacatccggaagtgattcatattactgtggttgtttgcttaactcaggacttggttgcctagagaccatatcgttgagttagccgagtgaagtgccagtggaacctggagggcctgtggcctaccggatcaaatcagggctctgctccttaatttttctcctgaagtctcctagcaatctgattgatctctgtggtttgacagtgcgtgaattaaaaaaatcttaaacatattaatgtttaagaaagatctggttaatggtttattttgaagagtaagagtttacttgctgaagtttgaatgttgggttaaaatttttt

SEQ ID NO: 81308 - DNA, 1069 bp, Homo sapiens
gcccaggagtttggaccaccctgggtaacatggtgaaaccctttctctacaaaaaaaggcaaaaattagccgggtgttgtggcacatgcttgtgaccccagcttcttgagaggctaggtaggaggatccagaggatcgcttgaaccctgaaagtcaaggctgcagtgagccatgatcacaccactacatagactctgtctcaaaaaagaaaaaaaaaaaaaaaagccagagtatgggcttcagaatcacaccaacttgggttcaagtgagagtttacttgccagataatcttggaatatactttttggaacccacagtttatctgtaaaataattacaataatacttcagaggttgttgcaaagattgagataataatgcatgtaaagtatttggcttcatgtctgccacatggtgtgaagattattttttaagtgtcatttatattgaaaatgagtcattctatgttacttctttcctgtttagtacttgtgtttcagatctgacatcacctttttaaaaattttgcatttgagtgagatttgctaaagcagttctggggttaaacttgaagagaaaatattgaatatttatatttaatatcccatgtgagaggagagattaagaaccctgttgtctgcttgttacatctcttgtgaaaaacataaaaaatataagagttttgttactgaactctacttgtggttttggtcgagtctatcatgaaggtatgttgtggagattagtgcaaataatgatttaaatatggaattataaagtttagcagctctatattcggggaaaaacgagtctctgttgattgaaaaagcataataaaataatttattctgaggctttgtggttatgcagtgtcagaatgaaaaagatgatactcctgttccatttcaggctggtcagaccatacctggaacacagtgttcagttggagaaagttcagagatgagcaaaagacgtgagggggcagagatgatgtctaacactgctaatataatacctggtaacgttttgagtacttactctgtgccaggcactgttcttagtattttata

SEQ ID NO: 81309 - DNA, 1071 bp, Homo sapiens
agaatccaaacttctgctaacattaaaaatgttaacatggcactttacttttcaaagcagtttggtcctgatttgttcgtttgtgacagggtttcactttgtcaccccagttagagtgcagtgccaccatctcaactcactgcagcttctacctcccaggttaaagtgatcctcctgtcttagcctcccaagtatctgagactataggtgcacaccaccacactggcaaatttttgtatttttagtagagatggggtttcgccatgttgtccaggctggtctggaactcctgacctcaagtgttcggcctgccttggcctcccaaagtgctgggattacaggtgtgagccactgcatcctacctagtcctgatttattttataaacaaaccaggtgatactccattgtgaaatagctcagattggtgggcaagccacatatgtggtgaggtgacttggaaggcagcttcaggtttgagcagttgtttagaaacaatgtattttgcctccctgtttattctagctcattctttctgtttaataactttcaccaaatcacagttggcctttcttctctgacctgacacctgtgttatataaagagcattctacccagctataggaaacatctaagtcaggactgttttatagcagttggactagggaaaggaaatataaagaatgctgggagatgttaccatgggctctccttttatttttgtctagaaatctcagaaaagaggaaaacctaaatacctctggtaactggctctgattcaaggcaaaagtatctactgtgctctttatccgtagttttccctgtgtgtttacttcattttaaaaagaaaaataagtaactttttttttttttggtactgttacgtgcttgagggccatttttggcttaggctgaggttgttaggttttcactgttaatgagaacccaagttagattgtcccctgagagctggagttgccagtagttgtttgccagaatgattttatcaacatcctttttagcagtaaaaagatgagatgtgtccttgaactacactattttccgtaccgacaa

SEQ ID NO: 81310 - DNA, 1050 bp, Homo sapiens
tttttcaatgtctaaatgtagcaggttgcacaaactaaagcacttagtaaatgttcattgttgagttgtttctccatctaggcatggtagatagtaactaggagcattgtagttctgaaagcctcatactcagatcagtccagtgatttaaactggactagaacttggtcttcatatgcctgtgtctgggtctgaaataagtaaatcaccttctcacacctaatgaaattcagtgggttgtccaaatagagattttccaagtagtactttttattctgtattatagcactttattccttgcaattcttatgatgaaatgtctgttcaccctaatgaagttatttgctgaatgccaccgatgttttctaagaatgccaccgatgttttctaactgtccatagtttgatttggattattgatgattggtgaatgtcagatgaacacagtgaatggatatcttactctgtttcttttatttctccctagattttttacccagaaactacagatatctatgatcgaaagaacatgccaagatgtatctactgtatccatgcactcaggtagtcaaattttcttggcaaaataaggaaattatgaataacatctgaattgagtgtgtagttttttatccttgaggtaagaatgaaaaagttttttgattagtttcaaaagttccaaataggataaaatactattatccgaacaaaatggtgagaaacagctgtgtttttctagggagtttggagaagggatttatttatttaatagcaggtaattttcttctaaaaacatggtatctttcataattgatctagtatttctgtgaactatgcattcacttggggtgcagtctcttgtttagttaggtaggtccttgccattgttaagccatttgttcattcattcaataatttttataagccggatgcggtggctcacgcctgtaatcccagcattttgggaggccaaggcgggtggatcacctgaggtcaggagttcaagaccagcctggccaacatagtgaaaccctgtctctactaaaaatac

SEQ ID NO: 81311 - DNA, 1032 bp, Homo sapiens
attcctctctgctagttgtgtagccactactctgcagtgtaacctgggttccaggccctcaaattctctgtagtagagcctaaagaattaactatgccttcctagtggtagagtcagaatgagaaagagaggaagtctgctattgttttccatttctcttgaatatgtagtctgtgcttagaaagtatatatagagcagtgtgtttcgtgatttatggtttcttttttatggtgtttttcctgaagggtggattggcaacatttgataatatgtaggaagtatttataattgctgaaagtgccttcttttaccacaaaacacagccatgttcaaagcaggttcctcaccttgctatattggataaggctccatctccctttggatcaacagtgacagaaaaatactacctctctgtctcctccctgcttgcctttttttttttttttcctctaaagtcttgattggcattattccagagatagtcactgtactttaatcatactaaattacttttgtagataacattccactctcagataagaccccagttttccattctcaaaatacttgtatactaagtttggtgtaagctcatttgtctccttagtatgattatgtttgtgtgtttctctgcagaaagtaatggattggattgaggatgctgccccagggcttgctggggatactttatgataccatatacactgtaaatagaaatacactttctaatatctgagaaattcaatattcagacatatctggctccaagaatttggataagggactgtggacctgtagtagattctgtttcctaatcacctgctgtgtttcagggtctttattaataatctttgagattggcatagtgacttctaggttactcaccattcacagaaaagataattagaatccagatagattaacatagcttccttctgcccattgctacaaagtacagcttaagtaggaaataagaaaaataaatctaagtgcagttacaggctgacgcattatagtgcctaacagtatat

SEQ ID NO: 81312 - DNA, 1047 bp, Homo sapiens
gaaactctgtctcaaaaaaaaaaagaaaaaaaaagaaaggaagtcctacatttccgtggctcattgagtttcttattgttttatggtgtttacttggtaattaaggcagatatctccagagcaagtgttccttgcaaggctctcttatgagtgtttctctgtgagattctaaattcaccatcccagacatggatcacagatggagctgtggctttgcatactgtaaggaagaggctaggctcatagcctggcccagggagccagtcttcgaaccccagttgttatttctctgtgaaaaggagcctctgtctctaatggggggtgcaatgttgctttctgttgtgatatacatcctgtaatctatataatctcagtgtttttgttggtttgtttttttgtttttttttttagtacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacagggtaaaaatgcaacatctattctttctaattaatttatattattccgtcatttgatatggctccagtttaaacatcagttttattgagatgcagtttacatacaacaaaattcaccggattttaaatgtacagtttgagttttgaaaagtatatgtgatcatttaaccatcactcccagaaagttccttagtgcacttttgcaattagtttccaccttacccacacccctgagcccaggcaactaccagtctattttctattgctgccattgacctttttaagaattttatacaaatggaatgatgcagtatctaatcttttggtgtgaggctccattttgacctctgcttcttgaattttatataaataaaattctagagcgtagccattaaaattaatagtgccctttggaaagattatctctaaatattaacatagtctttcctctttcccagat

SEQ ID NO: 81313 - DNA, 1001 bp, Homo sapiens
ggcactgactgttgtgggtggagtgtgttcaggaagtatcagggtaatgagaggattcaaaatggtgctatgtaagacatggttaaaggaaataaggctgctagtaaggcatttgctgtcatagggaggggcagtggaatgtattcagtgtgaactttagggttggagctttaaaaatatttttgaaacaaaattgtccaaagatgtagtaagtggccacgggagatactttctcctgtttggtagtctgtaagtataatctggacaactacttggcattttaagggaatttaagcgtcatgttggtctggattggtggctccatattggtgctgagctgtctacatttggaagtttttaagtaggctgggagtgtggcccaggaatctgtatgaaatctgatgaatagcttgttgggaacccctggacttgatgactctaaggttcttttccaatcccaagatcttatgcttctgagaatcacagagtaaaggctctctgagttatatttccttatctggaactgagattggttttggggaaggaaaactattctaggctcttctgttaacatagtcctttcacaagcttttgccttttttcctcagcattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacaggtaaacatagtctggattgaagctgcaagagtttgtatatatccattcgaatcccatgctgtcatttaaagatatatatgctgcctttgtttttcccccaatacgactttttcctctgcatataaattagtttaaaaaaaaatcctcaggtaaaatacacattgtcttcagctcacttttgcttttagagctatgaatcctcttttaagataaacagacaatacccacc

SEQ ID NO: 81314 - DNA, 1034 bp, Homo sapiens
tcttggtgtctttgtcaaaaaatgttctcctcatggctgtaaatgtgtggctttgtttctgagttctctatggtgttctgttggtctgtgtgccctttttttttttttttgagacggagtctcactctgttgccaggctggagtgcagtggcacaatttcagctcactgcaacctctgactccctggttcaagcgattctcctctctcagcctcctgaggagctgggattacaggcacgtgccaccacacctagctcatttttgcatttttagtagagacggggtttcaccgtgttgaccaggatggtctcgatctcctgacctcgtgatccacctgccttggcctcccaaagtgctgggattacaagcgtgagccaccgtgcctggccaagttactccagttttaaaggtagaactggagtcaatatagcctcactttggctcgcacacacttcatgatttgttagggaaatatctggaggaggtgagacttaagggatcgctaagatttggatggtgaaagaggtgagaaaagaacgtcctagtgcaggacaatgagggaaaaaggaggtgggagcggaagtacaggtagtgaaagatgtctttgaggaatggtggttagaatacaaattttgtaaatgttttgggctgagttgtgtaagatcaaggggtggaaagattgtagaaagctttgaatggtagcttaagaagccaggcagtaggagaaggaagaggtggtttagatgggaagtagtggtagcatataggatgaattgaacgggaagaaaatagggatgaggagaacagttaggaggctgctttttgaagaaaacatcttgattgagacatggttcacataccgtacagttcacccttcttcagacaaaggaggctgcttttttaaagacgaaagttccacttcaaacttcatggctgatagccacagaatgtgatatttttcccatgaagattggcaccttcttcccctgagggctctctaagcccactgcgtttctgactcctgttttttacac

SEQ ID NO: 81315 - DNA, 1021 bp, Homo sapiens
ttccctcatcactagaacatcatctcttttgcaccgtcaaaatatctagttttccattaagcattcacgtgatatttttaacccaattgataatctttcctaaatcagtaccttcagtaaaagttgctgaatgatgatttgttgctctgtcattcctcctgcatttattagctcatgtgtagcctttttttcttgtctatggaggaattgcttgaactgctgcctttaattctagagttagtcttaacatggaatttagaatatgtaacaggatattgagaataagtgatttctgttgcatttttgcactttgtttaaagtaactgtgcagttccaaaactggtcttgagaatatatcaaatggttgggataccctagcaatctttgttccttgaatatttaaacatgctgtgcttaatgctctttttacttgggggtctggggcaggtatctcgatgagttgatgaaactgaaggctcaggcacatgcagagaataatgaattcattacatggaatgatatccaagcttgcgtggaccatgtgaacctggtggtgcaagaggaacatgagagtgagttatcttcctgtcctccccaaataatgtcaccattaatgatgatgtgattccatgaagtggttcaaaatactactcctagaaggatttttgggtgagagattgaaaatatctatataacacaaaaggctaaagttggatattgttttgagaacaccaggcaattgctataattaggtatatgtccagtaagaactaaattttgggggaggtgaattgaacatgatctgttatttttaaatgctgttataacaagtagtcctgacactacatggaattaggttgaattgcacaggttgtaggcatggtcctccacaagactcctctcacttcagacacaagctgaaagctgcagggttcccaggccactgtacttctgaacaactggctgcaaatttggaggatcccttctacccgctcaggtttaataatttgctagaatgact

SEQ ID NO: 81316 - DNA, 1682 bp, Homo sapiens
tgtttgtttttggagaccggtctatactcttgactggagtgcagtggtaagaacatggctcactgcagcctaacctcctgggctcaagcaatcctgcctcagcctccctagtagctgggactataggcgtgcaccaccatgcctggccaagctatgtttgtttgtttgtttgtttgtttgtttgtttgtttttagagagacggggtctcactatgttgcccaggctggtctcgagctcctgggctcaagcattccttctgcctcagcgcccccaaagtgttggattacaggtgtgagtcactgcatccaactttttaccagttttttgatgcctccttcttccatttgactaacccacgtgtctcatattttttaagcctgttcttccatatttaattgagtctaggaagcccccttcttcacatgtatgttacatgtaccctgatttcatgactttaatattttgcttttaatgatatgtaggaaatccaggatgagtcagctgtgttatggttggatgaaattcaaggtggaatctggcagtccaacaaagacacccaagaagcacagaagtgtatgtatcacctgttttatttctgttttggtggaggctggggtgacaaggtgctccgtacagcttgaccaagataggtatgggggaacaatttgccagtagatatagttaggtgaagcagtatgtgaatttagacactctctaaactattctggtaacagttctttcccgaaatagttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggtgagttctgggataatacatatgtgccctgaagctaacccttgagtatatgaggggacagatgtagaggaaagggataagctatagggaaagaccttttagcatagatgtacagtacttaggctcattttaaaggagataaaatccctatttttgaaaatatccttccccccccccttgtggacagctgtgttaataaggccaattttctgagaatgtgggaaagattaaaatatttaactgtttatctttcacagagtagcagtagctctgattaagcctataggcaattaaaagtagtttgtctgtaaaaagagggaaagaaataagatttcttaccccattttatggacttttaaaaattaaaaaactgggccgggtgcggtggcacacgcctgtaatcccagcactttgggaggctgaggcgggcagatcgcctgaggtcaggagttcaagactagcctggccaacatggtaaaaccctgtctctactaaaaatacaaaaattagctgagtgtggtggcgtgtgcctgtaatcccagctacccgggaggctggggccggagaatcgcctgaacccgggaggcagaggctgccgtgagccaagatcatgccactgcattccagcctgggcaacagagcaagactctgtctgaaaaaaaaaataataataataaattgaaaaactggagaggctgaatggttgcacattttttaagacagacaggccttaaactttggctttggagtgaacaaagttaat

SEQ ID NO: 81317 - DNA, 2665 bp, Homo sapiens
cgtggcacacagccctgttgggtacctgtcactctgttcttgtctacagtgaccccagatcagccagcacagtgcccagcctagtcagtgttggataggtagataagtgagatgacatatgaagtaaaagaagatcaagtttttgtttatgaagtgttttctaggtgggaggacgtgtgtgagaacaacctagtcctaaaaaacagacctgagggctttattcctgttatgtagctaatgatctagtatagacttaggaagcaggaggtgttagcttgtgtgctgtggatgatacttcgtgaaaacctgcatccattcttgcctgtgaatgtctttgaatgtgaccactgctttttcagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcaggtatttcagaacctatcacacagacagcaagcgggcatctagagcaggggtaataaacggtcagctgtcaccattgactgtctgagtgtgttttttgagtgctggactcttagtcttctctttcctttgacaggtacctcctctttactaccatttaactgtagtgtgcctacaggtgtttaatgctggcacagtggcagttcttgggtacctcttcctctcttcttctaagactgtacctttctgtaagatttgaaccttgagggaaacaactgtggtctggcttcaatgataaggtagcacaatgtcctggaaagaattctgagttaggaatgatggctgcactactgccagacagtggtgaatctccaagtctttgtccccatctgtaaaaggggaatgccccattgtatcttatcttcctcacctggtttgttgtaagaagccagtaaatgaatctgtatggctgcactgtaaaaggtgtgcagggctgtgctgacgttggggaagtagaatgtagccatcgtgttcttccagtggagggatggcccgtgcccttgttcccctgtcactgctggaagtggtccttcctaaaacttcatcatgaaattgcacttggatcatgtatcaagatgaaagtttttttttaacttccattgatgcttgggaagtaatatgtcttctgtaacatttgactgtttcagtcacagtggagaggatacaagcagaagaaggcatatcaagatcggttagcttacctgcgctcccacaaagatgaagttgtaaaggtatggtagcctgaacagggtttctccatgaggggcacaggtataacacgtgttgagatgaaggactcttctaatttccaggatcccttttccacagattcagtccctggcaaggatgcaccaagctcgaaagcgctatcgagatcgcctgcagtacttccgggaccatgtaagcacccttggatcatacaggccattaggggcaattttgccatatttttggtagacagatgaacagagaaatttcttcttttttgttccttagataaatgacattatcaaaatccaggcttttattcgggcaaacaaagctcgggatgactacaagactctcagtgagtaactggctccgcatgaagagttgaggcagtggctgggagccaccaagttcagggtattctccacagacctcttttgttatcctgaaggcaaggcttgggggagagggtgtgacctgtgacataagcccctttgctaacatgtggctaggtgtcttgttggcttgttgcattaacctttatcataacatagcaatagcctgacacagaagactgcacctgatagttgtcttagcacatctcaaaattaaatgtttatgaatagactactttttcaagacaatgctatttcctgagacgtagtactttttctgctaactccattctttgatgcatactttctgtcagtcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggtatggcccagtgccagcgggggccttggaacggttcatcctgctttgtaacccctgcattcccctttctgactggtggggagggtggaggctgactttctcctcagctactgccataagagctttttttttttcttttgactgagtctcactctgttgcccaggttgtagtgcgatgtgatctcagctcactgcaacctctgcctcccaggttcaagcaattctcctccctcaacctcctaagtatctgggattacaggcacgtgacactatacctggctaatgttttttgatttttggctttttttttttttttttttttgctgacggagtttccctctcgtcgctcaggctggagtgcagtggcgtgatctcggctcactgcaacctctgcctcgcaggttcagcgattctcctgcctcagcctcccaagtagctgggattacaggcgc

SEQ ID NO: 81318 - DNA, 1050 bp, Homo sapiens
ctttgaaagctttctgatctatttattggtttttgtttataggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaagtaagtggctcctggaatcagtgttataaaaatttagtgaatttatttttccacaagaaagccttaccatcgatctctctggaagtatttttgacttccactgaggggtgagtgaggggcactgtaacatgttaatttattaatcttttttctcatatgtattgtagtccttcaattttaaataattgaatatatcttgccagcctttatattacctacaaatgacttatcccttggttttatttcagaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtatgaacagatttcctcagggcacaggccccttcccactatcagaggggctcccagtttgagattcatgccttcctgatcttttcttgatctcaattaatttatgaaaaatacttactctaaagaagcatctaatttttaaataactgatataaaatcttgctgcttctagggaagggataaattaactttaggaacattctgtattaaggtataatttcaaaaagtaatctgaacagaaagaattcacatttttatctagtagcggacccaatcatgaccacgattgagcgtgcagctgcaggaacattctgtgagtgctggggaatgtttcgagagaaactgtttcagggagataggatctttaagcaggaaggatcttttaagttgatgggttttgtgacaagtttaaatttttatctgatgttttataggtcgaa

SEQ ID NO: 81319 - DNA, 1092 bp, Homo sapiens
tcaggcaatccatctgcctcggcctcccaaagtgctgtgattacagctgtgagccaccacacccagcctcaaatagtttttctttagaaaactgtgctttctaagttgttgacctagtaataaattcacttatttagcaaatatttattgagtattaactatgtgccaggcattgtgttagagatgtgtacagtaatgcaataatgagtgaaacagacatgcttcctgccctctcttcatagttcattgggtggaagagacaccaaccaggtacataaaaataaaagcataattaaacattgaagaaagttttatgaagttttatgtacggttctttaatggagactttataagagggagctaacataaggtggttagggaaagcctatcccggaagataaaatttcatttagctgaggccctaaagctaagatgaacccagccttactaagagctaggtgcagagtgtttatgtctgaacactctaagctggagggtgtaggacttaaatggaccctggcataactagggatacagttgaatgagaaggttcatatagattgggtgagatcactgtgtttcattaaaggaaaaagaaaacggtgtggagtgagcttccctgaaatatcgtgagttgggctaattaaattaacgtattacaggagatagctgagctagggccatagcgtaaccaccaacattcatttatctaaagcaaaagtgtgccaatcaaatattggtaatgctgggaaaagggagttcagaatgccaaaacgtttctggttttatttgtcttgggtgaggacccagaggggtgggagatggaggtgtgagcagcatggtctgttgtggttttttcttgttgtggagtagagttagatcatgcatgaagctctctgggcataggtggagtagcagctgtccacaccattgctattcaaagtgtggtttgcacaccagtaatggaaaatcatctgtgcacactgtttagtttaactgatactttttttttcatagcaagattttcttaatgaaggaagtaatgtattgatttacattctgactcattgtctttatcttgtctttgatcag

SEQ ID NO: 81320 - DNA, 1307 bp, Homo sapiens
gcttttccactgtcatttctcctgtctccccttccttcctagaagactcttcctctccttttttcctgagttcaagcatcccttcgttttggaagctttccttgctttttccattctgagttgaagccctttccctatggtcctgtggcacttttggtgaactgatttacagcacaataggtttataatcatctgtttgtgtgtcgctcccaccagactgtaaaagactgaagagaaggtgtcatgtcttgtataacttttattcccaagtgcctgttattgtgcctggcacacaattcaggcacctgattcacagttaaaaacctgcgttcagattctagacttatcacttaccagccccgtgaggatgagcttaagctatctaatatttctgggtcttatagtttatgaaagataagacacttgcttcaggctgttcctggctgttagtctaacatagttgggtataatttctgtcttcccagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccgtgagtgccatcagttgtcatgacccccagtagaacccagcactaagtgcctttctgctccttggcccttctcactaagttttgtccatcccgcagttatgggatgcgcttcattgccaaagtgctgaaggactcgttgcatgagaagttccctgatgctggtgaggatgagctgctgaaggtaagaatctcatagccggcagactcctgccctttgaggacaaagcaataaaaccagggctgaccatagatcattactaactgcctaagtgtaggttctggcagtagcttaccattgattgtgagcttttgaaagcaattgtaattggtaaatggtacctctcttaggatgaaacacttcctatagtttggcacacaaacatcaaacaagtagaaagatggatttttcctgttttcagatgagtttctttgagtcctatcttttcgctgtagtattgttccctctgctggtgacctggcgaatagtagcaggcacagttgtttctgctaaggctgttgctgataactctttcttactcagctatgctcttctcttttctttttttttttaatctgaatgcttttttcttctctctcctagttctgtgctttcctacagtgaggcctcgattctagactttctgttcaggtgaattaattttatttcttctgaatgaaact

SEQ ID NO: 81321 - DNA, 1037 bp, Homo sapiens
aacttggcctttgaagtctgcagcatgagaatgttgggaggtggggttactctatgctgattgggtcatgttaaggaatttagctatgtttgttagctttttataaggaaagcccatctacatgaaagtacaaagtgcatgtgggtgacagcagccttatttgctaccatgatatgtgaacaaaagatgccctgaaatacttaataacagactttaagtgtgtcatttttaccttctgaatctgctctttcattaactactggcagtagttttcagttctgttctcattgttttcctgtattgaacaaagggatatttcatttagttccaggccatgagagagagtgtgtatatgtgcatgcatgcgtgtgtatatgtattttttatttattttttcctcataggactgcattttctgcttttctttgctagcaaagtcatttatagcttccttggtggtatgtcttttaatacccatctttctgtttcgtctgttccagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcaggtaaggggaaaggcacaagtgcttaagagagtctgtggatgtatttttattgttgaggggaaaaataagattaaaaaccacctctcactttccccggactgccatatgtagaagacgtgtttgatgtgcccaggattccagaagatgatccatttactttgaagagaattttcatatgaaatagatagtagttaacacttatgaaatagatagtagttaacataaaaataatgatgattatgcatttagtacatgttaccttgtaatcagagaagaattggagaatgcttttaatttttgtaaa

SEQ ID NO: 81322 - DNA, 2005 bp, Homo sapiens
gtagctgggattacaggcacacaccagcacgcccagctaatttttgtatttttagtagagacagggtttcatcatgttgtccaggctggtcttgaacgcctgacctcaggtgatccacccgccttggcttcccaaaatgctagaattacagacgtgagccactgcacccagccagtgttctttctcaaacagggcacatttgaatcctttatggccatgaggttaagagaataccagtatttcctcttcttatatcataacataagtcattcaacagagcctggtgtggtgccttatatatcatattgtttatttgggttagtttgctgaggatttgcttgttgtttctttgaatataggaactttgttggaacctctttgtgcagatcattgttagacattctagggagggacgggctgaagagttgaatgtataaatggagttgatcattggtgtttgcagctcctgttggatcaccaggatgccattgctccggagcacaatgatccaatccacgaactgctggacgacctcggcgaggtgcccaccatcgagtccctgataggtagagttctaacttttgcctggaagatcaaaagggaatgtgacagaaaagtgttgtaattgtcacctcctctattttttgcactataccaaactctggatatacattgagaaataaaatagatgtgatcctgatagtttcataagagagaaaacaacaacaacaacaaaagcccagatgtgatcaatatctataaggaactggagtcagaggaaaagatcattttaaacgcagatacatactgccagcttgtgtttttttaaaaaaattgcagatacataaattaaaagtcctctaaaggaaagaatttttttgtttgtttgttatgagacagggtctccctctgttgcccaggctgaagtacagtggtgcagtcatagctcactgcagcctcaaattcctaggctcaagtgatcctcctgagttgttttttttttttttaatagagatggagtctcactatgttgcccaggctggtctcgaactcctggcctcaagccatcctcctcctttagccttccaaagtgctgggattgcaggactgagccactgcacccagccagaaagaatgttttcagagagaattgtgatattgtagtgttgaaatgatttctcaaacatttatggagttattatggatcccttgcctttatcatttggcataacattttatttctcagtaaaagttgttctcgtcacactgtatgtgttaggtgattcaagtattatcttagacttgcatcatcttatatttgtattatttccccccaatatctcctctctttattacgctgactctttccaccctcccaaaacttcaggggaaagctctggcaatttaaatgacccaaataaggaggcactggctaagacggaagtgtctctcaccctgaccaacaagttcgacgtgcctggagatgagaatgcagaaatggatgctcgaaccatcttactgaagtgagtatcaaaagaaggaagaatgaaatgaatgtaatctgaaggtttcttggcctttggagaggaacctgctgggtcctacctgaaatgaccatcctgacctctcgtacttgtcataatcccagtcaccaatcacctcgcatattgtacttggtacaggacttatctgccttattttgctaatatgctacagtgaaatgtaaatcttggaaatcctaaccctcgtacctacttatggaatggctgggtaaataagccttgtgccttgagtactgtgtactggcagctgccgcttgggacttctgtgaggtactgtttgtgctgctgctgctgctgctgcttcggtccacttgagaggaactagaacactggtaatatttaaatgcctcccccatctcgtttcagtacaaaacgtttaattgtggatgtcatccggttccagccaggagagaccttgactgaaatcctagaaacaccagcca

SEQ ID NO: 81323 - DNA, 1117 bp, Homo sapiens
ttctcctgcctcagcctcctgagtagctgggactacaggcactcgccccatgctcggctaattttgtttttgtacttttagtagagacggtttcaccgtgttagtcaggatggtcttgaactcctgacctcatgatccgcctaccttggcctcccaaagtgctgggattacaggcatgagccaccgcgcctagcccagttgtgtgattttgtagatatcatctcttctaggtggaaagagatgtgcctctgcttcatgcaatttttcatctatcatttggcagggggcagaatttgtttccttctgtttcaaggttggagtttaagaactgtataagttcaggtgcaaatgtgctatataaattcaagtttaggattagtgtggtaaacttgctaagaacttctttttcccatccgtaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggtactgcattcgggggacagaggggacccggccttgttcaaagctgagaggctcgagagacagtagctgttcacataacagcatagcttcagttcatgggcaaattagtgccctcctctatgagaaaccatatctgactctccagcatgagggccttgcccgacctgaggtggcttattccatggcctaaattactagggagaggaccttaactggagcctcctatgaccttaaagaatttgtcttcagccttaaagaattcttccagatctttttcatgattactgtgaaatataaattcacatcaagctgattaaatcgttgatttgtatgaatcatctcaagcgaggggctttggtgaggactaagagtttaggtgttctgtgctgttgcactaagataatattatgcacacctgagaactggtagttgatgtattatagttctctttttctccctttcccaacaaaatatttaagaggtcc

SEQ ID NO: 81324 - DNA, 1082 bp, Homo sapiens
catttccctgctagaagatacaaatgggggaagaaaatttgagatctgaatttctctgttaatttgtgaaaacaaattactgcctgttgaatgtatggttaggtcaggcaccgtggctcacatctggaatctcagcactttctgagaccaaggcaggaggatcgcttgagaccccatctctacaaaaaaaagttttttaattagccagatgtggtggcatgtgcctgtaagtcctggctactctggaggctgaggtgggaggatcattttagcctgggaggctgaggctacaggaagccgtcaaccactgcacactcgagcctgggcaacagagtgtctaaaaaaaaaaaaaaaaaaaaaagtaggtagtcatatttaaggcagagttaagcattgctgggttgtagtgtgaaatgataatgataactgtcgttatttttctaactttaataattatgtctcaggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaagtgagtattttttctttttaaagaatcaatgtcagaattagagtgaggaaaaagcagaggcaactgaaatgacactggaaatttttacttaaaatacactggatctatttattgcattagtcttttattttacctctaatcatttgtgtaattgcctaattccatttgtaagtgtatgatgtgaatagtgggtgggggatttcatggatgcttatcgctaagtattccttttgcaaaatatcttcttggggcctgtcaaggtggctcacacctatcatcccagcactttgggaggccgaggcgggtgtgtcacttgatgtcaggagttcaagaccagcctggtcaacatggtgataccccatctctactaaaaatatacaaattagctgggtgtggtggcacgcacctatagtcccagctacttgggaggctgaggcaggagaattacctg

SEQ ID NO: 81325 - DNA, 3168 bp, Homo sapiens
gtgacattactagccttatctcatttccccgtgcttagtatatttcatcataggtttaaatgcttcaccttttccagatttattaaaactagtgacccataacatggatgaaatgggaaaatgtcattgtgacttctgaaataaaaagcttagatgtgtgtggcaattgaacatgtttctttttctttccatgtatgatgaattttgatatgaacaacatgacttcctaactccaaatcaaccagaagcctcccttggccaatgtgccctattgctccagctctcaggctggttgtgcagtgggtagttgcctagcgtggaacttttctttcgccccagttcacatctggcacacaaggcaggcctcagtccatctggatccctccctacattgtgtcctttttccttgttccacagacttgattaactgtcaaaatgttttgttttgttttgttttgttttgttaataggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttcatgtttgtgtttttctcagtttcattgttaacagttcctgctaaacaccttgactagagtgagatgtatcagttaaaatcacaacagcagacaaccccttccttttaaaggagaaaacgtaagtccaccatcagatcattgaatgtctcaaagtgacttttaatgtgtgaacgtgtgactttagcctttttaatgaatatgcttaagttatcttcaccataaaaagaagggtgttgcgggaagcaaacattatatgtcacttaattctgattgacgaacggtggaaagtttaaaattgcaacagcatttaaccttttttgaccagcatactgttgttgagcacatagactgtgccccttagggggttcctatgtcacttggaagtcaccagaaaagactaggggatgttgaatgtggaaaaagtaaatcacagcagtaaaaaaagaagaaaagg

SEQ ID NO: 81326 - DNA, 1689 bp, Homo sapiens
ttttgctgaagtcttaatcggcctgtcctgaagtcaaccaggctgtatgttagtgccttgactcagtgcagctttcaagagaggcagaaagaatacccacagagaaggcacatgtgggcggtggcagtgtaggaccaggaaagaagctaggtctctatattccctcgcattttgaatctgtgttaaattcaatcatattagtatgaagcaatcctcttacctatctccttaatccagcctctgactgccagctcacaaaagagggagaagaggcactacatttaaagtagtgattatctctaactagaattttaagtccctacatgttttggctgtagaaccagccaaagttttgttccaattccctacaaaatttcacaatagtcaggagttagaattggtccctatgttatgaaacagctagtttttatactttaaacttaaaatgaagctttagttgtttattattactgtggatattttccaagagacagaataacatctgtggaagattctacacaggccttgatgccagacattgtaattatttccctgctcaaaggcaatagtcagtgcctcaaggaactccctggctataagcagttggctgcctcgacaacagatagctaatgtcttagctcttttctgtctctaccgccagcctcttggggatgtgacttgagaaagctctcccctccccattttctcctgtaacctctttggaggaagtcaccagggtaaccactttcttttatgctagttttcttgagtgcaagggaaaacacttccccacagacatatgacagaagtttaagagtggtgaggagaagaacacgaacagttactgagtacctgagctatgctttgtgtacctgatatcattgagttcccacatcaaccttctgagataggcattatcatccccattttactgatgcttaaacagtaacatgcccaaggtcacacaagtggcaagtgacagtcaggactcaaacccaggtttatctttctcgggcctttgctcttattttgcaaattaagcaagtgtagacacacaaaaccaatttgtttttacctaggaaacgtgttttatgctttgtttttctcagtctggatagatgccgttttctagtcccctggaaccatcgtatgcccagtttagtaccacttttgtttggtttctcgtcttagaatatattctgcttattcactcccccggccacctgagaaatctttttactacttttagtccaaatcaaactttccttcccttgactacctaggaagtctctccttgggtgagtcttaactcgcctgaactgagagtctcaccctggaacttggttaagaaaggccagagttgggaggcaacagcctggatggaagaggggggtcagttgacactggagggggcaagccagaccagccgcaagcaggagccaaaaggtcagaaagccagtgagaatggggtgggccaacaggagcagaccaggccacacaggctgtgactcccccttgcagtggctgctgggcactggccatgcctgtgcttgtctctctcagtatctcttactctgccatcttgtcattcatgaaattgctcaagagacgctttctaccagtccgtgcctgcttagtctccgagaagttttgggggttcatttagaattaattaatttagaactagca

SEQ ID NO: 81327 - DNA, 1094 bp, Homo sapiens
aagtagaaataaaggaaaggaaatggtgaattcacctgacagtttcatttaatcagtcctgtttacagggcggcagtggtgggtgcagctgtgtgaccagcattgtgccgaaggctttggggaacagaactgagctggattttttgggagaggacacagaagtgtgccaggagggcccgtgctctcacttcattcttctcagtactcgggcgcaggggtggaggaaggagaagaaaggcggggtgggtctcgctgcggagagctgaattcctggcagtgatggtagagttggcttcacaagcctagaaaccaggaagtgggggcagggcactcatgtttactgagcacctacccatgccaggcgctgtgctgggtaatttatgtgtcacttagtcctcaaaaactcactgagtcgttaatttttttaaccctcattttctgatgaggaaactgagtgtgtggtgaagtaacccaggattcagaccaggccccgctgatggcccagcctgtgctctcccctccctatgccacctgcgaccattcgcagtgatgaggaccttgtacaagggagccaggagttgtgggggcactctagggaaaccccaacttttcttgccttcaagcttcttgcagtttttagtctatttggaggcaaggataatgaccccagggaatgtttttctctcccctttctcccgcccccaggaacacaccacatttggtccacagaaggactgacttctgattttgtatattatgtggctgttatcaaggaaagtaaagatgataaatgatcttgagaatctattctggaatgtgtgataactttgacattgaatgaaaaaggcaaaaggaaatggaggcaattcatcagcaaatttgtacatgtcaggatggagtggtacatcaaaccgttgtccaaattgccaagaatattcaggcaaaagacttggagtgtttctttgattgatttaacaatgtattttttttggctgggcatggtggctcacgcctgtaatcccagcactttgggaggccgaggtgggcagatcacgaggtcaggagattgagaccatcctggctaacgtggtgaa

SEQ ID NO: 81328 - DNA, 1013 bp, Homo sapiens
ggtctcggttcccttagttagaagagaccggccctcggtggctctgaggtttcctggaacacagttgcagccttggtcatcgctgtcccatccctgtgggactgataaaattagtgtcctgtttccagagagccagtcacaactcattcctttttctttttaaccctttatttgtagtgctatcttgtgggtttttaatttagcagtaaaaatccaggcttggatattttgatgatatgttagcttggtgccagtatatcagtcattgccaccaccatccttctggtcaccgcagcccagaccctgagagttgcatctgattactcccattcccatgcccctacgcccattcagtagccgagtcctgttcattttatcccagcagtatgtctcaaatctgcctctggttttctgtcctcactgccagtatcctacttggttcctgtttgccttggactattgcattggttttctagtcggcctccctgccttaaggctttctcctttcaatccacctcctactctgctgcaagagcagtctctgaagcttaactctgatcatgtcacttctccaactgaaaccttccatcccctacatcctgccaaatgaccagcagcctgcttcggtccagcccatctcccagtcctcccaccatgtgctgcagccacactcttccatcttccttctccttcttatccttccccaaccaccccccactcctcctcctcctcctcctcctcctcctccgcctccacctcctcctcctcctccgcctcctcctccgcctctgcctcctcctcacactgggcatccccttcagcttcgcttccggttgtctaaatcttccaggtactacagcaaattggttagggacatgaacattctgaagacacacgggccagagttctagtcccagaacttactagcagtgtgatcttggggatgataatagcatctacgtcgcagagttgctgtggggatcccatgagatcacctgtgtaaagcgcctggc

SEQ ID NO: 81329 - DNA, 1004 bp, Homo sapiens
actccagataaatcttcttcttaaaataacttcactgcataagaaatatatataatatcctacagcatgaaacttcggatttgttcctgtagacacccatggtaagtatcaaacagtgatgtaggctttttgagttacctgctcttaaccccatgatgaagcatttggaagagaatttccatctatacttctttactttgtggtttgaatagagattctcaggctttgtaaaaattgttctcctctcaggacagtgacagtaagaaaatttcagacagacaattttaaaggaaaagaaaaaggaaccaaatttagtttcaaattagctatacctatttttagtataaatgataaagcaccttaaatgaaaatcagtgtatcaaaagtgccttagaattttcaaaattctatttcaaatcataaagagttactgattcataaattcatgaaaatgaaagtaccacataaaagtgttttctttttttctttttcctttcccgctaggtttctgtgatggtgagaataatggacatggggaaggtatgaactgattttacctacctatattggagtgggatgctgattagtggacataacctttcaatacctttactaataaatattcatgttttcaggactcccccaaatgctgacaactgctgattggcttacttttcagagagcctctagaaaattaaggctagccatgttcagggccaggagaaaggaaatatgtggttgcattacaaaggttcctttttatctaggtccccacagtcacaaggttgagcaaggaaccaaaaattgtaatcacatgaaaatatgaatgaattggcctggcacagtggctcatgcctgtaatcccagcactttgggaggctgaggtaggtggatcacttgaagtcaggagttcgagaccagcctgaccaacatggtgaaaccccgtctctactaaaaatacaaaaattagccgggcgtggtggcacgtgcctgtggtcccagat

SEQ ID NO: 81330 - DNA, 1241 bp, Homo sapiens
tccacccacctcagcctcccaaagtctgagattacaggcgtgagccagcacgccagccttgttatcttgtttcatccataccctgcttttaaaaattgcagatattttaatatgtatctctaatagataaggattttcttagtagcctaaatattgtcatgctgattttggtttttcacaactacttcttcctgcacacatctttccaagattgtgtgtgtctgctctggcctctgactttcacggcagatggtttcctcagggcctggtgatcctcagtgctctgctcatgtttaagaacaggacactgaggggctgtctccttgcggctctacactagagcggagtatgagactgaggcgaagggagtcatggcaggacaagcgtgtagaaagttttttccactctctgactgagtattggttggaaggagcgctgctaaaactgtaaccaaaggaggcattttgcttccagaaaaatctcaaggaaaagtattgcaagcaacagtagtcactgttggatcgggttctaaaggtaaggctggagagattcaaccagttagcgtgaaagttggagataaagttcttctcccagaatatggaggcaccaaagtagttctagatgacaaggattatttcctatttagagatggtgacattcttggaaagtacatagactgaaataagtcactactgaaatggcatcagtgtgaagctgcccattccactgaagttctgaaatctttcatcatgtaaataatttccatatttcttataataaactaatgataactaatgacatccagtgtctccaaaattgtttccttgtactgatataaacatttccaaataaaaatatgtaaatgagaaaaaaaaaaggacactgagaagctggctggcagctctgtgtatgtgggcaggcctgctgagtgtggtcttcattgtagaatgatctagcttggtcatttccttgggaaactcctggtgtcataagttttacattcttctctggccaggcgtggtggctcacacctgtaatctcagcactttgggaggccgaggcgggtggatcacctgaggtcaggagttcgagaccagcctggccaacatggtgaaaccccgtctctactaaaaatacaaaaattagccaggcgtgttagcatgctcctgtaatctcagctactcgggagactgaggcaggagaattgcttgaacccaggaggtggaggttgcagtgagcca

SEQ ID NO: 81331 - DNA, 1163 bp, Homo sapiens
cctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacaaactccagacaagcacagacctccccactaagagcagccagagggagctggtgaggccctaaccccacccaccgagcaactgagcttccccatccctccccagagctgtgtctctgtgggctgggagtctaatgtcacccccctagaccgtaagctccttga

SEQ ID NO: 81332 - DNA, 1110 bp, Homo sapiens
gcaatatggtttagcactgaattcaatttgtccttaggtctatgagtgagtccgatcttttcttgtgaaaggttttgggcatcgtacaacccactctgcctagaaggtgtggaggactcaccacgggcagggtcgccctggcccacagcacgtgagcctgcactcactgcggcctttgtaacaaaaccagttgtggtcctcagcatttgaagcagctgcatacttcagagtaaactatttttcattatttagttttgtcacaagaaatcgaccattgtactactctcacttacagcagttaaacagcatagaactaaaaacctgtctgcatttccattttttctttctgtatggttgtgggttttaggacatagggggttaggagaaggggtttcttgatcatgtcatgaattctcctttgtcctgtttctcctgtttcatttctcctccgcctgctgtatattacctgagctggtgttgtatcttcaagtccatatgcgtatttgcagacctttcctgttcccactcttgttggctcttctgatttatgcacagatggttcccagcatgtgtccagtgcttcatggatgggaccatcccagcaactaatcagacttcctgccagtgtcctaacccccagggcaccctgttcaaccatatttaaaaattggaatttgtataaagttgcttccaagttttataatgcatcattttacatcttttgtaattaaaagcatcacaatgaggttgtctctgcatttggtggtgtttttcttcacttgggtgaggggttggtggggagccttaatctcaccgctcctgcacggctcagcctgcagctaggatttggagccttggcaaggcaggccctgtaccagctgtgggtcaggccttcttgtgatacgtgaaggggcactcagttcccttagctggaggcagctgggtctcctgcccccacagccagcacccgctccacacccctgcccacggcccttcctccaccagatactctgtcctgggttggcctctagccctgtcccttccccagacccccatcccagcagggttcaacgcgaacagccacatctagcacttgtcataaaggtgact

SEQ ID NO: 81333 - DNA, 1057 bp, Homo sapiens
cttgctggtaaacctttgctctcattggtggtggtgttcctcctttccccagttctgcccttgtgcagaattcagttattcatttgttctttgggctttccgtgtgctttgatcatttcctcccacctcgctcccttccagctttcatttatccttccaggccaggtcccatttttctaaaagccctttcctaataatcccctccctaatgtcttttgtacttattttagcattgtggaggaagagagggggaacctggttattctgttattcaagtgagccttcagttagttgaagattatatatttcaagtgtcactagttgtaaatgtcaaaacagtctattgaccaaaaaaaaaaaaaaaaaaaaaaaaaagtcctattactctgggcacagttggaacaatgcctgtttgaatcaagtccttcctcccctcaaaaaacattgtgattaatgcaaagtacctaactccactgatttctttttccctcactttttaggattatggctgctgttcctcaaaataatctacaggagcaactagaacgtcactcagccagaacacttaataataaattaagtctttcaaaaccaaaattttcgtaagtgttttgactggtttgctgtcacataggcactaacttaccacattgtacacatgagatatcttctctttaaactcccccattgtacagatgaggaaatgaagctgagagattcattgattttcccactttgccaattaatggtagagtatgttttagcagcaccaggtgagattgtgtctcatctttgcatggttcctggcacataatatttgctcaataaagatttgttgagtaaatgaataattgatcttgtaaatttgggcaaataagtgttttttaagttttggggggtttttttgtttgttttgttttgttttgttttttcttttgagacggagtctcgctctgtcgcacaggctggagtgcagtggcgcgatcttggctcactgcaagctccgcctcctgggttcacgccattctcctgcctcagcctcccgagtagctgggac

SEQ ID NO: 81334 - DNA, 1291 bp, Homo sapiens
taacctgtgtgaattagtttaaaaaattagttttgtagagttggggggtttcttaaaatggatccatctaatctagtttttccattatttttcagaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagaggtaacaattattttatcttcattttagtatgttcattgtacttttttattcaaagctagccattgggaatagtcatgaatatatagagcttttgtccttaaggttgttagggtctttagtggtgctttttgaataatctgttggccacatttttgaggcaggacgtactgatgaaatggaaggttttagtctgctaatatagtttccaggatagctctgtgattttatacatgaagaaaatacaggagtttccccttgtccacagctttgcattctctgaggtttcagttacccgcagccggctgaggtctgaaaatattgcatcacttctcttgcgctttgggaccattattaagaaaacacaagccctgcaataccgcgacagtcaatctgataactgagaccactactaagtgattaacagcaacccaggtggacagatcaggtcggggcaagattttatcacactatactcaaaacagcttgaaactgaac

SEQ ID NO: 81335 - DNA, 1416 bp, Homo sapiens
gagtagctgggattacagacacgcaccaccatgcccggctaatttttatattattagtaaagacggggtttcaccacattggccaggctggtctcgaactcctgacctcaggtgatctacccttcttggcctcccaaagtgttgggattacaggcgtgagccaccgtgcccagccccactttaaaaaaaaaaaaaaaaaagaaaaagaaatcaagatcttaagacttttttttttttttttagtgacagggtctcactgtgttgcccaggctggtcttgaactcctggacttaagcaatcctcctgccttggcctccccaaagggctgggattacagtcatgagccaccatgcctagccaagacttttttttttttccctcaaagaaaaatattaacaacataattattttatagctagacagataagtttacagcagcagcttattcatgtgatggagcacatctgtaaattaattgatactattcctgatgataaactgaaacttttggattgtgggaacgaactgcttcagcagcggaacataaggtatcttaattttcccccttctggaatatatctgattatatttctaccactctaagtgaaaaatggacagggcaaaatgttcaggctttctggcctggaaatggcataaggatgatcatcatgccactatgtttttgatttgtttacttttcaaaccactcctttaacattcgtattcatgtttttaagattgggaaaaaagcgaatatattttgctacaatttctatttggtatgaaaactacagatttgcttttgtggcctaccagagtaaactacttatatttaatacgttgttctcttttctctcttcagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggc

SEQ ID NO: 81336 - DNA, 1875 bp, Homo sapiens
gagcaggggcacgtgtgagagatgttatgaaagaagagcctgaggaagctcagatgactccaaggtttcagacactgatgactgggaaaactgtgacaccagtaacacaaacaggggagtcaggaggcggagtcagatttggagaaaagctgagaagggctagtttaagtctagaggttaaagtgctggtaagtcattcaggtaccaatgtcttgcagacaacgggagctgtgtgcaggactggaacttaggagggtgtcagttgggtcttaagagaggtgtaggcatttgctgcacacgggtcatgtttaagatcataggactaggaaagctccaaaaaagaatgtctacagagcccagtcccaaatatctgaaagactccctcccctatttatggggcagatggaggtagtagagccaggaaagggaatttaaaatgagtagaaaaccatgattgtcttggtggtcatggttggaggaagggagaagaggaaggaaagaataaaagtagtggtaggtgctgtagaaaaagtcaaggaaatacttgatttgggactttggcaagtttttggtggctttgagacttgtagggaaggaaagccagtaaagagtttaagaactgtgctgcagggaaacgtgtgccagtgattctgcagggcaagggaaatgctaaagctgtactttcactgtattcatgtactgatttttcttaacgttgattattttcctagacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggtatgtatttttagaagtgaattggcaggaatccattggcagatgttaaatgaaagctctttaatagaaataaaaagaccacctacacagtatttctatcatttagggacctcttaaacctcctgtaccatagtgagaaagcatattactttatatcctttgttctggttgttgacatcatgaagtttatagccctgtaagattttcaactcgaagctcattgtgttgaactgatctagaatttttctttgggaatttttcttttttctagtctaagcagttttggaaatcaaacagaaaaatcgctgtcagagaccatgaccatttctggcagtttatttgcaacaatctggtgttgcatagtggttaaatcatatatgcatatatgcatagtggtccatcagctatggaccaaaggcctggacttaaagaacagctctgctgctcacagcagtgtggccacatgcaaggcactttactccctgggcccattttctcatgtgtgcaatggtgatagcagtaaagtacctggttcacagagtggcatgaggattaaatgaaaatcatttagcacgatattgtgttggccccactttaaagagtctaggacattcattgtgctgttaaagcttatgacagctgttcaatgatttatagtcattcacatgagaatattaaatcaacagggcagagcgcaaggagaatttgcagtttcagtacctatgtgtagtcctccctctgtctatcacctgacttgtgacctttagcaagttagctagtgctgtcattattgtataatgttgactgggcatctgaactttttcatcctggtttttagatttagatagccttggcttaataatcagcatttcaatttttattaatttattaatcactctgtgccttcctttcaaccctattttggtgtttcagaactctaacgctggaaaaa

SEQ ID NO: 81337 - DNA, 1051 bp, Homo sapiens
ctcagcctcccaagtagctaggaatacaggtgtgtgccatgatacctggctaatttttgtatttttagtagagatggggtttcaccatcttggccaggctggtctcaaactcctgacctcaggcgatctgcccacctcggcctcccaaagtgctgggattacaagcgtgagccactgtgcccagcccacatatttattgatactagcatgaactcgacttcttaatttattcaatgagttacattcaattatcaagtattttgatgttctaattgtcctacatgtgaccagtgagacatctctctcaagctggcttctctgtccttttgacatgtcccggtcaagatgtgagtgctacatgtgctcgttgctactgagatgtcattgcttctaggccctgttatgaagagagctataaaatatataatttttcccccagccaacacgcatccatataacccagatatgtaaccctgttgccaatgtaaatgtatggtggccctcagatgtcttgaagcagacaaaagtttgagaaccactaacctgctaaataagctgtttgcttaatgttggtgaacattctaaaatttgatctgctattttctattacttctgctgttctcttcatagattgaaataagaaccaattttatatggaggtgtttttgtttttgtttttgttttttcgagaccgagtttcggtattgttaccaggctggagtgcagtggcacgatcttggctcactgcaacctccacctcccgagttcaagcgattctcctgcctcagccttcctgagtagctgggattacaggcatgcaccaccacgcccggctaattttgtatttttagtaaaggtggggtttcaccatgttggttaggctggtcacaaactcccgacctcggatgatccacccacctcggcttcccaaagtgctgggattacaggcgtgagccaccgcacccggccttatagaggttttaatacagcttaagttgtgatggaatttgaagaccacagaatcatgaggtgatgtgtttcagtgttttta

SEQ ID NO: 81338 - DNA, 1012 bp, Homo sapiens
ttttcttagtactgtggggaagagatctgcctgggaaagcaaggttgtggatttccagtctccagcacttggtacataattggcactcagtaataatcaataaatgaaaaatgtgaaggaatttgggtaaatgtaaaaatgtaggcatgtctgttgactccttaatgtgtttggcacttctctgcatttggaagtaggaaattttaaggaatactttctgggactctgtttcctgatcttttctgccagtaggccctggtttggattaaatttgctcaactgctgctatgtcgtggccctggcgaagtcaggtattcctaaggttgaagccacagcccctgtgctgctctcctcccgccagtctgtaataatattcttcctctttgggaaatataaggcacacaaaaaaggctttattccatttccttagggccttaaaatatgaactggaagagagcaaagagacaggcacatagagttaactataatagaacaataataatagctaacacttacatatccagcctactcagtgtgccaggcactgttgtcattttaagtgtatttacctccttgtccacacaaaagcaaggtaggtactcctattttcctcattctacaggtgaggaaattgagacacaaagagattatataacttcatatgcctagcaagggttggagtgagaacttaaaacaccagatagctggtttcagaatcctttaaatactaggtcaaattgcagaaagaagaaagcagtgatttgagatgtaaattacagctgcaggaactgaagaagacaagataagctagaacccccagtaacagctgttacaaggaggggtcagatcaagttttgtaaaggcactgggcattgtaggaggagtagtttatttaaaagcataggttgggcatggtgactcacgcctgtaatcccagcactttgggaggccaaggtgggcggatcacctgaggtcacgagttcaagaccagactgaccaacaaggagaaacc

SEQ ID NO: 81339 - DNA, 1002 bp, Homo sapiens
aaaaaaaaagataaaagcgtagacagcagccgagcgcagtggctcacagctgtaatcccagcactttgggaggccaagggagacggatcacctgaggtcaggagttgaagaccagcctggccaacatgttgaaaccccatctctactaaaaatataaaaattaaccaggtgtggtggtgggcgcctgtaataccagctacttgaaaggctgagacaggaaaattggttgtacctgggaggcggaggttgcagtgatccaagatcatacgactgcactccagcctgggtgatagagcgagactccatctgaaaaacaaacaaacaaaaaaaggcttaaacagctgtattgaaataaaatttacataccataaaattcacctaaagttgacacttcaatggccttttttttttttttttttttttttagtttataaggttgtgcagccatcaccattatctaattttagaacatttttgtctctgttgaaagggagagtatacccattagcagtcaattcctactttctcactttccccattcttaggcaacccctcatctactttctgtctctgtaggtttgcgcctattctggacatttcatataaatggaatcacataacatgtggccttttgtgactgacttctttcactgagcatgtttttaaggttcctccatgttgtagcctgttttcagtatttcattcctttctattttcagataatattccattttatggatcctactttctgttttatttgcccattcatcatttgatggatgttcaagctgtttcagtgttttggtttttttgaataatgctgctgtgaacatttgtgtagaagttgttctgtggtcatcagttttatttctcttgggttgctgggtctgtggtaactgtatgattaaccttttcaattcaaggactactaaactagttttcaaagtgcctccgtcttttttttttttttttttttttttttgaggcggagtctcactctgt

SEQ ID NO: 81340 - DNA, 1044 bp, Homo sapiens
tttttagtagagacggggtttcaccatgttggccaggctggtctcaaactcctaacctcaggtgatccacccgccccagcctcccaaagttctgggattacttgagccaccacgcccggccataagcatacattttgattgagaatgtatctcttaatgagataggccttttgtttgtttgtttgtttaagagatgaggtctcgttatattgttcgggttagtctggaattcctggcctcaagtgatcctcccaccttaatcttctaaatagtgtggactacaggtccacacccagctaggacttttgttgttcacttagttgacatatctggatgaattgggtccatttatatttcttatttttatggatgtaagcactaagaaatattgctcacataaacatgtagatgggaatggaaggcattttttgtagctgtaacaattatttgaattccttctgatgtatatgccaagattacgtaatgatcagtcatcaaaaattatttttaattatctgtcaattgacaactcaattaggtctttcaaatttgtggtaagcaaagaattggaaactctctgggaaaataagcaagatcaatcgttattcactttactttttctaggaaaaataccctaaaaaaaagctttaccaatacttacctaatgactattaagtagtcttattattctttcaacaagaatcttgttccctgtatccaatatgtatggaagagttggggaaatcaaaatactgttagtttcagtatacctttccaatatgatatttttgacaaaatacttttattgtgtgatacgcttttctaataacttttttgttgttgttttttgagacagagtcccaatctttcacccaggatggaataagtacagtggtgcgatctcggctcactgcaacctctgcctcccaggctcaatttatcctcctgcctcaacccgccaagtagccaggactacaggcgtgcaccaccatgcctggctaatttttatgttttttgtttgtgttgtttttttcgtagagacgg

SEQ ID NO: 81341 - DNA, 1486 bp, Homo sapiens
ctcaactgaaatggatatccttgaaaactgatttatcaagctcctgagagtgaactatcaccttgcttccactaagtaatttgtaaggtctaagatccgcagtccctggtgttttttttttttttttttttttttttttttttttttggtataagtagctctcagacttttacccacatgagtttccattaaaattgtacaagctttgactttaaatcagctgatgaatagaaggagttgatgtgtgatcagctggtgctattgggaaaactgatgataagcagtggagcaggtaagaacgtattgttcctgaaccattggaggaactagcagcagtgacctctgaggagccctgggaacaccctggagctcctgagcaacacgttgcttgtgatcactgacctggatatcatgactgtgtgagcaacaccccccacacctcagtagcaaaaacagagaacagtggcagcacatcgtgggctgactgcagttgattctggctctcttacatgagaatgccaagtcatacaagaaagtgcctgccatgctgagcttctctttaccttcttgggttttaatggcattgcaagttatcagtataaaaactcatattagttatactaaatagttggaccaagttaagatattaggttgttatgtagtgtgcattttaaagtaaaacaaatgatagagcttttagaagcatctattatgaaaatgttccttcaagtctgtgccttatgaatctaataagcttttgcttttatatcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgagtaagctgggctccattgtagagacattctgtcatcttcagcctcatgatagtagtctactcctgctattgtggtacttctggtccagttttccttaaataatcgtagaaaaatagaggagtttatacagattggcaattttattttagttcatttttattataaaagtggtaagtgcttattttgtaaaactcaaatgatacagatgtgtacaaggcagaaaatttacaaaccatgccttgtagttttgcccccaaaataactctagttattggtttcctttgtatcctttcagaccctatttctgcatgcattcttgcatgtaacacatatttcaaacatgcaggaagataaaaaggagaaaataatgagctgtcatatactaccatctggattaagaaataaaacacaatcaatcgagctgaacccctccccaccaccccatagcctctcttgtctcatccgtcctctcccattagaggcaggcaaatatcttgtatttggtatgtaccttttcc

SEQ ID NO: 81342 - DNA, 2406 bp, Homo sapiens
caactatttgggggaaaaatactcataaactggaagaaaaaaataatattttttaaaaattattttcttttttttttttttgagacggagttgcgcttttgtcacccaggctggagtgtgatggcacgatctcagctcactacaacctccacctcctgggttcaagcgattctcagcctcagcctcccgactagcagggattacaggctcgcaccaccacacccagctaatttttgtattcttagcagagacagggttttgccatgttggccaggctggtctcaagctcccgacctcaggtgatccgcccaccttggcctcccaaagtgctaggattacaggcgtgagccaccgtacctggtgttaaaattcttaagtaacaacagttgcttactgatggaaagtatgccactgctgttctcacacattggaatcaaatccgacactgccaccctcatttcctgtttcacattgattttcttgagatacttctttttatcatagcaactgcgaaaaacccagctttgcaaagatgagatattgctaataggaatgtagcacaatctaatgttaataccattaactacctcaagctaataatttgggtgatgttcaacagatgttaggcattgctgtgtttcccttcatgtaaaatattctgtctctgtgagttcaccacagcacccccgggcttgttggcacacaattttggaaccactggtgtaactactttgacctcagatactcagagaagtgcatggccactgccgtaatctcaggctctgcttcctcaggatgttcagttcggtggatgctcgactgataaatacagcaaatataagtcaaaccatcatcattggggataatgaagatttgaaaaaaaaaaacctaacatttattcctatagtactaaaatcttgaggatgaacattaatactcagttaattataatatagaatgccatgttgacaatgctgttaacagtaattttcttatttaatatttaaagttatatgaatctattctaaatatttctatgatatgctctatttttcccctataagtatgtcttactatagtcttcatctcttttagtggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggtaaaaaaagaagttttaaaattctttataattaaattttttttctcttactttaaaaatgtagatacaaattagattgcaaaaggtggtctccgacagattaacaggggaaagacagcttccttccagtagtaatttggaatggaaacatttaaaaagtaatttcatgcggtatcttttctttataattagaaccctgttaaaaaatataatggacatcagcatatccagaatattgagtttatatatgtgcactgatgattacagaatattttagaaatattaatatgcaaacatccaaaaagatccaacatgggcaggtagaatattttaaatttaatatattaatgttattaatataatacattatattaaaaatttaattgattaaattaaatatattaaaattgacgtattaatatttaatattttaaatatttaattaatatactaaaaatctcattctcaaaagagtaataactagtgtaccgtatgtttgaattcaaatcaattacattactctttttttttaactataaagaataacagtaactgcttgtggataaattcactattatctgtcctaaaatacccttggaaggttgttaaattcagtcattaggtacttattttacctatcttggtaattctacattttaatgtctactgtaacctactgcttactgagcattttcacgtttggtgtattatttacctatctgggagtattagacttatatgtgcaagatgctggagagccacaagtgaccatggtatggaccaattcatagactggagtggagaccgacatacatgtgttcatagaagtttaacactctggcttggcgcagtggctcatgcctgtaatcccagcactttgggaggccgaggcaggaggatcacctgaggtcaagagttcaagaccagcttgaccaacatggtgaaaccttgtctctactaaaaaaatacaaaattggtcggctgtggtggcccatgcctgtaatcccagctacttgggaagctgaggcaggagaatcgcttgaacctggtaggtggaggctgcagtgagccaagatcatgccattgcactccagcctgggcaacaagagcgaaactccat

SEQ ID NO: 81343 - DNA, 1115 bp, Homo sapiens
aaagtcatctagtaacggggactctaaaaagtgggcaaagtttggggatagctgaaggaaatgagaaaggaaactagcaggagatgatgaaaagagcgttgactatggcaccaaagaccccagaggggttagaatccgtggatttacgtggcaccccacaggttcccacccagtatgtaacagagcactattctaggaggcatggaggatttaaattgtgtgtttgtgtgtgtgtctgtgtgttatatatgtgtttctacccacagagtgctatcaggtagttgaaagacaagacgtatctctgtgaaacagtaacaacatcgagtggtagttgttctagaacttagataagaatgaacatttgaaatttccgtaggttttggtctcggtattggtctggaaatgggttatgatgaatctactatagttaatattaaaccctagtaatctaggcattgttaccttaattatagcagaaagtattctctttttattcataggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttgggtaagtcatctgttttgaatgtttgagttacttcaattgaaattgaacatctaaagaatttattacaagtacatagaaaaactttttgtctattttcttataaaacttgagtttctgaataaaacttttaagtaacaaaagaaagtcaattattatactgttttatataatgtatatgtcactaagttgagatggtttcacatacaaagaagaaaataataaagcttatgcgagttcatctgagtgggtggaatgtaactattaaaatgtcagtaaggaaataaaatgaggattagacccataacagcatagagaataggagagagactattatcagattagtgccttaaaaatctctcaggggctgagcacagtggctcacacctgtaatcccagcactttgggaggccgaggcgggcggatcacctgagatcaggagtttgagatcagcctggccaacatggtga

SEQ ID NO: 81344 - DNA, 1014 bp, Homo sapiens
tgcactccaacctccacaatagagtgagaccctgtctctaaaaaaaaaaaaaaaaatgtagataagtaatgcacagttatcctaatacatagcacagtgataggaagctattatggtttatgtaaactctttctttgatttatttgctccaatataattttgctgctgttttttgtccatgtgtattgtaaaaagataaggaaaagtacatacaaccatagaaattttagcgttctactcaaatactctcatttaacagaaatgagtgtctgtgccggggtttgtgatctattccatctgtccaaacctgtccataaatgactttttagcctcttctatttgagggtgatgatatacgtacatttactcatcttacttcctgtatcttcttatcagggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtatagtatttttcatgtttattttattatctcacaatgagtgaaccaaaatatattattgtgaagtatagtgtctttgtccaagcttatagatactgaatttatatatactgttctatacgaacatattctgtttttcttaaattggaaagagatcttaaaattcaacccaagtaatatgacacctgtcaaaagtaatttaatgggttatcaggtcactaaatctttatatattcattaaagaagcatttatcaagaggctattctatgcttgacactggagatacaaagatggagaatgcacagcccctgttcccagtgggctcactatctgcatgacagaatagaattgccccccaaaaatgcaattaagcattaaataaagcccctgtatgggtacaagtgcacatatacccac

SEQ ID NO: 81345 - DNA, 3228 bp, Homo sapiens
ttcttccttaatagtccataaaataacagtatcttaatatagttggcatcttagatccaatgaaatattgtaatgaccaattgtaatattgtaatgggctgggggccgtggctcacgcctgtaatccctgcactttgggaggctgaggtggacggattgcctgaggtcaggagttcgagactagcctggccaacatggtaaaaccccgtctctactaagaatacaaaaattagccaggcgtggtggcgggcgcttgtaatcccggctacttgggaacctgaggcaggagaattggttgaacccaggaggtggaggttgcagtgagccaagatcgtgccactgccctccagcctgggcgacagagcgagactccatctcaaaaaaaaaaaaaaaaaaagtctgcaatgaagagctagtttccttatgaagagattatgttttatgcttctttgaatctggatctagcacactgctatgtctttagttaataaatacttactggtctgagttatttccatgggcagatagcccaacccagaatttcagtagtagagttcctggaaaacaacgtcttcatatagttggccagctgggctatattaccttccatattcttcttcataaaatctcataatcatcaccttctctcttcttcattccctctcctacgataatcggtcattacaatatttcactgactctaagatgccaactatattaagatactgttactttatggactattaaggaagaaaaaattctgctaattaaactatgacacagtgcttttattgaaaaaattgtgttttactgatttagacattgatttttattatccacagctgtgtgcctgtatgaaaaatacatataatcaaattaccgtaggtacttataaaagttcacattcaaagcctgactcttctgagtcactttttgactgagtcgtccatgtctttgtttttccctatgtcatcactaacattctcattagccataaggcatttccagagtgttccactattttccccaggatttaatcgaaatctctgttatcagttctgttttgaaggtggtggtttcttgatgataccagaaggtgtcaacagaaggttgtacatctctcagtaacaaaaatgtagtgcggcctcatctactttgggcatcttctttcttaggtcacgtaaagcacttggttgtacttgcgagaaactatggaattgggggcctgtgtcctcagagacaaatagtgcctgggttttttttgttttgctttgttttgtttttttggagataagatcttattctgtcgcccaggctgggtgcagtggttgaacacagctcactgcagcctagacctcctgggctcaagtgatcctcctaccccagcttcctgagtagctggaactacaggcatgtaccaccatgcttggctagcttttttatttttttgcagagacagggcctcactgttacccagactggtctcatactcttaggctgaagcaatccgccctgtctcagcctcccaaagtattgggattacaggcatgagctaccacgctcagccagatagtgcttttcttaataccaaatgtattccctgctactctgtttcagaacttttctgcattcacaatcacttttttaatgctaatcacagtatagtctttttgaagacatgtcatggcagttagactcaatacatgaggtacaaacagtgcagtgactttgttgacatgctgacagtactaatagctatgactaagttctcacaagcatgagcagtaacaaccgcaaggcagctgccatttagccatcagcagttctaagacatatcttgacctcaggaatgctaaattgtgaaaaggtgtgtgtcttagaattgatgaaatttggtattttatgatatgttatttctaggcgattagtgtagtttcttaactgtcctccttacctccagctgtgaatgtgatgtacattttaatctttcaaaacctagtaaaactacaacagcttcccagataaagtatacattttatcaagggtctacatttcttcctgcctctcctactttatctttcattaaacccccttcataaaccttctgttctgtccacagtctcttgcttttcctctaaacatgggaatgatgtgaaaatcacagatgggaaaggatttgaaatccactctttgctcagctcaaatacataggaatggttactccctcactacccagagccagtgcatcagtcagtcctacagagccagcctccaaaactcacccaagcttgcttcactgtgtctccactactgcattccagttcactccatcctcactcgctcctgcaatggcttccaccaggctcccggattctactctttcctttacagtcaagttcttaaacagcagccagggtggcctttaaatgacaggcttgtctagctgcaagactgatatgcgacctctatgcagaggactcagctggctgcttgttgcctcaacccacatggggaaagagtggaggaagaaaagtttgtgctggaggaagtaacaatttggttatgccgtctagggtggggtgtacaagtctggagtgcagagaagaggctggagctggaaatagaaatgcagcgttctcagtaaagagagggcacaccagtctcagctagatgagtactggccatgggaacagtgggcaagagcagatctgctccactccacgcacatggcacaggtcccaccctcagcttcctcctgccctggctcttgcccttgctctgccctggcctatgccgctggaattggatggtgggttcctgccctctgtgcctgtctgctgcctctgaggtgctaactttgccttttacaaaattggcctgtgttcccagtaccctgcagttagttggcacttagcagacgtgtgctgaatgcgtgaatgagcctgaattcagtgggttttctatgggtgataatttaaattcctaattttatgcctttgcacagaatctttatcttctgatcctgaggttttgcttcaaattgatggtgttactgaagacaaactggaaaaatatggtgcggaagtgatttcagtattacagaaatactctgaatggacatcgccaggttagtacacagccatgtgtgttctctaaaagcctgtttaatgtgaagcgacgcgtctcactgaattagaaggatgcagttgtgtgaatgcttcctacacc

SEQ ID NO: 81346 - DNA, 1031 bp, Homo sapiens
tatcccacctcagcctccccagtagctgagactacaggcatgcaccaccacacctgacttatttttgtatttttttggtagagttggggtttcactatgttggccaggctggtcttgaacttacgacctcaagtgatccacctgcctcagcctcctgaagtgctggggttacaggcatgagccaccacacctggtcaggttctcctaaattcttctatatggtaattagtccattaaaagccttgttccgaatacattttgacagtgagccagggttggagcagccatggtggagtcctgtgccctccatgctgctcctgtagggtggcctgtaggacaaggcagaccagccaggaaatggagactgggtccccgtgtgagctatctatagggaggtttcatgctttttgggtgccttgggatgcaaatacttatggaaattaccatcttctttgcaaatgtgtgctttcatgcggtctcacctcccgcataatatgtgacatgttcagccatattgtgcaaagacaagtttttttgtctgtaaagagtaaaataggatctagaattttcttatgttcatttactaagaaactattgttcaaagatgagatacaggaccgtttgtttcccttatattgagctgattttttcagcacatttaaaataagtaaaattgcctgccatctttatagcagttgatactttttgaattgcctaccagaactaactgcccaatcaacaacaggaacacaggccatatgcgacagtatgagctaaacctcatgtctctagttaacttcaagactatcacaaatttttttaatgaattctgattctcttttgttaaaaatgaattgccattgaacactttggggctttgtgcagtaaaaaaaggtttggttcttgctgaattgttgaatccatatggcagggaagcagctaggtatctgctaaaatgggcccctgcagcgtgtctcttcatatacactaaaaacacgtggaccagtgcgacatcacctgtaaacatctgc

SEQ ID NO: 81347 - DNA, 2091 bp, Homo sapiens
tttactattctgtcagtacttgctccgctgcttttattgctgcagaatcccatggatctccaccttgaagcacgtgcacactccctgcctttcattaacacctgggagaatcgacctcccagcctttgcaggggtagcaagaagaagccacaacagagaaaccaaaagttcagtcaagccaggcctctttaggggttgcgtaaatggcttctgtcttccccttcccatgttttcctgggccgctcgtctgggacatgtctgttctgggcgctttctgcacaccaggggaacaacaaagacagcatggtctgatatgtgtgatgatcttggcagtttccttctttcttcataattgcattgtttctgacagccgctttttgattttctgccagggcaccctctgccttctggctagtaggttaggcctggcaggagggagaccattccatcagtcttgagaacttgaccccaaagtaactgtatattgtaacagagttgcttgcagaaaaaagaaaccaaaaaaaagtccacagtcaacttttgcaagctgttgtgttttcttttgcagtttttctacctcttgtccttctgagtaataaaaaacaagaactgagtggggaaagagaaaggaaggcagacattaccaaattgtcattttcttgttaagtccataaacaaaatcttgtatgtgctaatcctcctgccagagtaccgaaattaaaggcattagaaaacgttagtttaattttgtggttttgagtgcgcaagtgatcagtaagtgctcttcagtgagaacattttcttatttccatcatttattcctccactttgggaaatactcatttcctcagtaactcacacagagccggagaccttaaaaggcatctggctcaacacccagggtttttgaagaggaagcttaggcctggcctggggagggcttatcggaggacaaccctgcctggtctcgatttcaaaggtagaagcggacactggcctgcccacacctgcccagagcacgttcacttctgcatgttgcctgtggagactcctaaaaaacacgcatggtcttccatctcatctttatgtattagaacaaagcaaaccatattgctattggctcccttatttaattttcacaacttttgtttgtaagagtgaagcactttgcagcatcatctggaacctaatctgataagaagcagtaaagctcacacttgtacccatttccatgcttgttttcagtgagcctgggtgtttaagatgggatttgttgttgttgttgtcgttatggagttttgctcttgtcacccaggctggagtgcagtggcaccatcttggctcactgcagcctctgcctcccgggttcaagctattctcctgcctcagcctcccaagtagctgggattatgggtgcacgccaccacgctgggctaatttttgtatttttagatggggtttcaccatgttggccaggctggtctcgaactcctgaccccaggtgatctacccaccttggctcccaaagtgctgggatgacaggcgtgagccactgtgcccagccaagatgggattcttttttaagccctaccagctaaagccagtgcactgtgtgactttgtgttacccttggagcagcctctttttgctccactctcctttccaccgacccagtgtgctccccggattgagagtccctgtgcagtgaaagaataaatgtggctctctgccagcaacctcacctccccaccctaccctcagagtttcacatcttcagaacaacacacaatgaaccagttgtgttctgggctctctgagtgggagtaaatggatggcccaggtgaaatggaggctgctgttggccgattcattctgtaaatcaacataaacagcaggttttctctctgggcttaatttctcagcaggaaatcagcatagggaaacttcaggctgcatctctgccagtctagcagatctctgccagttctgcagtaaaactgccttggagccagagtttaagtcatggagctccatcagaatgtcattacccacaggctgtggccctataccctcaattcagacgggaggcta

SEQ ID NO: 81348 - DNA, 1794 bp, Homo sapiens
gtagagtgcatataccacttggacttgcctaattaaaaaacacattttttttagaaatgaggtcttgctgtgttacccaggctggtctcaaactcctggcctcaagcgatcctcccgccttggcctcttggtctgattttttgtgtgcctagatagacatatttggatacatacttgatccaccagggatctcacaggggacaggaggttcccagagaatgaggctccagccttcccagttttccagcagtgtcctcctgccagccctccctcaagtcccaatcttgaatgaccccagcccactctgtccacagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgagtcttacctgggggtgggggctggggagatggggctgctggctggctctgtccagcaccctcttttggaggctgtctgcctccacccccatgtggctgggtgatagtggctcaggcatcatgcaacatgaactctggggctctgtaggttcttggaggccatggagccatctctgaagactttgaaaagcctagactctctctaaaaacatactttgttcttattcatctccaccctctagttgaacccccttattcctttggaaaatgaggcccaggaggggctcgtcattagcatgtccacggcaagttagcaaggcagcagctgggacctggggttcttggccctggctccccataccatctgtggtgcccagggcctgtatgcagagggagggtaggcaggtggctcctctagccccctccacccatcacaggccccaatatgattctcttcctggcaggtgacgactgacttgcggcagaagtgcacggagtctcacacgggcacctcagcctctgcccccttagcagccggcatcattgctctcaccctggaggccaagtaagtgggtgggggccagcggcaaccctgtccctaccagcactctctgtagggcagcccttagggcagctggagagctgctcccaaaaaagactgatccccagcctctcccttccttctttgcagtaagaacctcacatggcgggacatgcaacacctggtggtacagacctcgaagccagcccacctcaatgccaacgactgggccaccaatggtgtgggccggaaaggtgagggcaggctggcccggcaggctggatgtggagttaggtagaaggcactctgtgcctgacagctgaccctaccttccctgtccccacagtgagccactcatatggctacgggcttttggacgcaggcgccatggtggccctggcccagaattggaccacagtggccccccagcggaagtgcatcatcgacatcctcaccgagcccaagtgagggctggacccaggctgggagggggccagtgggacctgagagtcgcagggggtgcccgctggtccctctgggccaggctgaccatcatggtgctctcctgcacagagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccat

SEQ ID NO: 81349 - DNA, 2250 bp, Homo sapiens
cctgcccagcgccgccgcctctcacagcccgcgtgcttgcctttgctcgctcacacggcccagggggcactgagtgctactcagtggggcactcttggcattttgggagggacaattttgtcctgtgggactgtcccatgttgcaggaatccctggcttgcaaccatttaatgtcagtagtgtgccccaccttgtgcggtgcctgtgtacctttctagaatcccccagttgagcacgtctggctcactgagaaacagccaagccagcaggcacttctggccccatggggttggtctgcgtgggggaagggtgtgtggcccatgtgctgtgggttagatgtccctggcttggggtcccgcagaggcctcagggctgtgtgcactcccctccccaggccacatgactactccgcagatgggtttaatgactgggccttcatgacaactcattcctgggatgaggatccctctggcgagtgggtcctagagattgaaaacaccagcgaagccaacaactatggtactgggggcacttgaggggtaggggtacgaggtggagggctggcaggatctcgagcactgggtgtggtgccagcactgtcttaactcttgcctcctccccgctctggaacagggacgctgaccaagttcaccctcgtactctatggcaccgcccctgaggggctgcccgtacctccagaaagcagtggctgcaagaccctcacgtccagtcaggcctgtgtgggtcagtagtgggtgctgttgggctttgggggcctgagtctgggggtaaggcgggtgcctgtcctgaagcccagctctaacagaaaaaagtctcaagagacctagggcccctggggctcttgggatgaccacagtcctggggctggaggatcctggggatgtggtgacttggcttggggctgctgtggtcctggggctacagtctgtttagctgacacacacttgccctctctcccacgccggcagtgtgcgaggaaggcttctccctgcaccagaagagctgtgtccagcactgccctccagggttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgcttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctga

SEQ ID NO: 81350 - DNA, 1203 bp, Homo sapiens
gtactcaggcctcagctggtagaccccaagcagagaccctccctgtggcataaggagctgtgtgtgattgctttctggttttttggcagagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcaggtaagagtcagagctggcagggacgtacagtggccacgactggggtactgagctgcagttcacctggcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggtgagggccctgcagactcctgggagctggagtgtggagtgggatttctgatggccaatacaagggagggacgtcgaagaagatggtggcatcctcaggggaccctacattggctccctaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggccagtaccaggcggggaggcatgggagggcattgtctgagccccaggctgggtggacgggtcttaccttaagctatgggtgccaaggtggcagggagaggcccagagagctgtggaagagatgagtgatggtggagggagggaaggcaaaaacagataggttccgagataagcggggccaggatagcctggaggttggctgtaaggaaaggagggcaagtgtgtgttctcttggtcctgggattgggagaactggtccagtgaggccagtgcacacaggccctgacatttgctggttggcaggactgggcagagtgtcctgctccgtcctgagtgtgagtccttaac

SEQ ID NO: 81351 - DNA, 1100 bp, Homo sapiens
taggtgctctcttgcccagccctgggctggcaccttcctgctttgccctctgtgctgtagtttcaacagcaatctgctctttctctagccctacgtccccaaggagccccccgtgctgcgtgtcactgaaggccctttcttctcagaggtggttgcgtactatgagcacattcaccaggcggtccggctttacaatctgccaggtgagccctgcatatgaggaagggtctggaaggaggtgtgggctccacaactgtggcgtattcttccttctgctgcttctctgttcatacctctgttccgtatcatttgagacagggatgctccattctcttggagaaaaagtcatccagaaatgccctggggatttcttgggaggttggacagagcctctccccagctcggctctgatcccccagcccagcctcttagctgtgcttcagcctcacacctgtccatgcccccactttgttcctgtacccaggggtggaggggctgtctctggacatatcatccctggtggacatccgggactacgtcaacaaggagctggccctgcacatccatacagacatcgacagccagggtatcttcttcacagacctcaatggctttcaggtgactcctgggcctgggtctcggagaccccacagagtagaacttggactctgcttttgcccctgtcacaggccctgggggatgatctgccctgatggagaaagatgaatgagaggcgaagagttatcggggactccttcagtctggggaccgcttgggcccacatggtgcccgggtgcccttgatctgctggccttgcccccacaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggtgagtagggcccaggagttctgcagagggtatcagacaaaaagaagcccgtccccaccctcaagggctccccgctctgttggcctcccttgcctctttctggactgcatcacctccatgcttggagaggggg

SEQ ID NO: 81352 - DNA, 1931 bp, Homo sapiens
ttatattgttagtagagacggggtttcgccatgttggccaggctggtctcgaactcctgacctcaggtgatccacccgccttggcctcccaaagtgctgggattacaggtgtgagccactgcccctggctgagattcttaaagaggtaccaaattgtagatgaacagccacattctttagtgtctcggcacctagcacaaccctgccccttctctgctctccacaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaactgaagacctgttaagagtattctgtaagtcaacccaatgatacacatcatgttcctgtccacatactggttttccccaaatcagctgataaattcagtgtaattccaatgagattgaaactttggaattgacagt

SEQ ID NO: 81353 - DNA, 1040 bp, Homo sapiens
gtatgaatttgagagggacacaaatattcaaacttgcgggaggcatgctgactgggaaaccccagtccttcctactccactgaggggccttctctaggtctccacactcaatgctgtgtctcaaatcttcaactctgtcacattcagaatgacagagtccgcatctccaaccccactttggtttcctgtgcccagactacctaactacatggatttttagttcaggtttattctcaactagggaggtccaaagtcaggagccagaatgtcaggagtcaggagccaactgcagacccagctggtcctgggtactgttaccatctgaattgatttctcactgaccctaagtaaaattgagggttgttgcgaaggatctggtctctgtcttatctcttctcactatgagaatgagaatgagaatgagcccttgaagtgtttgtccttcacacacttttttgttagggaagaacaaagattttgttcagagatctctattgtggatggtaagcctcattcccaccatcctagactgattttccccctccgtgagtgcacagatgccccagtgacagagcaaggtaagcaagtcaggttcaggtcaaattaaagatgctgctctctctgcacaagtggtcgaggttttatgttttacctaccctgaggcaagccatatgaggacactgtctgggctggctcgccctgcatgggaggaccagctcttaagtggttcaactggagcctttctctctgtggttccaactggccatacagcccttccttcttcatgaaagctggatggttccaagtaaatgtaggaatagaatccgatccgtctccagtggttgaaatggcttctgtcatgtcctggttcattttgatggtaaccctcagaactgtgaggctggccgggcgcagtggctcacgcctgtaatcccagcactttgggaggccgagacaggcggatcacttgaggtcaggagttcaagaccagtctggccaacatggtgaaaacctgtctctactaaaaatacaaaaattag

SEQ ID NO: 81354 - DNA, 1154 bp, Homo sapiens
tgcccagccaacagcctcccttttaagccagtttgtttccttttgtctggctgttttatttcccagttcctcaattactgctgtgagaagggtccccctttctctgtgagtcagcctaggcccctctcctaagctgcctcctcccccaggacaagccaagcttcgtgcgggctcgggtgaagaagctgctggcagcgggtgtggtgtcggccatggtgtgcatggtgaagacggagagccctgtgctgaccagttcctgcagagagctgctctccaggtgagccagccttggtaggagccaacctttcccaactcctgagcctcagggctgcagatgtggctccagagggtgcaggttccagtgctgtgggcctcttagagcgacgggggctgcctgcgtggctgccgtctttgctgagcctaggagtgcagcgtctgcctgccagagtcccagagctgcctgcccaccaccgccttctccccacagggtcttcttggctttagtggaagaggtagaggaccgaggcactgtggttgcccagggaggcggcagggtaagctggtttacacaccccttcctgatggctgagccatcagcctataaaacatgactcagcagctgccacgccagagctgggtgttagatatggaacagaaaaacattaatggccagaggaacaccgtcccgctgagagagtgacgcggaagcaggcaagctccttggcccctccacactggtgcctgtgaaggtcctaggctctactgttcctttgtctcatttacccccatggccctggtgctcagcacaatccatgtccagcccttattaggtgtttcaggaagtgtttggatgcagagggtctgcacagggagtcaagcctggggagagggaggaaggtgagggtggcacggtcagggctggggagcccgatggtcggggtcttactcccagggatgtcctgagcagtgacgggcttgttcctacaggcgctgatcccgctggccctggaaggcacggacgtggggcagacaaaggcagcccaggcccttgccaagctcaccatcacctccaacccggagatgaccttccctggcgagcgggtacgtgtcttcctgccccggcctttccactccctctgtccctgatggcctgt

SEQ ID NO: 81355 - DNA, 1054 bp, Homo sapiens
ttgcccaggggtcatatctaccctgtttttctcacagaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactccactgtgtgccctgtccttgggcagggagggctgctgtgagtgggagtctctgagtgggtgagtgtgggtgagtatgggtgtgagctgggcgtgggtgagtgtgcaacggagcttcacagtggcagacccacctccatggaaggaatccaatggattccccaaccagggcccactgagttgcttcttaatcctactggagggacaaagggtaagcctaggaagctaatcaataagaaactcaccaggtgcggtgcctcaagcttgtaatcccagcgctttgggaggctgaggcaggtggatcacttgaagtcaggggttcgagaccagcctgggcaacaagcaaaactctttctctataaaaataccaaaaaaaaaaaaaaaaa

SEQ ID NO: 81356 - DNA, 1031 bp, Homo sapiens
actttgtctcagaatctcctctgtaaaacgaccattttggttcccaagattacatgggataaagtgccagatgctgggaagctgcgggacggggtgggggtgtcgggggcgctcggatcctagtccaatgcctaaaggacaggccacttcgtacccactttgtggcacgctgagcttgagccaaaagggaggacagggaaagtgcctctaaatatttgagcatctttgtaaatccggtagggcattagtcagggcgcctgctcagcgaaccttcgtggcacggactctgcctttgtggtcgggagaatgatagtttctccattttacagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtgagcactccccgccccgtccccacttattccagccgcgctccccagtcgcctccccgcaccgctgtggccagtccagtttgtctcccccgttcaggccgccagccccacattctgggttggtccccaattcgaccccttcccaggaacaccccgctccccccatccccgccgcctccattctggccaccctgctccaatccgccccgcaggtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaag

SEQ ID NO: 81357 - DNA, 1060 bp, Homo sapiens
ggtgacaaagccaacaagactggaggaagcaggggcctcggccaggtcactgggaggaacaggactgctccctccctggggttggaacagacataggcgcgctcagtccgaggccagacaggggagacatggagaggatatcggtaccacccgcctacctctctgaaagactgtcttaagggagtatccaaccagcacttacaaagcagctttttgtggatgtgacactgggtggagaaaaagattcgatggaagtgtgtgctctgaacatcttagcttggatagcagggaagtctggaggagcgtcttgcctggagtggctggtcgccactagcctcttggggatccccaaggttgcctggctctgggtctcttggattcacagagcagtggggcataatcccagcacttcatttgatagtctgggccccttcctggagggaaagcagcagcaagacccagtggagacgatggcaaaggggctgatttcactttaggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacat

SEQ ID NO: 81358 - DNA, 4210 bp, Homo sapiens
agccacacccagccccatatatatatatatatatatatatatatatatatatatgttttttttttaactaaaaagtataggattatagacatgaatataaagatagtctcagcctttgaccagtgcaggtattgtgtgtgcgtgtgcacgttcattagaaggatgatacatggatctctttcctttctctgcagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcggtaattcaccttttctaatatctaccagtctctggggagcacacagttggggcagagtgggtatcttcccaggggcacccaggctattagctagggcagctaccttggaggctgagaatccctttcctgctttgaccatggcagggtgggtgtgatttaagggggggttgtgtaggaaggaagttggcagcagcaactagacatttaacctggatccttctgcttaatacataccattccctggctgcaggaggcaacccctctatcactgtcctggtgctctcttggtggagttcttggtaattgtcttaattctttgttcttagaaggatccgtccctctctgacagttccactgttgggcttcaggtctgtatggcaatccctgcatgtcccttttccaaactgatctgtcatctgctggcttcattcatctgggcacagggctacactaactaataatctcagcagtgttacaaaggaagcaggaattcctatcatggactcaaaaaaacacatctgatttacattcacaacagattaattaataaaatttgttcagacttgaattggattctcagcccctaaagtcaggcacagttttaaatcacgtttaacagaaaaccttgaccctccccaattgtgacatcaaaggcctgcaatagctggaaagaatagaggcccccaatcacatggggaagggagccccagctgtgtgctgcctacaatgaggctcttggcctgtgtgctgattatttcctggagtatatgccttcctaacccctcagggcttaaccgccagctctattctcagctagctaatgctgatttcctcacctttgcctctttccatacattgagctactgaagcatagatgaagcactggaagcaagtttttccagaatgctcttcacttcctagtatcctactctatatttgctaacacctaactacactgccttttacttaatctgtgatttcttctctcaatattttactagcaagaggagaggatgttcctcacccttgaggggatattgagttaaacccctagcctgcctcccctcttaattgctgcagggatagagaatggaacagttggccaaggctgcagctagttttgatcactgaaactggcttcctactccagcatgtttttcaaattacgtggctggtggtgcttctacctttaaaagtgggtgtgtgtcactctggctgattgctggacagaggtccagctttctctttttcgcttgttcaaccaaggcccattttatctgaggcttaaatgtacctgcctatctgtgtggctagtcctaggtaggttcgtctggtttgggttgctatggctgatagactccaccaggcagcaccaaagccggtaaactaacctctgctaatatctgtctttctcaatagccattcatgctttatcttttgctgctctaccatgtgctccagcatgagatcaaatcaccagcaggttacaaggcctcagccccagggattggtagatatatgttctggcccattgttttataaagggctcaagagaccaaagcttgttgcctacttaccttgacaactctaaagtagctctgtgaagtagagtcatgcctcgcttaatgacagggatatgttctgagaatgtggggcaatttcattgtgcacatatcagagtgtacttaacagtcctagacagaacagcctacacacctaaactatatggtatggcgttttcctcctaggctacaaacctgggcagcatgttacagaaagaatactgtaggcaattgtgggtttttttgattcaggctattcctgggatactgtaggcaattgtaacgcaatggtaagtatttgtgtatctaaacatagaaaaggtacagtaaaaatatggtataatcttatgggaccaccatagtgtatgtggcctgtcgttaactgaaacatcattatgcagtgcatgactgtatgaaggatttctcttctgtgaggtgtaacagaatggactggctgaggaaaaaggggtcacgggcatgcgtgcacatgcactctgtctgtgactaatagaatggtgctcagagttcctcaccttttactcctaacgcagcctattgcaggctagggatctcagagaaactaccttcaagggaccttttgctgacacttaaccaaacttagaagggtgggccatgtgtaagagaggcagtatggccactgatgttatttatttttcaacagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaagatatagtgtggtgtttcctttttttccccagtcactttttagttggttggtctgtgtgtgaaaaacaaacacaaaaaactaaaaggacctcctggaaatttttagtcaggagtgtgatttttttttttgagtctcactctgtcgcccaggctggagtacagtggcactatcttggttcagtgcaacttccacctcccaggttcaagcgattctcctgcctcagcctcccgatttgctgggattacaggcacgcaccatcacacctggctaatttttgtatttttagtagagacaggctttcaccatgttggccaggctggtcttgaactcctgacctcagatgatctgcctgcctcccaaagtgctgggatgacaggcatgagccacagcacccggccgagtgtgatttttaaaatattctctggtacatt

SEQ ID NO: 81359 - DNA, 2041 bp, Homo sapiens
aatattttaaaaatcacactcggccgggtgctgtggctcatgcctgtcatcccagcactttgggaggcaggcagatcatctgaggtcaggagttcaagaccagcctggccaacatggtgaaagcctgtctctactaaaaatacaaaaattagccaggtgtgatggtgcgtgcctgtaatcccagcaaatcgggaggctgaggcaggagaatcgcttgaacctgggaggtggaagttgcactgaaccaagatagtgccactgtactccagcctgggcgacagagtgagactcaaaaaaaaaaatcacactcctgactaaaaatttccaggaggtccttttagttttttgtgtttgtttttcacacacagaccaaccaactaaaaagtgactggggaaaaaaaggaaacaccacactatatctttttgaaatgtaagtatacagattttaatttatttttaagaataattgtatattttaaaaacaggacacgtactgtatgagtaaacagcgtggctaacaccaagtccacactggtaagcttttgagaaccatttacactatgttgacagtagtactgctgcaggcagacagcggaagaataaataatagtgcttcaagaagagtagtgattgagaggataggtaaagagggcgcctcatcgtggaagctagagcaggaacacctccccagtagtgacatgtgcaaagttccagatctccacgacaaagacagctcaacccattggaacaaacagactcccaatgtggctggcaactgcgggggtagaagaactcaggcaaagtaggcacaggaatgggggagatgagagccaagggacaaacgccgagaaagcgttccgacaagcatgtgtgttcatacatgcatacccccaacaaagggcaatgcactgtgtaacagaactgaacacaatttaacaaagctgctcccagccttcctgtcacctctttggcagtagggcaggccatctcaacttcggacacacaaagacattctcttcaggaggaaggctgtcctgtgtggtggggacaaggcttcaggtaagagcaaagctatgatagctacagcattaattgaacatgcctaaacaaaaaagatgttaattactagttacaggtatacatgccaaaattacccccagggatgggcatagtcaatcattttcctacagtggtgaaataaaacaagctttgatcatgcttcagcaagtagaattatgtggtagagaagtcaggccccatatgctaaaatttgcacttcttgccataaacttttcatgtatataagtcaaaaccaagtctcctaggaccactaaacctatgatgggctttcaactgtaacactcattcacatctttaagttaggcccatggtcatggaacctggccaaggtttcaagcacgcctaagctgaagaaaaactaaagtcacccccatataattaggtccagtctaggcacaggaagccacagctggttgactgatcagggcttctcaggactggatgttggttgaattgaggattccagaagtagcatcagatttggaagcctttgaaagttctcgctgttgaaaaataaataacatcagtggccatactgcctctcttacacatggcccacccttctaagtttggttaagtgtcagcaaaaggtcccttgaaggtagtttctctgagatccctagcctgcaataggctgcgttaggagtaaaaggtgaggaactctgagcaccattctattagtcacagacagagtgcatgtgcacgcatgcccgtgacccctttttcctcagccagtccattctgttacacctcacagaagagaaatccttcatacagtcatgcactgcataatgatgtttcagttaacgacaggccacatacactatggtggtcccataagattataccatatttttactgtaccttttctatgtttagatacacaaatacttaccattgcgttacaattgcctacagtatcccaggaatagcctgaatcaaaaaaacccacaattgccta

SEQ ID NO: 81360 - DNA, 1051 bp, Homo sapiens
tatatatatggggctgggtgtggctcatgcctataatcccaacactttgggaggccaaggcaggaggattgcttgaggcgacatgttcgagaccagcctgggcaacatagcaaaacactgtctctagaaaaaaattttttttaaatatgaattcttgatttacagaacacctatcttgagcatagtctaataaaatatttgaaagactgaatgtgttttgccacatactttccacatctctactgagtacctggcatgtctagtgatctggtttcactgggctagaacccacatgtaggggacctatctccataccagctgaggactgggcttggaattgagtctacagcgaccctgcctgatcttcagtttcccagacacatcccagtgcttcccatggtaccagtggggctcagagtgactgttctctttttttgcacgttagttttggaccattatttaatggtgagctagcttatatctgtcaactctcagcatctcaataagaaccaaatccagggatcttagaatctagaacaagtaggtggggcctctgggtgaacaggctagggacgcatgtgaggatgtgcttagacacagggcatactaaccttgctgccagaaggaggaagtcgagacacgggggagtggtagactgtccctccaaagataggccgaatgctactattggccgtagcattggacatggtggtagtgttcagctagggagaagagcacgtgggtaactgatgtgcagtaacatcctcagcatttctagcaacctgtctaccctacagagaaatgactatgggaggaggcagtctagggaagacgggtttacatggtgaagggcctgctgtgtctaatactgcatagatttgaagtaacttgtgaaaaattttcaaagcctattgctatccagcaaatggaagtgtacaatggtacaaccactgtggcacaagacatctagcatatgacccagccattccactcttagatgtttctacccaaacgaaatgaaagcatagatccatacaaagacttagacgta

SEQ ID NO: 81361 - DNA, 1025 bp, Homo sapiens
taccacagtttgcttgtccacttacctgctgatgggtatttggctgttgccagcttttggctgctgcagggagctgttgtgaacatttacgtctaagtctttgtatggatctatgctttcatttcgtttgggtagaaacatctaagagtggaatggctgggtcatatgctagatgtcttgtgccacagtggttgtaccattgtacacttccatttgctggatagcaataggctttgaaaatttttcacaagttacttcaaatctatgcagtattagacacagcaggcccttcaccatgtaaacccgtcttccctagactgcctcctcccatagtcatttctctgtagggtagacaggttgctagaaatgctgaggatgttactgcacatcagttacccacgtgctcttctccctagctgaacactaccaccatgtccaatgctacggccaatagtagcattcggcctatctttggagggacagtctaccactcccccgtgtctcgacttcctccttctggcagcaaggttagtatgccctgtgtctaagcacatcctcacatgcgtccctagcctgttcacccagaggccccacctacttgttctagattctaagatccctggatttggttcttattgagatgctgagagttgacagatataagctagctcaccattaaataatggtccaaaactaacgtgcaaaaaaagagaacagtcactctgagccccactggtaccatgggaagcactgggatgtgtctgggaaactgaagatcaggcagggtcgctgtagactcaattccaagcccagtcctcagctggtatggagataggtcccctacatgtgggttctagcccagtgaaaccagatcactagacatgccaggtactcagtagagatgtggaaagtatgtggcaaaacacattcagtctttcaaatattttattagactatgctcaagataggtgttctgtaaatcaagaattcatatttaaaaaaaatttttttctagagacagtgtt

SEQ ID NO: 81362 - DNA, 1811 bp, Homo sapiens
aataataataccattttttgagttaagtcagggatatcatttcaaaacgctctcatttagtgattcgtctaatccttacaacatccttatgaggtcggtattctttccatttttacagacgaggaaactgaggtactaagaaattaggtaaatctggccgggcgtggtgtctcactcctgtaatcccagggctttgggaggccgaggcagttcgagaccagcctggccaacatgacgaaaccccatctctactaaaaaatacaaaaattaaccaggtgtggcgtatgcctgtaatcccagctactcgggaggctgaggcacaagaatcgcttgaacccgggaggtggaggttgcagtgagctgagatcgtgccactgcactctagcctgggcgacagagtgagactgtctcaaaaaaaatgtaaatttgctcactgcttcacagccagtaaagagggtgattccagattgaaccccattaagtctgatttcagagtcctgctcctaatgttcaccgcctatttcatattgctgatcttccctgtgctgcctccaacttcaggcaccaaaaccttagtggtcaaactttgggttcttgccattttccactcttgtgtgttgtgtgaatgaaatgtctccgggctttgatttctggtcactctgacctgtacccatgtgggcccagctacctgaaatgaggctaatgatgctctggggaggaggagtcactctctagggaaatcatttcatttgggctttgcactaaagagttgaagtaattaacatgtccttgtttctggtctcagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagagtaagtgtgaacgtgaacgcaaattgggaaaagacgaagaaagtaatctgagcagcccatagtctctgccggggaccagggtttgtggaacagggagccggggaccggggcttgtggaacgggaagccggggaccggggcttgtggaacggggagccggggaccggggcttgtggaacggggagccggggaccggggcttgtggaacggggagcccgcggcagctctttagctctggctgtagagacacgggcctagattcccggccctgctgctgttgccatcccagacccgctctcttcctgagatttatcactgttgcttctgactttcacacagcaactgaagaacaaaaaacagacagagacagagatgctgtatggcagcgctcctcgaacacctagcaagcggcgaggactggctcccaatacaccgggcaaagcacgtaaggtaaacacaaggcttagggaaacactgatttcaagggagtgggtgagggtagtcccagccacctctttgaagggggccagcccctccacacctgtgggtatttctcatcaggtgggacaagagacagagaaaagaaataagacacaaagtatagagaaagaacagtgggcccaggggaccagcactcagcatacagaggacctgcaccagcaccggtctcttgagttccctcagtatttattgattactattttcactatcttggcaaggggaatgcggcaggaggacagggtgatagtggggagaaggtcagcaggaaaacgtgagcaaaggaatctgtgtcacaaataagttcaagggaaggtactgtgcctagatgtgcacgtaggccagatttatgcttctcccca

SEQ ID NO: 81363 - DNA, 1096 bp, Homo sapiens
taccttacgtgctttgcccggtgtattgggagccagtcctcgccgcttgctaggtgttcgaggagcgctgccatacagcatctctgtctctgtctgttttttgttcttcagttgctgtgtgaaagtcagaagcaacagtgataaatctcaggaagagagcgggtctgggatggcaacagcagcagggccgggaatctaggcccgtgtctctacagccagagctaaagagctgccgcgggctccccgttccacaagccccggtccccggctccccgttccacaagccccggtccccggctccccgttccacaagccccggtccccggcttcccgttccacaagccccggtccccggctccctgttccacaaaccctggtccccggcagagactatgggctgctcagattactttcttcgtcttttcccaatttgcgttcacgttcacacttactctttcctgcttggctctctctttctccaatcgatgcatctcccattgttctgccacatactccatgaatttctgcccattcaccataaatgcctttgaatgttcctgttcccacaattcaattcgtgccttcaactcttcttccagctgagaccagaaacaaggacatgttaattacttcaactctttagtgcaaagcccaaatgaaatgatttccctagagagtgactcctcctccccagagcatcattagcctcatttcaggtagctgggcccacatgggtacaggtcagagtgaccagaaatcaaagcccggagacatttcattcacacaacacacaagagtggaaaatggcaagaacccaaagtttgaccactaaggttttggtgcctgaagttggaggcagcacagggaagatcagcaatatgaaataggcggtgaacattaggagcaggactctgaaatcagacttaatggggttcaatctggaatcaccctctttactggctgtgaagcagtgagcaaatttacattttttttgagacagtctcactctgtcgcccaggctagagtgcagtggcacgatctcagctcactgcaacctccacctcccgggttcaagcgattcttgtgcctcagcctc

SEQ ID NO: 81364 - DNA, 1001 bp, Homo sapiens
attctgcttttctgtcttgcccagccagtagaggggtggatcacagaaaatgtgcaaaaacatctgttgaatttagttggggtagctccatctttatattcagtgcagttcagactagcattcaactggactccaggagtcaagctccttttggctcaaacgtaggctctggcatttaccattatatgtctctgggttaaatgactcagcatttatgtgctttagtatcctcacctcttgacatgaggatgtgaaataatattaagggtttgacactgcacctggcaaaaagtaagcacctgataaaaacttaagcttcacagctagaggctacagtgacatattgcttcagaaagcaagagaccaatatttcccaataaaatttgcaaatgctttttcatacaggaatggcaattatgctaaatgtcttgaaaaggtggctttatctgttcagaaaaggatatacttcctgttgaatgtctggatgtcttaaaaactagtgagcaggccacatgaagaccccacttttggctgggtgtggtggcccaacactttgggaggccaagttgggaggattgtttgagcctaggaacttgagactaggctgggcaacagagtaagacctgtctccaaacaaacaaaccaaagacctcactcttgtactaaccagcacagaaaggggcaaaagcttgtctctgctcctggctataaaagcactggtcccagtactgaaccagctccactcgaattgcctcaatcactttcttcatgttttgcattttcagttcttccaaccgatccacttctaattgcagctgaaagaaagaaacttgttaagggtggctgccatagttttatattcactcaggtttgcaaaagatcccccccttttaagtaaaattataatgcaaagccacaaaggtattataaatcaacacttttttttttttttttttttttttgagacagggtctcactctctcgcccagacaggagtgcag

SEQ ID NO: 81365 - DNA, 1109 bp, Homo sapiens
gtctgggtcaaaggccaaggtccggaaagcggtaagaaacccagtgggtactgggtcagcagtcttctcttagcacttctgtgttagtcataaagactgttgttgatttggccaggctcagtggttcatgcctctaatcccagcactttgggaggccgaggcaggtgaatcatttgaggtcaggagttcgagaccagcctggacaacatggcgaaaccctgtatatactagccaggtggtagtggcgtgcgcctgtaatcccagctacttgggaggctgagacaggagaatcgcttgagcctgggaggtggagggttgcagtgagccagaatcgcgccactgcactcctgtctgggcgagagagtgagaccctgtctcaaaaaaaaaaaaaaaaaaaaaaaagtgttgatttataatacctttgtggctttgcattataattttacttaaaagggggggatcttttgcaaacctgagtgaatataaaactatggcagccacccttaacaagtttctttctttcagctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctggttagtacaagagtgaggtctttggtttgtttgtttggagacaggtcttactctgttgcccagcctagtctcaagttcctaggctcaaacaatcctcccaacttggcctcccaaagtgttgggccaccacacccagccaaaagtggggtcttcatgtggcctgctcactagtttttaagacatccagacattcaacaggaagtatatccttttctgaacagataaagccaccttttcaagacatttagcataattgccattcctgtatgaaaaagcatttgcaaattttattgggaaatattggtctcttgctttctgaagcaatatgtcactgtagcctctagctgtgaagcttaagtttttatcaggtgcttactttttgccaggtgcagtgtcaaacccttaatattatttcacatcctcatgtcaagaggtg

SEQ ID NO: 81366 - DNA, 1891 bp, Homo sapiens
actaccagatgggtttttgttgctaaggtgagacgatgttcataggattagcaggatgagtatttagatatgagctaggcatgccaccctatagctaacccaaagcaagctttccagccaatttacactgttatttctttatttatttagagacagagtctcgctgtgttgtccaggcaggagtgcaatggtgtggtctcggctcactgcaacctccgcctcccgggttcaagcgattttcctgccgtagcctcccgagtagctgggattacaggtgtccgccaccatgcctggctaatttttctatttttagtaaagacggggtttcaccatgttggccaggttggtctcaaactgctgacctcgtgatctgcccaccttggcctcccgaagtgctgggattataggcgtgagccaccgtgcctggctgccaatttacacattctataaaagtgcctggtgcctggagtagtctaatcatagagacaaaaggtagaatggtggttgccaggcttggagaagggaaaaaatggggacttatttgtttgagtatgaagtttcacttttgcaagaggaaatgagttttggaggtgatggttatgattgcacaacaatatgactgtacttaataccaatgaactgtacacgtaatggttaagatggtaaattttatgttatatgtgttctaccacaagttttaaaattggggggaaaagtaccctggtacttactcacttttcctcactgggaccttccttaggagaccctctttgtgccatattctgttgaccatgagttgacttacttgttagtttaactgaaagtctgtcatccacgccttcttatgttgtccttctcttcctctgaaggaattcacttggaatcttataacagtggtacgttgtcttattcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggtacactgcctacatttgttcttcctaaaagtcactttggttttcctctaggtatcttgtaattgctttgttttaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcaggtactgtcttctcaaattatgccctaggatctccgtagtatatagcagtttgaacaaaactgacagctgtttcttcagtcttaaataaggagacaatgtaaggtaagagaatgagggaagctaaggatagtaatatatgatatacaaccttgatttttgtttaacagttaaaaaacctttatatggctccaagaaaatgaaattatagatgaaataatattagtcatttgaattagactagtgtttaattaaaatttttttcagttctaaatttgaatgctaattcttggggtctgagatcccgacagccttacagctcgtgtttaggaggcatgaaaacatgctactttgaactctcatgaaagtgcctcctcctctactccagacatttctttgcgggaggctagagggctagcctctgtgctgctgctttgccgtgagtgacactggctttctatgctgtagctggaaatgcagaaatcacaaaatgaagc

SEQ ID NO: 81367 - DNA, 1268 bp, Homo sapiens
tggtttggttttgaagtcccttcttgaaatttgaggaggctgggtgcggtggctcatgcctgtaatcccagcactttgggaggccgaggcgcatggattgcttgaggtcaggagttcaagaccagcctgatcaacatggtgaacctccgtctctactaaaaataaaaaaattagccgggcatggtggtgagcacctgtaatcccagctactcaagaggctgagacaggagaatctattgaacccggaaggtagaggttgcagtgagccgaaagcacgccattgcactccagcctgggcaacagagcgagactccatctcaaagaaaaaaagaaaaagaaaaaagaaatttgaggagtttggtattggtgttgggagtttttttcctccattgccccaaacttatggactgttttccctcttgtaggaactcctggatatgatgattgctgaagaggaaagcctgaaggaaagactcatcaaaagcatatccgtctgtcagaaagagctgaacactctgtgcagcgagttacatgttgagccatttcaggtccgtggcagcccacagggtctctggtgatctgtctggggcctgagacttagaaagcaacgttgacttgggcctgcagatggaaggcttcctcgtagggatggagctagacgtaagaagtggggaaaacatgctgtgtagttaattaggcccagcagagtaattctcacctctgtagagagttgccctggtaagaggtgaagcaactaatagatgatcaaaaagaagctgctgcttaccatagttttgctttgtagggaatatgaatttttttttataaacgctgagaaaaaggtaggcatagatggtgctgcagtgttctttctctgaaagaaaatgaaaacaggaacaaaagtaactaatgattaaaaggaatactatgaaaacaccaacctttgtgggttttatcatacccagaagctgcataccactgaaccagccaaaatggcttcttcagaagaaatgtctcaaaagctggaatactgggagtgcatagtccatttcagagcatgccatgacatccatctgggtatggagctgagaagtggctatattgtggtccactgcaagtcagggacttgagtgaggacacagcaaggatgaaatgaataacagatggggtcctgaaaatctctgcttagaaccagtaaaaatagtgccaggatcataaaaattaggacagatgtggagcttggaaagacaatgagtacacccataagg

SEQ ID NO: 81368 - DNA, 1040 bp, Homo sapiens
aggctcagacgcccgggtgggagccgagcgccggtgcccggacgcggcagggtagtcgaggcccggggcccggggcggcctccacccaggcggtcagcgctggcgctcggaccccaccctccccgcccgcagcgtctcaggtgccgctgcttggcgcagatgactcgttgtaaaccttctgtggtcgtggcttttctttaaagctgttaagtttatttatcgttgtttttctttgttttattctttttttttatttttgtggaaacgcggtctatgttggccaggctggtctcgaactcctggcttcaagtaatcctgccacctcggcctcccaaagtgttgggattacaggcgtgagccaccgtgcccggcccgttgtttttctttatatctggccagcggtgttaacgttttgtttgaattggaaagatagctttgtttctttgcaagttaagaaacggattatggaattcttttccggtcgttttaataacttcctaggcggtgttggggagggactgtccgacttgaaatcgggaccagacggtgacactgccacttaccaaccttgtgacttccaaatattaactttattttctaaaagttgtggatgcagttttctgatgatacagcgttaaataatgtgtagtttttggtggaactgattgttctaaggctttgtaagattcttcatttcatgatcactaattctgatcagtctttttaaaatgcttgccctcagaataatgagaattgagtgccaacatggtaaaaccttgtcttaactaaaaatacaaaaattatctggccctggtggcgcgcctgtacccccagcttttcaggaggctgaggcaggagaatcgcttcagcctaggaggcagaggttgcatgagccgacatctcgacactgcactccagcctaggcgacagagtgagactacgtctcaaaaaaaaaaaaaaaagtccattaacagtttatgaattatgtaggcatctcctctatcaagggattgaatgaagcaggagaaaacttacccttt

SEQ ID NO: 81369 - DNA, 1045 bp, Homo sapiens
caccatgcccagccaatttttgtatttttagtagagacggggtttcaccatgttggctgggctggtctcaaactcctgacctcaggtgatccacccgcctctgcctcccaaagtgctgggattacaggtgtgagccaccatgcccagccaatgtttgtatttttagtagagacggggtttcaccatgttggctgggctggtctcaaactcctgacctcaggtgatccacgcgcctctgcctcccaaagtgctgggattacagcactattattatttttaatagagatgaggtctcactgtgttgctgaggctagtttcgaactcctgagctcaagcaatcttctcaccttggcttcccggagtgttaagattacaggtgtgagccaccatgcccagcctttatttttaactgacagataataattgtatatttttatggggtattcttatattgtttttcagcactgattgttaatatactccatatctgcatctttttttgcccactggattgtaaattatttgagaacaggaacttttgggtccaccatagggccagtaatgtacccagctcatcacattatacccattgtgttgagaggtatcttctgtggttggtatatggtggaccaagagaatagcatagctttggctaggatgagacctgtagggcaaatggcaaaagagttggtattgtttcagtttcttctaagttgctatccaacttgataattcttcttcactgtttttttttctttctctctcatagattgtgcttcttggtcagaccccgcatcaagaatatgcgatacattgccagtgagtgtgccatggtactatgtgtaactgtgggaaagggcgggcaaaatctaagggccttggccataaggaccctctaataagaaaataattgtttgagttggccgtagcacttgtggaggatgtctgcttccccgcttctttttttttttttttttttttttgagacggagtttcactcttgttgcccagtctggagtgcaatggcacgatctcggctcactgc

SEQ ID NO: 81370 - DNA, 1032 bp, Homo sapiens
ctcaggtgatcctcctgcctcagcttcccaagtagctgggaccacaggcatgtgccaccacacctggttaatttttaaatttaaatttattatttatttttctgagtctgtttactacagaatatatatatatatatatatatatatatatatatatatatatatatatatatatatttaattttgtagagatggagtcttgttatgttacccaggctgatctcaaactcctgggttcaagtgatcctcctaccttggcctcccaacgtgctgggattacaggcatgagccaccacacctggcccatactgtttttatattgttttattttaggtttttctattgacagtttgaggaaaattcagtgggatggtcgtcaggggagcataattagcataattaggaagccctcaataattagcataattaggaagccctcaagaagtcccctatcttcgtgtcacactttgtgcttttcaggcactcttatgtccattgtcttattggattctctctgtagcaacacgaagtagacaagctatacaaggtggagaacaagccagccctcagctccaatgaacagtgagtgtctgggagagtctgtccctactccaagctggaagaggtccctaggggcacgtctgcctttcatctgtccttggctgagatatatggttcacctccctgaactttacaatttcatggctaggttaatcttctgttgttttgttttgttttctgtagtttcctttctgtggtttcttgtcctcttccctctctaatttataatacagtctataaccagattgactaatctttcaaaattattttcatcgtgcttttctcaagaacctgcaaggcagctgggtgcggcggctcatgcctgtaatcccagcactttgggaggccgaggcgggcggatcttctgaggtcaggagatagagaccagcctagctatcatggtgaaaccccatctctactaaaaatacgaaaattagccaggtgtggtggcgtgtgcctgtaatcccagct

SEQ ID NO: 81371 - DNA, 1017 bp, Homo sapiens
atacatgactgatcttgagccttggtcccccagtggctcattagctggatcgcagctgagaagaaaggaggctgtagcagaattattatatcactgatcttaaggtatcagaaattctcaaaggaaagaagctgtagaggtacacataagggaatacttcatactttctaggtaaatatttgaatgaaaagttacagaaatattaaatgatatgcataggcattataaaatcactgaaaataaaataagttgaatgaagagcaatgcatggcagtgtccttttggtgaggatgagtcaaaatgggaaagtaaaggaacggtggtatgcagccttgaagcgaggcccccagtgcaccctgccttctgggcctcatatccttgtgtagttccctccccatgagtgcgggccagacctccctgcttctaatgagtagcatatggcaaaagggagaggatgtcacttctgagcctagattataaaagatcatgacttccatctttctctctctctctctctctctgtgtgtgttttgcattcttagtttgcttactttaatgaagcccactgccatgctgcagaggcccacgtggcaaggaacacaggacagcctccatccatcagccactggggaactgaggcccccattccaacagcccacaaggagcttgaatcctgttaacaaccacgtgagtgagtttggaagcagatccttccccagtcaggtcttaagatgactcgccctcgtcgacaccttggttgtagcctgtgggatcctaagccagaagatccagcaatgttgcacccagattcctgatttaccagaagtgtgagataactaatgcatactgttataagctgctgtgtttgggctaattggttgtacagccatagataactaatacaggaactaacatcaactgagcagtgctctgatgcagccttttacagtttatcttatttagttccctattttacttctgggaaaactgtttgtttaagaatacaggatgtttaag

SEQ ID NO: 81372 - DNA, 1046 bp, Homo sapiens
gagggcaggctgttcccaggaagggagaatactgagtacccaggaagggcttggcgcgcgctcttctccgcccggggatttctggggacagatgttgtgctctgggtcttggggaggtgccagaggtcagagctgcttgaggcttctgccgcctgccggtttctgccccagctgtccccggccacagggggtgttgaaaaggccccagaccgaaaggacagaaaggggaagttagaggaatacgtcgggagccccacggaccgttagtgccccagcctcggtgtccaggcgctgcaagatcgccgcggccccagcagagggccttctccggcccttcatccgcccagggccccgctgctggagcgctcagcaagcggccagccgcaggcctgctgggtccccacccgtcccctggctctgtggccctggccaccatcctcggccttgacctgaatgcctggcccatggcagccgctcctaattactccccactctcaccgttaccaaggagtgtgggccacagggcactaccaataggatctgctagttctcaactgcagcgtttggaagctgagagaaaagctcagagggctggacaggtaccaggaaacagcaccttccacctgggccattgggggactcaaggaatcatttaaaacggtttccttaataattgtgtcaaagaaaatgacccactctcccaagcgcctgtgtccaaatgcaggctcaacttcaaaactgaatagcaatgaacccgaccatatttttcctttctcccgaagaacttgaatgagaatggagggtgtaatggtggggatgttgttttgccatggcatttaaatataaactgcttcatccttctgtggctccagacgtgatctcacccaggcttggtgtcgctttgagatgccctcaccttgtctaggccacctcctatctgaattggctccccccacacttgaagtctcttcccgtcttccccacttcctgaatcagtggtcacaccattcccggccagtcctataatgagaatccttactgccccc

SEQ ID NO: 81373 - DNA, 1049 bp, Homo sapiens
gttaaaatctttgccctctgaaaattctgggaacaggctgtgcccataaacccatcccataggcagtgatgggactaccacatttgttctgccaggttgtcctttgggacaacttttgggtgtctggataatgaacctgttcagataggccttgagactttcttggtagctctaaagtctcttctggctctccgtccattgatacctaaatttctagttgtgcagagcgtgaagaaatgagcaggggctgatgaggcttttaacaaatagttccggagaaaataatagaaggcaaactaaatccctgctcacaaaactacaggaatttgagggagttagaagtgattatttttaccgccatttctgcacttgcaaggttgatgtagggagaagtgtcacaatgatgtttttcatttaaagactactgtaaaatattaatgggaatggctattgtctttcaccccctttgcaagaggcttatgtaaaataggcaggctgtttctaattgttgaatttgtctcccaacttcagctgattagaaggagaaattaccaccttgaatataagcaggttgaaattgggagagctgccctcagctgattatataagctataaaatacagcacctaaagtcttatgtttactctgctaagaattcccttaatgaagatgaaaatttctaagcagcatggacccatatgtgtttattatgtaagattcaattatggtgatccaacctgtaaaataaacagtggggctgattaatctctttgttggcttttgggtcagagaattgtttaaagtagatccacagagccacctagagctgtccccctggaactcagctggctgtgctgtcagcaccagctccccttctctccaggggtacaggaggcttgtcctgggtctgtggtcactgtagctttcagggtggtggagggcagggcccccttaaggttggctttcgaggttgctcgtgcagtgtagtgggatggccgtgagtacaaccactgccggttgtgacagacaccatcctttggccgtttcatt

SEQ ID NO: 81374 - DNA, 1032 bp, Homo sapiens
tcctgtatcaagagacagaggacatctgaagccagaatgcccttcccaaagctgccctagctcctgtgtttcaggaagaagccgggcagatgcctctttgttccagcagccaaactccagcatgtcacaaatcatacattacaggaaaagggagccctttgctgctgggcagcggggcccaagatcctcacagtcttttagggatgcttagaattggcccttggttggtttgtagcatttatacaatatcaacccttaaactgatggcccttgaacaagtgcatcattctctgtccttgatttcattcacagtagacagttttaggtagatccctgctgtgagcagacacatacatgcggtctgacaattcagatcccttcgccttcccctcccctatttttatggctgctaacaaatcggctggacctttctctaaaggcctctctgggcgggtgatatttgagtagatttgaaagaagtgtgagatcaaattatataactatttggagcaagaatgtttcaggcagagggactaggaagtgcaaaggccctggggttgaaatatgcttgatgtggtcggggagtggaaagaccagtgtgtctctagcagagagggtgagagggaggcaggggaagatgaaagcagagaggtgggtggaagaccagacccggcaggcccctgtgagccacagggaggcagagttggtcccttttaaatattggggctggcaaatctgactagtccatttccctagtactcctgcttacctctgcatttttgcctttgattgttccctttcttgagtgtgtcctgcgcttccccttggtctcccttagttgtgcaatggaaagtagtagcagagcacaaaaatccacattggaagcttagaggattgtatctttttctcaccagctaactcttactaattagaaattgacaacagcgcttgtctctcatgcttctcttttaattgagatttccttcaagtcctccttttaggcaagagctgcctcctatgagcccctggccc

SEQ ID NO: 81375 - DNA, 1011 bp, Homo sapiens
gtctgcataactgtagggtggatctggtcttgctctcttataagaaaagagacaggccttgttctctacatgttcctttaggcagtttgcccaggcaaatcaaccaggccattaaggtgaaagtatgatagctgaattttgctctttttccataggttgtttgaatgatttcattttgcatcattcataactgttgtcattctgtgatgtctagttcataaataccattcgccctgagcgattttctgttacatttaagactaacctactttaagggaaagatagtctttcctagtctagtccgcgtatcctagactgagttatgcagtctgggaagcttgcagcattaatttcttgctagaaacaaaatttgtttacatgtccaatattctgcatatagttgtgtattttactcatttatgactataaatatagaggcatatcagcatgtatattgtgtaaatatgtacacatttaacatgtggaatatagtaggactgagtttgtgttttgccttgtgggcactctcagtagttatttcccctcaatattttattattgaaaaaattaagcataaaacttgaattatatagttaatacacgtatacccactgtcatgattctgcaattaacattttgctatatttgctgtataattgttcatctctccatcaccatactcatccattttcatcttcttgctgtggtggtggttgtatttttaagtaagttgcctggtccctaatcatgactatgtgctcagcttgcaggaaacatatattatatcctgggtcttcctgagcctttcctgaacctctctcttacagagaccttgatacctactcatgactgccagagccctcccagtggcctcacccagagctctatcccctatgcctggcattgacaattctgattcttactgtgcatttcaaagcaaggatgttcgagatgttgtatctatcattttacttcctcccatgaagagacttaactggaattctgagaaaa

SEQ ID NO: 81376 - DNA, 1037 bp, Homo sapiens
taaagacagggtttcgtcatgttgtccaggctgctctcgaactcctgacctcaagtgctccgcctgcctcggcctcccagagtgctggaattacaggcatgagccactgcgcccggccaagatttctccagttttatatgtgctcatttgtgtgtctgtgtatagttctgtgcaattgtatcaaatgtggatgatgcagttttaagaatgcagattgggatcaagatgaaaccagataattttgagttgtgtgtgttaggcagacacacgcgcgtgcacgcacacacacacacggcacagagacaggctggcagattctcctgaggatggatgttctggagagaatgggagctggccagcggaaaggggttctttgagaagggaggctttgctgtttgcctgaatacacagaacaagtgctctaactcaggaggcacacgtattagacacaaaaatgtgtcacgttttctttgtttatcacttatcctgaaccccagtgcagccctctgtgtttccgttaataatgcaaagagaataattctcagatttcatctgccaagtgtttgattagtacgaagggcccccgaatactggccagcaaccaaagagaaccaaatttcctttcagagccctgggagcaaagagttatttgcctctgatgagtttttattttaacttgacattgggtaaaatgtgttttaactctccaaagaacgtggattgggtatggatcaaatatactgtgactgaagttcatctgaaaaaataattaaaaagccatctctcgtgggagcaagcattgctcattatattcttgcaacttcattgatattgaagtttccttcgttaatttctttttctaaaataaatggcactataaaagtggtcagtttgttttggccatattccattccctctccccagctgctggtcgcatgccattttcagtgtgtttgtagcagcctgctaggaaacagcctgtggctcttacctggtgcttccatattgcctgggctgataggtgtttctcattcatt

SEQ ID NO: 81377 - DNA, 1696 bp, Homo sapiens
tagattctaaaattgcgtatggacactggaaccttttgaaacctggtggtgtctattattagatctaaatcatttcgccaaccctggcctcaggctgtacatttgtatcatggggcaaagagccttctcttcatcaaggtagatctaccatattgattgaagaacatgttaatacctgtgattctggtgacaagacaaggtaaaaaggctattaggcagtacatagaggaaaatgtctcccacattggtgcttttattttatttttaaatatcagccttgttactggttgtgtgtttaatactaggattcattactatcataaagagagtttaacagctgtctgcttatttagacaagtgcgttaagcacaggtgagtttgaatagtgaccataataccgctgaatacactagctcccatttatggggtcgcagctgttatgacatacagacaaccagtattttgcatatactctctcactccctcctcataaagcccaaggagatagaggctgttattctttctgtgtaggtaaaggagctaaagttcatggggcttaagcagcttgttcagggtcatatggttagtgagtggcacggcccaagctacagtccggtctggtctccgttatcccaagggccttatctttcccatcgtatgctacccctccaccatccccaggcatgattacatccacaccaggataatataggaccccaagaatgtcacactaagtatgaaaagtgactcaacccaactacctaaataggtatacagctctttctcagtatagtacccacctgcggtgctttgtcattttagctgtaaagtatgaaatggtgaggcgtttctaggccaggagacgtctgatgggtctggggtattcagggcctagttctgtgggaattttaaaaactctcatcagataaagcattgctcccacaaaaaaatcatgtgagttgttttcaaaatctccttgtagtaaagtgagagaagctcactcaccagacggttttgtttacacttcaggcctggcagcatttaattggtatacattcactgcacttatgcaacttggacttgagtgtttcactcccagacttgatgaagctgacttgcttttctgagcgagtcaggagtgattttaaaacatactagacgccagcggggacaaaaatggtaagaaggtagggcaagaaagacttcatggatcatggatgaatacatgagaaagaacaagaagtagagataatgtaatccccaagacctttcctcatggggaaataatcagcatgagcagttattgagctctgtggtgttctgaagaccctcaggagtggcgtgtccacatacatgaactgtgtttgcagaagaaggtggttacacgatggatggattgggagtggcaaaggcaggcctccttaaggcatcctcaaggatttgacgtccaagtaggtgaactctcttccaactctatgtcctgaagccacattttcccgaagtcattgagatagcgttttggtgaccttcagaaaaaatgacagtctcttactggtccatcttggggagtgaagagagggtctggagattaaattgggtgagggaccacgtgttccatgttggagcattggtgcaaagttgggagactcagctcctccagcttatgatgacaggttcatatttccagtcttttttt

SEQ ID NO: 81378 - DNA, 1130 bp, Homo sapiens
ttctgcctccctttctctcctaaaagcatctcccttgaccttctgtccttgtaattaattcaggtctccacagagcacactgaaaacctcaggtctagtctcatttccattttatagaaattgatggtaaaagacacatagcataaaacgtagcatcttacccatttgtaagtgtgcagcctagtagtgttaaggacactcccagtgttgtgcaatctccagaatgtttcgtgttgcaaaaccgaaactgcactcattaaacaactccccattccccctcccctcagcccttggcaaccaccagtgtgcttccttctgtctctgtgagtcttgctatcctagttacctcctggaagtggaaccctacagtatctgtccttttgtgactggtttacttcacttagtatcatgtcctcaaggttcatccaagttgtagcctgtgtcagaatttccttcctttttaaggcagaatcatatttcattgtaggtgtaaaccatattttgtttatccattcatctgctatggacactaggattgcttgcacctatggctgctgtgaattaatgctgctatgaaccataggtgtgcaaaatgtcttttgagttcctgcttttaattctcttgcttacacccagaaatggaaatgctggattatatggtaattccatgtttaatttttcgaggaaccgccatactgtttttcatacccagtgcataattttcatgtctcattgttgataaaatagaggtgactaggaggctccaggaagaagccagagccccagaggacacagaatggcctgggaatgtattccctccatctgtgctaggtcatgatttgggcatcgctggcttcctctccccagaggccagctcttgctggattccaatgacctggttccctctttgtgcctcttcagggctaccctctggtgactgcctcccatgttgcttgtcttgggtgccttagcatccctcggtgggtcccttggctctgccttcacttctgtcaatagacctccattagctgctcttcattggaaacttttgagcgtgccatttgctacctgcacatcttgtctgatataattactagcaggatgaccttgggcacattgcacaacctcac

SEQ ID NO: 81379 - DNA, 1081 bp, Homo sapiens
aagcagctgcagcgtggggctcagagtggctttggcttctgtgcttacttagcaagtgatccgtcacaagtcctgccagctccctttggaactctgtcaccccgctcagccatggacaagcagacagccacggatattatgacaatgcaagtcctggagggtttgcatctctgatatggaggagtcagagtaatccttcccactctcccccgagatgcttttcaaagaggagcctgctttgagttctgaacatctgagtctttcacgaaggaatgtggagaaatcgagggggcttttcttccctgcagaactgatgatggccatccagagggggaaaggcacgagcaggctccctctctctctctttctctccccctctttttttgggtgcaacagaaaccttgcacttcccttaagctttctgtagtacatgttaagattcctctgccacgcccaaatttcaacttttctccaatattctctttaacttagaatgaggactcaggccctaattgaattgtctttgaacagtttttgttctgagctatgaactgtatattccctttattcacccaacagatatttattaaatatttttggttgggcatggtggctcatgcctgtaatcccagcactttgggaggccgaggcaggcgatcacgaggtcaggagttcgagacaccctgaccaacatggtgaaaccctgtctctactaaaaatacaaaaattagctgggcatggtggcgtgtgcctgtaatctcagctacttgggaggctgaggcaggagaatcacttgaacctgggaggctgaggttgcagtgaacctagattataccattgcacttcaacctgggagacagagtgagactccatctcaaaaaaaaaaaaaaaattacgtggctggcactggattctgtactgggaatgtgatgaacaaaggagataaggaccctggcctcgtttacattctaatagggaagacagccaaaagtgaatgaataagtgaatacgtaaacagacacaatagcggcaagttgtaatgagtgctgtgaaggggaaacaccgaaggcagcaaggacag

SEQ ID NO: 81380 - DNA, 1047 bp, Homo sapiens
tgataaatgcctgttctcatcacatcctttgccgtttttaaattattagttttttaactgttgagttgtaagaggtctttgtattttctggatactaggccagatctgtcatttgcaaatgttttctgtcatcctgtgggttgccttaagtatacattcaaactagtacctttcactagaatattatgctcttggtcagccacaaagggtagtgctctgaaactctaccaaagaacagttgtatctttgcatcaccagcacctgggtgagcacctggcataaagtaggaaccggtgatttgagtaaataaatgaatgtttctgtttgccaccttttgagagtaaaaatgggtgtggtaagatagacagaaatggataatgaattgctgagccaaaccacagaggcaaagatgcaggattgcatgctaaagcaccttgtatctggctatgatgttcaagatcaatgaaagactggagtgcagatcagggattgcacctgtgtttctgatgcagtaaatatacttttccgaaatcaatagggtgactctgcagagccctgtaaacatggtgtaattactgtgctgagaattacagttgtcacatatcgattctgtcttctcagcaggtattcgtacatttcctcctgcccctagtgccactctgccccatctccaaaatctaattcccattgaccgcatcacactgctgtgtccaggagggaagaggggatgtaatgtagtgaggggacttcagctgtaccttcaccttggttgaggaagaggcagctgagtgagtcacagatttagggacaaggtggcacaaagttgctctgaaaattagatcaaagaatcccaagaagtagataggcatcaacctcagtggaagctgcctcgggaaataacctgctcaaagaaggatttctcattcttcagagtagactaggagggaggcttccttaatcctggaaacaaggcccaggtcatccctgcagaggaaacatctatatataaagtggctaacgtaagataaactgtcatcttagaaagca

SEQ ID NO: 81381 - DNA, 1026 bp, Homo sapiens
gcagtaatctttttttaagtgaaattttttcttaagtagatcatacatagagagaagcacataagtgcttcatctcagatcataagtgaacaacatgaattttcacaaaatttacacactcatatgaccaccacccagatcaagggatagaacattcccaaagcccccatcgtggctctccaagtcactcccaccctcttctttcccaaagtaacgcccaaagtaacctctcttttgatatctgttaccttttattacttttgcctgtgtttgagctttatgtgaatgaaatgatggcatctattctctggtgtctggctgcttttgcagtacattctctttgttggattgatccatgttgtcacatgtagttgtagtttattctgtttaagtgcagcactccattctgtgacagccccgtttcattattccttctactattgagggcatttgtgtagtgtccagtttgtggctatcatgaatagtgtctctgtgagcattactgtccctgggttttggtgaacatatgcccacatttatgtgggatgcgcacctaggagtggaattgctgagtcatgaggtatgttcattgttagtaatactgcccaaaagtgtcagtgtacgtttcctaatgagcacgggttgaggagcagttccacgctcaccaacacttggtattagtgtcgtctttttagctttagctgttctggtggatactgtcagcatggtccttacgtcagacaatggggtccctcaggccctgtgtcacagagggccctgcactagtgctcctcaggagtgtgccagttctggagggtggttgcttgcaaagggccacaggaccacttccagggcctgcttgtcctgcagaaggtggcctgaaggggtggccaagagatgcttctcatcagagacaggacggaaggaggaatgagtgcacggagctggttcctgtgggcttcctagtctacgtgtaggtgggggaggccttcgaggagcaggatggagccctgggttgggggaaga

SEQ ID NO: 81382 - DNA, 1021 bp, Homo sapiens
acctcctctttaggctcttgtcttctctatcttccctgttccatcttctttctgtaccttatatggactcctgctgcagcccttaacgtactgtattataatctgtaacatacatagtccccttcctatcgtgtgagcaactctggggcatcagccttaccttctgcagttttgtggcccccgtttccagcccacatgtgagcagatacttatggattgtatgtccgtagtaaatatggattgcgtgattgaatgatttagtaaaaaacattccagatctctcagtctataaaaatgaataggatgcaatcacaaccaataacaagaacatagagggctcaaataactgatatttggaaaagagttgcagagtcatggtacaaataagaccataatgagaagtcctgagctttccattacctcgttgctctgcatcacaggcaagtccacatttggctctacttagattaatcatttcgtggaagaaccaaagtattatttagctactaataaaaagcaatttgctgataccaactcagggacatgaatatcacaaaatagttatccataagcatctgtcatctccattatattttagtcacagtgatagattatcaaatgaattagaggacagaattagtctgaatcctcagttctaacataatcacttggggaaatatttgccaagagagtagaaagattatgagaatgaaaacttcttccatttgccttgaaaagattagctgtagaatcctaatcatctagaatatttcaaaatccactgtcagatgacccatgagctcagtccatgtagtgtattttcaaatgcattgcttaccacttctatccttcgcataccatagatttttaaaatgatggcgggagggcggaagagatggtgctttaagatgagggaaatgggcagtttttttctttggaggcagtcactgaatagtgggactatttacaatgtagggcacggaaaggcagcatttattttgaagaaatgtcagagctagag

SEQ ID NO: 81383 - DNA, 1012 bp, Homo sapiens
agcttctcaggactgtcagtcatacctgtttaactcctgtctaatgttctcagtgacagctttagcatcttggaagatacataccattagtgctctccaggagccaagggtcccaactctggtgagttaaggcaatggcacaattataatcctgggttgaactgtcaacattattggaaaggtcatcctagggctattgcagtggcatttccccatatctgaactctctggcatggatctgttgtgaaaaaagctgccaagtatgatgattttgagaaacaagagtctaaggaaccttgaagggaatccagggccccttataaagatggtcatttcttaagtcattaggtacaacctttctggcgtgtgtctagactcactggcttcagtaagcagcctccacttggtttcagccagtcttatctcctaagtacagcactgattgggagaagaggaagcagaaattctgcctttgtgcaagaaggagcttgcccacaattgtctctggatgcatactagtctttgtacgaattgcattagtacaaacatttcaaccaacacataaaatttcagttgtctttgttttgagccttccgaattcagaggaagtatttcatgctgatatatttagatgaaagagaaagttacagagcacttttggtttgaagttaccactccagacaccttaaatgaagatgaaatttgagaactaatttatagagataatgacttagagtagaaattgagagcaaatacttccttccttggaaatggctcagaaagtagatagtaaaacaaaggagagccaaatggaacttggttgggatgacatgggcatttcctcttttcatccacacatccattcttcagataaatatttattgattttatcatgatattccagacacttagaatgcaggcatagtgaagatccatttttgtttttaatttaatagacttggtccatggtagccagcctgcaagactagctcccagtaatcctcatttcctg

SEQ ID NO: 81384 - DNA, 1121 bp, Homo sapiens
cccccttcccatcagaggatgtctcatcagtggacatcttgttagtgaatacctcgttattccttcatcagaccttctgtcattttctcagctgcgttgatgagaaatcccagacttcatgggaaaggtcaggagttggcaaatgagagctagacaagattcagtagtgacatgcagtggttgtcctgtgggatgaagggctttcgtgagtgatacagtaggtatacacaacagttagttccccatggaattcatggatacggggccaggattacatgcaccaccagccagaagatgacaccaggtcagcctggccaggctgtgggtcggatcacagcccttggcagtaggtttgaatgaggtggcactggagtaggcattgcctggcagtgctccccatcagcactgcgcagctggggacctgctgcagaagggccatgctcacactgctcagcagctgtagctgtcagcctctatcatggattctgataatcgtccagattaactgaaatgtgcaaaataggttggtgccttatggtatgtggtacgtggaccgtctcaggcactggttataggggcagattcctggatcccacccagaccttctgggagaggctctctggggtagggcttcgtaagtatcagctttaacatgctccagtctgtgctaaatcacaggaaaggtggagagccatgctggactagctgggagtctggtttttggagctgacagacctggacaggttctaggctgtgccacctgctagctgtgtgattgtggcatgcagccctgctcagcctctgcatcctcctatacggtgaagaccatgacgatggtgtccgtctcatggaactgttaggattaagtgagataatgtatgcagggcatcatagcacagcatatggcctaacacaggcagctaagagtatagctggttaggcagtgatgacaatgatgatgactatccgtggagaggggagtggttttagtaattctgctccacgcagcattagaagagtagatgcttgagtagtgttgaagagatgatgaattattggccattttattgacaaacagaacaccaaaaaccaaagatactcactccctggattagatgtca

SEQ ID NO: 81385 - DNA, 1051 bp, Homo sapiens
ggcttacctgggtcaccctatgtaaaatgcaagaatcccccacttccttgacagttattctctctctcattccttgctttttaacccccttggcgccatcagtgcctgccctgtgatgtatttatattgttatttactgactcaccttctcaaaggaatgttagctgtgctagggcaagggctcagctttgccaagggcagcatcgctggctcctagcgtggtgcttggcctgcagtcacagcccaggacctgaccattgaatgggtgagtaacggcagtggctagcagccctctagtgatgtgaacagagcgagttatacgcaagaggttgtgaacatcagggaacctctcaatttgctgtgttatttggaatggctcagcctggcagctgtccccagggtcacagactgctgcttctgagtaaacttgtcacagctgaaggtgagagccagcgaatcaccagcacatgagcggggactgaagcctcagaggagaaggagggtggtgcaaagacagcccagagaggaagagacagaaggcggagccctgcagagcctcgggcagcaatgcaagcaacccactgtcactgaggttgcctttatgtaataatcagtgccgtttattgcatgagtgcatcttctgctgtccttgttgcctcttacaaagaccattgtattttcatcttctcagttacaagcctttgagattggagcagcttgcacgtgagcaaacagctcgccattaggaatcagtctggataagagcaggaaagggctcagctttcttgggcttttcttgccgtgaaatgagcaaattgaaagtgaaggttttcaaggtcccttcccagcccacagttctgggaatttagtcaccttgaagccaagggagcatgtgtgtcactcatttcatgactcagaatagcaggcacttcagaaatacataaagccagacccagaggtggtgttggccttgtggaaagtgtccccttcccatcgctgaccacattgctctagaaattgttttccttggagttgatgtagactgtgatga

SEQ ID NO: 81386 - DNA, 1121 bp, Homo sapiens
gaggagcagaatgaatgggggcgccatggcagatcacgtggagtcctggtgaccattgggctgatcttggcttttatgcagaaggacctgggaagccattgcagggtgctgagcagagaagcgacatggtctgacaactcctgggtgctctgtggagagtggactgtggaggagtgaggaggaaagtgggggctgtatgcagggatccaggagagggatcctggagacttggggccggggatagcacagatgcctcctaaaggaagcactgacagaatgttcagatggattcgatgtagagaaggggaagaggccagaagtccagcatgacctgagtaactggctaggtgaggctgccaatggatggggatggctcagagagagcaggctggggtggggtgtttggatgcgctatgctggagatactgctggaacatccaagtggagacgatgagtgtgcctggaagtcgggggaatgtgagtttatgagtcatcggggtagagatggtacttaacactgcgaggctgggcgagatggtttggggcatggatgtaagaaaaagggagcctgcagcaactcccttgctgagcaatcagaagaggaagacctggcccagagaccaggggaagcatccagggtgggcaggaccaggtggaagccctgcagccacaggaagaaagtatttccaggaggaagcaggaccaactgggttcccaaagtagaggatggatcaggtcaggtgacagcgaccattggattcacccactttcacgcctgggaaggcctcgttcccatgtcccctccagtggtggcatgtggctatgggaactgtcattgagacgttggctggccctttggccagtgaaaataacgcttccatgtatcaattctgtccctgcgttagtactgatagctctaactgtcattcgctgatttcctgtttaatctgtcaagtgatctacgtctaccccctcatttcattctcaccatggcactgtaaggttaccacattttgcatctgagggaactgaggtttggaaagattcaatggcttgtccaaggtcatagttaaagaggcagggcaggatggagaatccaggacaatgaagctcccaggtac

SEQ ID NO: 81387 - DNA, 1064 bp, Homo sapiens
atctctatcttctgtccactgtgctagtcctggccactatcactaccaccaaccatatcatgtgtccactctgtaagccattactcactcagcaaccagaatcatcttttaggtcacgtccctgcttaaaatgttttggtggcttcctgttccacataggatagaaccctgactgcttatcacaactgggagagcctgccttcctcttcagcctgtgtcttgctatgctgttacggctcgggatgatgtagcctcctggcccctcttgctattcctcacatccatcaaactcactcccacttaagactttcacgcatgcttttccctccacaggtgacactcagccttcagacatagtcttcttgtctctcaggccccagcccaaatccaccttcttagagcagacttctctgacccatccaaagttgccttctgccccacgtcactctgtcacatacacctgttgtgttttctccatagtattattacctacaattttcttgtgtttttctcttactatgatagaggtgcaaataatcaggggaattaagtaaggcatatagtatgctcagggtccacagtgaggtgaaggcttcagggcagtggtaacatttgagctggaacttgaaacaggtgtgatttgccaggtcaagaggtggatggagagatttcatcagaggcaacagcatgtgtgagggcccagaggctagggaatgtgtcacccttagggaacagctttgggacagcatccctgtagcctggactgcataggaaggcagagcaagagtggctgggggcatttagacttcatcttgtgggcagttggaatcatcagtgcacagggagggattcactagacctcatggatttgctcaatggaaccaaatagggtttgaaagtgtaattgaggggttttttgatttggaatatttttattccaattttattaggagccaagcctggagagggagggagagtgtgctaagaccaggagcttcagtttggagtacgaatcaaggaggggctttggagcatgagagcttgtcttctgatcccatcgtgaa

SEQ ID NO: 81388 - DNA, 1038 bp, Homo sapiens
tcgtaataaagtgagaacaatgtctttaggagaaagaggcaccgaaggacttcagggagaaaaaccccaaagataaaaagggaagggatggtttcagaggaggggacattggaggaggctactgaccggtgagtaggacctgtccagctggagggaggtgtatgaaaagacaggttgtatgggggaagctgaacaccacaaactgaaaggaggtagagctgaagacacgtggcacctagaactgatcttctagttgacagagtagcatgagaaagggtcatttgctatgttacagaaacccttctgactgcagtgttgaagaaaacgaaggacataaggggccatcctgggaggccaggtaggacctactgctcgggtccaagcaagagatgggggcggggcctccacagggcaggtgccaaggactcctggaaggtgggatcagcaccaatggatgacccgtcacttagcatcaggttttcagggagagagcgtggaaagctgtgggctgacagccaattgtaaaatccacgctaagcaggaaaaagcaacccacctcctcccaaaaatgtgtcaggaacatggaaagaggtgggaggcatttagttaggaggaaaatggcaaagcaaactgggtaggaaagaagctgaattggtgtcagagtgtttcaggtctggaagaagtctttcctgataaatggtttttaagcctctcttgacatacttctggtgatggggagctcactacccatgcagacatcctatttcattgacactgcaagtaccttgaaccaccatcttttcctttggttccatatatacagcttcctttgaatttttactttcagttgcacaatgagacttcctacaaacccacttgatttagcaagaagacctgaatcagtcctctcatcctgctgatggaacatcttccactacagcaaggcaacagctaagaaaaagtcacagggaaggcgaacaacctgggcaaaaacttgggttttaagccactttagctgcctgaatcccctgccccatc

SEQ ID NO: 81389 - DNA, 1027 bp, Homo sapiens
aaaaaagagagagaactgctcttgcaggctttggggaagacagcatttcttcaaaagacacagttactaaagaaatacaccaccatcatcaagctcccttgtaactaaggacttaacagagtgaaggtgctcaaaaccagagaggacactaaagtacacctggcccccccccttgtcctcccttctggacacacctgattatcctctaaaacttatgatgatgtggagaaatttttttttttttttttgagaccagtctcagtctgtcacgcaggatggagtgcaatagtgtgatcttggctcactgcaatctctgcctcccaggttcaagcgattctcctgcctcagcctcccgggtacatgtacagaattcttgccagtgggggttattattcactgaatcacagcttgaaaggttttctacaactctttctctagaggtggtgaacttaggacggattttcatttacccaaaagagttcctgaacacggaacaaaagccaaacagcagcaagggaaccagatttttggagcgcccaccctgtgagggctttctcaaatggcatcccattgattctttacaaaagctctgcctgaaggtatgatcgtgcccattgtataaacagtgaaactgagattcactcaagttgtgtgaatcacacagttcccaagtggcggaattagaatccaagatcagctgtctctggttcacaaatttgcatttcctcccagtcaccaaaactccagatgtgaactccctgtctgagttcacatcaaagcctaccacgatgacaactccgtgtctcttcctgctgacaagcatagtatctgctattactgcctcaggtgtccagcgaaatactgagtttgtttacaaaataagtctcccagccttctctatgtattagcaaccccagagaaggaagggctgcccgctttgcaaagatcaaaccccctgtgtgtttcaccctctgcacacttcaaaaccaggcttcttcaagccagttacgccaggagcttagcaaaa

SEQ ID NO: 81390 - DNA, 1031 bp, Homo sapiens
accgaagctggtccctaattggatatacttcctctccagaggagaccaggggcacttgtcatattgagttcaagtccctggtcaaactcatgcactggccaccctagcttgctgttctgtcttctgttctcagattccaggcttttaggaacagaatatccagacatttccatttttgtaatagtgactcaggtcaacaatcaggagttggtgattatcataaattttgaatttttgtcccgtaagatacaattgattacgttcttttgctatgagcaaatgaacaacatagtaagttttctggaagtttaactttctgtaggtggacacttaccatcccattcatgtttttcttaacgttaaccttatagaagattctcacactaaccttatagaagattgctctcatggagacatgtttggcaagaccatttgattttataatctaaggccataaaatgaattggaagcatagaatttacaaaatgttctacagaaggatcccaactgaacacagatggtgctcccatccagcactgtaagggagggaaggggccaggaagctcatgtttttattaagcacctgctacccacgtgccgggttctgtgaattcatgatcccaggtactgctcccagcagccttctcacaccagccctacgaggtaagtatatattcttttccacttcacaggtctgaaaactaaagctcagcaaatccaaccgttctaagatcacatagctagtttataaagccaccaggagccagtgacagatctgactcctaaaccagtgctctttccactacaacacaaagcccccgaagttagaacacggaactagcttcttatgaagcctctgcaaagccaacagagcgtctacctgtgggaaacccctagcaggagtctattgtttcatagagaagtgagccaggagttggaggtgagaatctctgcaaagttttgcctatgggcacaggaatctaggtttcactttaataattaaatgttggaaacctttcaaaacactcctc

SEQ ID NO: 81391 - DNA, 1049 bp, Homo sapiens
atggtctcaaactcttccaaactctaagcgggcattataactatttagcatttattagtgttaacatttgtttggaaagactatctttatgacctagtagtgttgcatgcttttgtgttacaaatattccttagggtacattgaaatcccagatataactgaggcatagagtaaatgtttactaacagggagataattttggcaattctatatagggatctataactgtgtatctgcctctatgtcaacatgttataatatggtaatagctatgatttattcacttccaaatccttgggcagtaacagaaccctccgttatatccttgatccaatggagaaaatgcagtccatcttggaggtttctggaaattcactgagatgacaagagggcactgcattgctcttaaggtctgaaagcagttcagtaaatttccctaaagtggccctgggaaaagccatggcctcaagctatctgacatcactgggaggtagattgggctcatcacagcaatccctgtgagcatctaagttactcacacactgagtcagagaaatgcgtgtgactttcccaatatagcagagcatgggccggagagagatcaggaaggccagcttgagcttctagttttcttcccaagggaaaagactgggagtcttagaggaggaaaggctctagaggtggttatcatacccctctaaatccccataagatctttagccaaactctctcaattttactggagggacccacgggctcaagtccatcagcttttggctgtatggggagagttcaggaatgcagaatcggtaacagttagatgccctggaggactttcttaaccgatgtccttctctttccctttttttggtctgtgtgaataatccacatttaggccagcaaggatacgtttgagaatactgcatttatgttgcagtttttaaggtataagggacttcatccggcatgaggaccacttacattttctaatgttgtctttctacctttccaactggattgctagcttcctggctctcgtgtattttata

SEQ ID NO: 81392 - DNA, 1033 bp, Homo sapiens
ttctcctgcctcagcctcccgagtagctggtattacaggcacccgccaccatgcctggctaatttttgtacttttagtagagatggagtttcaccatgttggccagtctggtctcgaactcctgacctcaggtgatctacctgcctcggcctcccaaagtgttgggattacaggcgtgagccaccgttcccggccagctctgagtttcaactttgcccaaggatgctgtgtgtgcccatcactgtgccagactcaggaaaatatttatccaacagatgtttattgaatgccttgtgtgcccagttccatggacaccatgatgggcaagacagctacgcctcacaatcccctagtggaagttacactcaagattaaaggccaagaaacaatcagaagattttagcttacaacttggtcgaattggatctaaaacttgggagtgtgcatgaattgatcagggcctattttaccaaagccccacccaatttctgacttagaatttgaattcactccttggctaccaggcaggactctctaggtgctttgcagagaacttatctttctacattttgttttcttagtcagctccagctcaatgagagcaagagagtcagaaatggaactttggaaaataatcactaaggaaaagagatgtgtgtctcagaaaactcccctcaaagaaagccctgcccctcaattcatgatgtataacttttcaggcaggacaggacctctgagaccaccacattaaaagcctcattttataaaaaaaagagaatcaaaagcttcagaaaagtaaatctcagttttatccctccagataatacacatgtaattcactttcttctttcactttttaaaattccttaatccttgaaaaagttacccccaaaagaggttccttctatctttccttccttccaacagatcacagggtcccactgttcattactttccagaaacagccatccttttacagagccatcgctttctcccaggggccgacacgcgcagatcatctgtaatcctccct

SEQ ID NO: 81393 - DNA, 1113 bp, Homo sapiens
ctaccatagatagaataccaatatcccttgccctaaatagaaggtaatagcaaaaataaatacaattaaattcttggcttccagcctgcttggagactttctttatctggaagagcagattggttttaaaaggctcccctagacttgccttccatcacccctagaggccttccctctccattcccctgctttttataactgagagtgcagtttggaactggaccgcaggctgggcaggccaccagatccactcaggaacccccagaactctagggaactgtgactgcatacgccaactgtgaagtggggccctgtgctgtgtgaaagatcgcatcccagccaagctcattggagggcttaatgacacagctgatgagcgctttgctgtccagtttctctagaaatttccttcaagtgctccagcaccgggtcaagcctgtttctggacacactgtatcctccttggacttatgtaataaatcacttcaaccctcggttaagatctctgctctcctcatcttatgcctcaggcctcatttgggaggacaaaggaagagaaatatgctaatggctaaaggctaaacccctggcaccttggaaaacagccagctagatcgccacacagtttaagttctttttctgtttcctaagcagtcactctatctgagtctcagtttacttgtccgtaaaatgggtgttgcaggggttttataataaatgtgtgaaacaatgtataaaaagctcctggcatacactcaggaatccaaccagtggctgtaataagaatcattattcatttttctttgtagtgtttttttttttcttttcttttttttttttttgagacagggtttcattcttgatgcccaggctggagtgtaatggtgacatcttgactcactgcaacctccgcctcccaggttcaagtgatcctcctgcttcagcctcctgagtagctgagattacaggcgcacaccaccacgcccagctaatttttgtatttttgtagagatgggtttcgccatgttgcccagactggtctcgaactcctgggctcaagtgatctactcacctctgcctcccaaagtgctgggattacaggcatgagccact

SEQ ID NO: 81394 - DNA, 1050 bp, Homo sapiens
ggcaaggaatttaggggtgtagcagcaaatggatttgctatttccagtgaggctgaactccactgcacaggaaaactccttgagacagctctccagttttgttgctctagagcaagtgaagacctgtaggtccattgagtccactttttataaatgcgaaaactgaggcccaaagacgttagggcctgcccttagggcaatggcctggtggtggcaaatccacaaccaaagcccagaccccgaaactctcacctccagacacattcctcgtcattacacaactcgctcccccaccagatcacaaactccatgagcaccttccctatgctgtactcatcttttcagtcgccagcactcagcacagggcttgtaagcacctgtaaaatggatcggatgcactttgctcacacacagctttgcaatgactgcacaaagctcatggtaaccatcacagaaaccaggtaccaggaaaccgtcctgacgcctttttccaggggcactgtgagtgccttataaggctgctgtttttgcacctaatcaggagcagattggcttttccagcagggtggctcgtggcacacagtctgtgctggtgatgctgcaatgctgcatttgagaaatagttactgagcatgtaccaggtgtcatgcactcgctatacagaaatgaacaggaaagaaatgggcccttccctcatgaagaatcatcgagcggaaaatgaaaaaagcagaacaaaagtaaatagaccacctagtccagacagaacaaccctctccggcagctaatctctgcctatttccaagacagaaaataaaaacaacactacacaatgggactctgatgaagaccacaaatcccaaagtcaacacattttactttattttatctcaattgatctcaactcccaaatgcgtgagcttcaaaaggtaagattaggtaccattaagccagccagaccagcattgatttgaaaaccctcctccctaatacaagactgaggaggttgcaggccctcattaatctccttgttatcagcttgatctcagcctg

SEQ ID NO: 81395 - DNA, 1014 bp, Homo sapiens
ttaaaaattattaagccaccacttactggagcaactaggggataagagggcagcagaaccacccctctttcattttataggtacagccactgaggccctgagataggaagtgacttgtccacagtcacctcaatggtgggcagctggggaccaattcgtaagagaataacaggagagaagttaggctggaggttaggctagatctgaagccctctgggggagatggcagttgaagctcttagtgtagataaaatctctaaagtagaaaagaccccagaattaagcttgggtctttgctctgatttagagaattggaaacagaaaccaaggtagcaaaggccatgcagaagggcagtgagggaagtacgaggcaaccaagaggaagaagcaaggcaagacaggcaggtgctcccggtgggagggtccttacagacgagggcctcaggccaggttgtcggcagatccccagtggcatttgagagatacctccttccttggaattgtggggtgaagcgagattccaaagagaggtctctgataaaggggccagagagggcatactggccttgccggaggtgtgaaaaggaaggagaagtgggtgaggggtggaggcaggcaggagaataatattttaaaaataaaagagtgcatctgtaaaaataactaaagaaatgagaggagggaaggaaggggggagaggttcaatgatagggtcacagtcaggtgaaaatgagaccaaatggcagaggtggggaggggaagaggagggatgaaggttcagaggagagatgaaggggtgagcagggcctggaaacatggtaaattttaaaggagggaagattgggatcctctaacccattaggctcttcttgcctttcaagttgtggcccatgcagacctctctgcctgatattcttcccacagccctttgcaaggctggttccccatcttccttcagagttctgacagatgccatctcttgaaacagcccttcctgtccactccccagtatcc

SEQ ID NO: 81396 - DNA, 1041 bp, Homo sapiens
acccctgccacgcctctcttcccctctcctccattgatttaattggtttgaggtacattctggacattggaggcgaagctccccaagtgattctgatgagcagtcatggttgagagcaggggctaactccaccagggcctcttgtttcaatctcttgggacagctggcaatgctccactgaaacacagcctgcccgccgctctggccccagagtgcctgctggggcatgttacctgatgacgaagctgtgggcgtcaatctcctgcccacagccgctgttcagcaagacccccgagttgcccacgatggcacaagtcccaaagtgcttattcttcagtggcgaagtcctggggaggagctcgtagaggttctgggacacattcatggtgctgtctcgatcgaagatgtaatgaataatatctccaggcttcagggttccctttaggacagaaatgtccttttcagcatccaagaactttaaaatctgcttcctgtgaaaaccaaacatgcgtgaggaaattctccagggtgccagctgccctttgccagcccagcttttcctatccagggtcgccctgcacggtggctgcagcccagcaaacacgcagagtatgatgagagttcagatgccctcgagaacaggttccagccagggatggccagaagtggcccagaagcaactacggtggtggccaatatgggggttgccagggttacaccctcttcctttgctaggtgaaaactgccctgtggaatcactccattagggctggagtgagctcctcacagcgggccccagaaggaagggtggcccaccaccccagtttccccaggactgcctggctcgggcactgaaagccccatgtccctgaaagccccacagtctggggcacacccagacatttggtgagcttacattaccctcactgtcttagggggatttagggccatcctctgacggggatgaaaatgaatggctaggtataaaatctaagtttctctgctactcccacacttcctagattttgaaaaaaggataat

SEQ ID NO: 81397 - DNA, 1021 bp, Homo sapiens
agtgaacaccaggtaaggtcccaccaaggcaagggctaatgaacatgctccctaacttttcattggtgtcctattagacccagcaccctgcagagtccaatggccccacggagggagaggatcattggcagaattccattccaagcctccttttccccttcttctccccctgctaaaagaagaggctaatctcctgcagtatttcctcctggggtggtcctgcagctgaagatgttgcagtctcaggatgaacagcctgtttgtttaaagggcttattactggtgcttaatgctgttttgacagatgaaagtgagtcagttatagctggaaatagatctggctgcatcagtttcttccaggtggttgcccattccccattcaagggacattttctctccttaacaaagggcagtgtttctcctcttatccccaaggactccagaaccatctcaagagtttcctccttctaggaaggaacgatatttaatatttaaacagtccacgagatgagggttgccactgcagacctactctgacagggatgaagtgaaaacatggtcctgagagaccaacctctaggataaagtatgtagccccattgagccccgtgtccatatggggatcattctggctccatcagacacacatgtggctgctccttatcgaatgtctctctcgggctttcttgggggcaatgggttttccctgttgatacccatcttaatgagaccagtgttggtcacaggcttgggtgaccacagtcaccatgaggacaagaatcctttgtgggtggctcagagggcttcccagggtcacactgagttatgctaagtccccagtgaagagcatcctgatgcccctcagtcagtggggagtctgtacactgggctccctcacatccctggtgatctgccatgtggttggatgggcaattgggtatagggcctgaccccaagctgggaggtcaggagtgtggtaggatatacatttgtaacaggcatctcacacttcgtatgctca

SEQ ID NO: 81398 - DNA, 1035 bp, Homo sapiens
tgaggggatgctgaggagctctgacctttcagcttgttctccccgataaggtgctgccccaggctctgaacaactgcagtgtgtgcacgtgtagccttgatgcgttgctgcctgccgtggtcttctaacacctcttctccagtgtggcagctcctggcccactcagctcattgccatccctgtccctaaatgagtgcaaatttctgctgcacctggtgcaccacattagagcgagagaatgcagttcagttcctggttgtgccacttagatgctgggtggcctcatacaaatgacctaacttgtctgagcatcaagttcctcttttgcaaaatgaaggtaacaagatgaaggtaacaagttaacgtttgtccccttcaattccctaaactgtccgtcaagtccaagttgcccatgaaatgctttgtcaaggtagctgacttatgtccagatgtgaaatgattatactgatccctggtcactgccctaaaagtgaattctcatttgaaattcccaccagcaaagcagaagggttcctatttctccacatcctcaccaacacttgttattttctgtgtgtgtgtatgtgtgtttactaatagccatgctagagggtatgaagtgatatctcattgatatggtttggatctgtgtccccaccaaatctcatgttgaattttgtaacccctaatgttggaggtgggacctggtgggaggtgattagatcatcagggacagtttcttgtgaatgggttagcaccatgcggtggatactgtcctcatgataatgagtgagttctcataagatctggttgttgaaaagtgtgcagcacctccctctctctcttgctcctgccatgtgagacgcctcactctccctttgccttctgtcagaactggaagcttcctaaggtctccccagaagctgaagccgctatgattcctggcgagcctgcagaactgtcagccaattaaacctcttttctttataaattacccaatctcaggatttctttatagcagtgtgaaaacagact

SEQ ID NO: 81399 - DNA, 1060 bp, Homo sapiens
tgacaacaggtggctcgccattcatccatgagcccaaagatccctccaagccaggaggcagtttgtcatccaaagtcatgggactggcttcttttcatgtcaagtccttccacccccaaagatggattgagtctcaatctggttcaggtgggttctccacaccttcttcctgtggcctatctgcctaatgctagatgaacaccacacagttataaatactcaggtcaatatatatatgcaggtatagatatatatattctggtcactgttttacactttaacaaagaaaaccactagcctgcttgttctattgtttgtgccaccccgactcccatctgcctgtggtgtagctggcaggaaatgtgagccactgagtcccatggggtgcccaccctacgtggccccatcgcactggccgacagtcagtttcaaagccccctgctcatgtaggctcttgagggccttaaactccaagggcatggtatgcgggctggcctgggaggtgtagccatacttgaggctgtcataatagtggtacttgactgggttctggttctgatccagcggaaagggccagaagccgtagaggtagatttgtttgcagaaacgtgtggccagggtatacatcaagaggccggtggtgggtcttttgatgtggactttgttggtcagccagtatctggaaaaaaaaaaaaaaaaaaaaaaagaaaagaaacatgggtctgtgagtcatcctttccaggaagacaaaaattttatcctgcccagcagcctgccttctgccactccagggaccgatcaagctacacatccctggttccctccacagaggagtgacaagcacatgaagcaactgaactgctccttagcctggatgcggtcacagacacgagtttatgaaattctcaaaacaaacctgttgtgggtacagatgcagaaatggggctctgaggtgaaaaatggcttgcccaaggttacctgggtagaaaggggcagcacttgacttgaactcaggcccgtggacagctcaagcaggagctggcaacctttttctgtaagg

SEQ ID NO: 81400 - DNA, 1063 bp, Homo sapiens
ttttcctccttctttcccaatccctctcaaccatgtatttatttatatatgtatgtatttttttatttattatttatttattgaaacccctactttgattgacaaaggaatcaaggtagatctgaccagtattcccctctcttctccttgtcccaccacatggacatgccttacactggcgtcctctcctgagtccctccgcactctccatcagcaacctcacacctgccttcagacccggctgcaacttcctaagctgcccctgccccagctcctctctgcaacccagccctctcctgagctctaggctgggattacacccgctggagggacactcaccccatctgctcccacggcagcaccatcaactcaacaagtcagaagccaagtggatcatctgtgtccccttcccccacaatccctcctttttctagtaaaagacccgtgatcccgtcagccacccagtctgagatgctgacgttatcttcgactattcttccctgtcctgccttgctaattcttcccactagcactaatctcgactctttgtcacttggactatttcagcaacagtctcatctcccagattacctctgtgcacactgacacgtggtcccgtccatcctgaacatgcacagtgattttcctctcccgttgcacacaaacctttaaaagttccccggcccgtgaacaaatgtacaattctctattctgacattacagaccaccggataaggccccattcttcctttacaccctcccctggtcagcctaggagagttgtttttcctggaaagggtgcctgcgttttactgtctctgtgcctttggtcttgctatccccatcccctggaatgctcccttttcttcccttcaaagcccatgcggaaaccacgtccttcatgaagccctccctgatgtaccaaccactgggatctctccctctgctgaaccaccgtagcactttatttgtacctttctcatggcacttaccatattctgccttgtattatagttatttgtgcacttgtcctttgactgttcttagactgtaagcttgccaa

SEQ ID NO: 81401 - DNA, 1048 bp, Homo sapiens
tcctgcttgcgaatgttcccttcgcctccttcttccatgcaggttttaggtaaaggacaaagccttattttaaactctgagtctttatcttattttctacacaaaatcaatcaagataagggagcaaatatgaagagagacttcatcaagtaacagggatgtgtctcttccattatcagttgatggctactcagattggggttgagagaagcaatttcagtgttacatactatcaagatggttcctcatatctgagattttattttccttggagtcttgaatgcacttccttcggcactaacaccagctggaatggagtgcctgggggttggggcccaggaaattcctgtctttacccatctggactgccccaggaatgatttctttggaggctccccaggaagagtcaggggtcagccactctggggtctactcggtgtgtggggtcagagagaagaatcacaagcagacttgagctaggggaggttatggcagggtgagcccaagatggacaggcaaatgaagccgctatacctgaagcctgggcacagtgaagcccatggctgaggaaatgagagggagcagacttcgcgcccgggaagatgagagggccatcttggacgtagtcagaggagcttgtggttgctgggttgggctctgacttttgtgtgccttttattagtgaccttggattcccatgccagcctgccagtcatgacttaagggcatccagctccctctaatgcctactttttctgtaggcaaatttagttttacccaaatctactgttgggtagatttgatgagaaaagctattattttggaggaagcgtgtatattaggacaagtaatgaacatgtatttgtttagaaatgatttaggcggcttgtaaaggaatagtgttatttttatatgtgtgtgggcatagttctgttatgttggtagaattaaaagtgttaagtaaatcaagagagtgggtctcattctataaggactaggagaaagtgatgtgatgaagaggggagagccacttagcaaggccacgtgt

SEQ ID NO: 81402 - DNA, 1046 bp, Homo sapiens
tggagtccgacacatctcagatctacagacagtttttcaggctgaggcaccagggctgggagaactggggctgctgggaggccatgttgtgaatttcctctgagttgaatggtcatgagggggagacttggcctggagatgccttaaaagggactttgcccaagaaattcaactggaaagataatgagaccctagcagagagcatctctgaagggtcttcagagttcccagaagccaacaactggaattgttaagtggccagttagaggaggcatctgccatggctagaggcataggaggagaaggtggagctaggagagagaaaaattgagtcttcctttccttttccactctctcacaatcaggcatgaaagcagcaaagatttcaaggatggaaaacaatctaaattcattcatctattaatagtttgttcctttttattgctgagtaatattttattctattgctattttgcaatttgattattcatccttctgttgataatgatgtggatcgtttccagtttggggccattaggaataacactgctaagaatgttcatgtacaagtcattgtgagaacatatattttcatttctcttgattaaatacctaggaggagaactgatggctgacagagtaactgtatgttaacttattaatacaaggaacatgctgttttttttctgtattgtttcatttcagtacatatgctgacaaagtgagcactgcttggttatttttgactgtgtgctgctcattttctggaaaacttatttgtgagaagtcttttttgggctaggatgaaagtgtcttcctctggagaatgttcactttggcttttgcaaggggccttagcagcccaggatcactttcaactacatttagggctggaagtttattttggactatccgtgtgatgaacatctgggctgaaaatttacataaatgccagcttttggtcatgattgttccaagaggacttcttgatttttatcccctgctttgttgagtgccagagcacctgtccttgcagacccctgggt

SEQ ID NO: 81403 - DNA, 1049 bp, Homo sapiens
gtctgcctattcatccctccctcctctaacccctggcaacaactaatcatgttactctctctatatttttgccttctccagaatatcatacagttggaatcataccgtatgtagcctttttactttggcttctttcacttagtaatatacatttaagcctcctttactttcaaaagaacatatcaaacctactttatattctgtgtctgataactcagtagctcccatgttcgcagatttcattctgctgtctattttttgtctggctttggttcatgacttcctgttgattgtgagctcgtatttcatgcaactttatctgaagaaatgttttgagggctgtgttgaagatgacttccttcagatagggaagccattgtttgttgtcaggtgtctgggggaactaccaacccaagagtatttgaaactgtcacctggaggtttttaaaaatcaaccaggtagtttgaattcagtctatgcctgcatgagtatgactcgagattacacactctcgagggagatttttttctcctctactcaccagaaaggtttgacacagacaattttctttgaaattcttggagaagcaggattatttctagatcattttttttttttttttttgagacagagtcttgctctgttgcccaggctggagtgcagtggcgcaatctgggctcactgcaagctccgcctcccgggttcaagtaattctcctgcctcagcctcccgagtagctgggactacaggcgcccaccaccatgcccggctaattttttttttatatttttagtagagatggggtttcaccgtgttagctagggtggtctcgatttcctgacctcgtgatccacccgcctcggcctcccaaagtgttgggattacaggcgtgagccaccgtgcctggctctagatgacttttatgtggcgggtgtagcgtttagtgtcccagctttttgttgggggtctcctgtcacacttctcatttcaaaggggccctcaacttcgctttgctattaggaaatatgggaaggaaatcgggttgggc

SEQ ID NO: 81404 - DNA, 1072 bp, Homo sapiens
aacttggcttgaaaggagtacagaaagttgcagggccaacagcattagataccagcaagaggggtgtatccatgagcacttggaaggacagatgtctgagagacagacagaatgtagcatgaatcagggatgtttgtaggaacaaatgacttaggttgatagcaaggacttctcttcttttccctctgttttgccacccacccatcaggtaccttgcccaggagtcccatagaatgttgagtctacactgcccaaagccaaagctagggataccctcaaatggcgttgaacctgggctacctcagctgctagtatagttccatgtggttgtggaaacttcataaaaatgcctcttatgggtggtcaagtgccaagatgatgcatttccctgggctgattcagccctatgttcagtgtgtggcttaccatgaagggcacaggctgaatttcagctcctacagaagctctcagctgaacagggcttaacctgtgcagccaaatgtggaggccctgtttagactgaggttcaaaccctccaggtgactttagatcacctatagctgtgtagaaacaagcttttctcacccaataagagagagaaattcagtgatgtgttagcagtaccctgggctagacatcagaagattcacttctgggaaatgccatttgttctccatgtgaatcagcattgaaacttggaacctcagtttcctcatatgttaaatggaggagaagagctcctgcttttccttgcacagctgtagtttgggtcaaattcagagatatccaggaggctgtttcgggagtgatgactagggctgagccactaaagttcaagaagtcatggaaggaggtgagatgatggtgtgagtccttttttttttttaaggggtcttgctctgttgcccaggctggagtgcagtggcgtgatctcggctcactgcaacctccacctcccaggttcaagtgattctcctgccgcagcctcatttttcgtatttttaatagagatggggttttgctatgttggccaggctggtctcaaactcctaacctcaagtgatctgcctgc

SEQ ID NO: 81405 - DNA, 1518 bp, Homo sapiens
aataaaaataggtcaacactaggggagtccaaaagaaaaaaaatgcatttcaaaggggacacatatattattcaagctcgagaaacactaataactcctccacagctccacatcttgtttccccactaaggatgaccgcaaatactgcacaaagcatgggacgtatttcctggagtcctttggaggccaagctgaggagcttgtgaggcttctgcagcagctccaagaggcacccctgctttcaaaccagaagtagacatatgtttggtgaagtgagagccttctggaaagctgtgggtggacacagcaaaatgcatgcagagtctgggctctactttagtaatatgggccaaaactggggccaaaacaagtggaaaatgagtttctgctaccatgtggccattctctttttaggtgaagaaatcaatcgctcagaacaggttaaagaaactgacttaatagcgggtgaagctgatgttaaatctactggctagaatgtcagccctgaaattcctaaaaagaaaagtcctgttgaaacaactccctcgtaccacgcaaagcaatatgtcctgtaattcctggtggaaaccgctaggctcagcaagagattagggaaggcgagtgggtctaagcatttctgaagcttctttcctctgttggtgtttggtggtaaaggattctaaactctgaagattctgaatagtgtcctttggatttctgcagactgatcagcctgcgtcctttgtctcctcctgagttaacttgtggccagaggtcaacatggtgcaggagaagttagagtgcacactccccagtccctctgatcctctaaggcttgtctgccagtgagaatggaggatgtgtgttagaatcactgctacagactggacaggctggactactgctaagagttgctatttctgaatccttaaagggttggcatgacccagctgggtttcacttcagtcccttcagaagagtaggcacaagtgttccactcttccctgatcggggtgctgggagttttcttgggagcagagactgaagtttggcaggacaggggagcagagaggtgaggctgatgtttccctggtgcaggcactgtggggagagtttttcatggagtaccttcagtgttagcctcagagatttggggtctcctggactttatggtagtgaatttgcctttgacctgtccagagcactttccactgggaagttttgcatttggagctatctctgaaacctccatcatcccacaacatttgatttttgtcgttcagggagcgattttagggcaacctggttgatgcttccattagatgtggtatcagctagacttagttttcttctttctggtggtggtgggcacagcaggtaaactggggatgtgactgggaaaaggatacaggacttttacaggacttccaagcagcaaagttttcagtctcttctttggctccgtgtctgagttcccaacacattgtcctggtgtttctgcttggattctcaaacaat

SEQ ID NO: 81406 - DNA, 1062 bp, Homo sapiens
atgaatgacaaaacagaggatgctattttttttacctacaaaatcataaggaatagaaagcttgtaaatatatcccaattctactaacaaatcaaattgaaaccactcacagccaaggcacttactgccacttaaggatactatcccatagtcgcttctgctatttcagtggtttatagatttaattttcaggaaagcggaatatacacagcagtgccaggaatatcacattatttggcaggtatgcacaaaagaaaaggcagcttggttttggaatgacattatggcgtgatagttgggagtagataatgacttcctggaaaccagtctaaagaaagctataaatatcagtgaagcattgattcgtttaacatgtattcattaagcatctattatgtgatggaacctaggtacacctagtgaacaagacctcactcttccctgctgcagttgtcagtctagcaggggatccaggtaagtaaaccaaaataatgagaagagattatgaaagcagaggagggacaactaacccagacttgggatgggagggccgagaatgtttcctggtggaggtaacatttgagaaggaggaaaatgaatatgtcaggtacaaaagggttgggtggttgtgtgggtaaagaaagggctgaacaagacagaagtgctcctggaagggcctggagggagcaaggttcttctgaggagctgaaaagccaatatagtttgagcgagaactataaccatccatgtgtcctgaatccaatcacttctcatcacctgcagtcaccctaatgcaggccaccatcgtctctaacaggactagtgcagcatcctcctaacagcatctatgctttatcttattatcactgagacagacaaatgcagcccctgacagctgggagctggtctggcactgccagagggctgtggtgtctttacgacctggccgggtgctcacagctgggcctttggcattctttcatccaacataaaatgtcataaaaccccaacatcaagcaaggccactctgtgaccctgatggatgaaggcaaaaacaggacc

SEQ ID NO: 81407 - DNA, 1154 bp, Homo sapiens
gcctcattttggcgttacctgtgtcagagttcaaggtggatgtgcttagagctggtcagccccttccagacctggacacgtctgtggctccttttctttcttcctttttttttttttttaaaaaaaaaaaaggttcagcagaaatcagcgtggctagttcacaaagaatttccagtatcagggaaaaactgtgcgtgtgtgtgtgtgtgtgtgtgcacgtgtgtgcgtgtgcacgtgtgtgatacctataaaacagtttctccttctctgaagggaaaggaaagtgctaggcagcctgtgattagcaacattctttgtgcttttttgttgttcctctgctctgtcacagttctacgttgtttgccttagaaatgtaatttttaaaaaccattttaaaaatgaacggtgatttggctggctggaaaaaatcacactgtcaggggactatatttgaagtcagtctagacggggctggactaggaacccacctggacccaggagaccccacaggacccaggaggtccctgccggaaggcagaggttcaggtgagagtggctcacctctgagctggtgaagtgaggacttgcctgtgacatgacccagggatctgctgctggcttctggagacagggccttgggctgacttctcaggttgattgaggcctcctgactagcggtgttcccaggctagaggtgattggctgcaacaaagatgcttctattagtctattagcagtgccttcgggaccctgggattttgctctctctagaaaggtgttttttatttttttattttttatctcccccttttttcctggctttgctccagggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcc

SEQ ID NO: 81408 - DNA, 1155 bp, Homo sapiens
cttgtcacttgctccttatgctctgtggtttcccgcttctagcctaattcttgcctctatattctacaagtgcgtgcagccaccaaggcccagctcccatcctccttcctctgtatagttttcctggacatttgaatgaggctgtcactattttctgacctcctcatccctaatctgtgcatccttcagtccaaccatgccatgctggcttctgcactcagcagagggcccttgaggttgggaagtccagttcatcttcgtgtctccatgcccgatgcgggcctgccattcagcagaggtgccattgtcatctacggacttcctgattgttcagttggagtgaaggttaatgcctagagcagctctgagtctggaggtttgaaacatttagctcaaaataggccctggagtccacaaggctgtgtattttttttagaaggtatttgaacaattttgctagtctgctgtttattactcaggagtaggggagaaaagaaggcagcatgcacccagatgtgaggggtgcgagactcatgttggagtgggtaagccagcactctagcctggaagagatgggtctttagtagcttgggtgtggagtgttgaaagaagtttacgacttcataggagaagctggttatggacatgatctgcgtctcttcccaggaaggcaatcttgttagggtgagttttcaggtggacagctgccaccccagattctgatctagagaggactttgtaatattttacagcttgcaagggccctgatggtgcacagtccccatgtgtttctttgcagttgagaaagttgcatcccaggaagtggaataagtcattgctagattctagaacactctgcaagtctgtgtagccaaggcagggccagcacctcatctgtgctattcggtctgtactgtggcctttcccctgtcccacgctcccctgtaaccttggttagtcagctaaccaaatgcctgctctgctggctgggggccctccttcctttctccctctgcaactccttagcctgcgggcaccgagtcctggaaattccaccacctgagtctccaagagactgtctcacctctgcccacaccaccttccccagtgaagcttcgccacctgccgccgtttctaccttgtcgctcctgaatt

SEQ ID NO: 81409 - DNA, 1009 bp, Homo sapiens
ggttgcggtgagccaagatcgcgccattgcactccaatctgggcaacaaaagcaaaactctgtctcaaaaaaaaaaaaaaaatctgaagtagggacaaatagtacccagctcaaggccactggaagcttccataggacagagaaaatattagtgctgttttccttattttgccacaatttgtggactgatggtctacatcagtcattaaacaatgcttgattgtttaatgctaacatcaagaatgtagaaagcataaatgttagacttttttcataacgtgaaactttagaatctttccttctaatcatttgcttacttaaaaattgccctcaattagagttctttaaaaacattttaattcaaataaccataaacaaggacatttttaacatggtaaacgggcaacaaaaccaaatctggttgatttcagagaaggggagattattggaagcatgtcatgttgcttccagaattgactgtaagccaaagcagaagttctaacagtgggatttgtggactcctggggtctctgagaccctttcagggaatcttcaaagtgaaaactaattcaataatgataataagatgttatgtgtctttttcactatgttgacatttgcactaatagtgcaaaagcaacagtgaggaaaactgatggtgccttagcacaaatcgaggtacacaatattcatagtcgctgtattcttcacaactatacactataggaaaaaaaaaaatcagtttcactttagaatgcccttgaggtagccattaaattattaaatcttgaccttaagatcattttaatattatacatgataaaatgggaaataggaataaatcacttctgctgtacattcatgcataatgactgactcaagaaaaagcatgtttacaattcctagagttgcaaactgaactagccacttttttcacggaagaccatttttaatcaagagagtgactgacaaactttacacttggtctttggcaggcattttctcaaaa

SEQ ID NO: 81410 - DNA, 1052 bp, Homo sapiens
ctccctccacacctccctgcaagctgagggagccggctccggccttggctagcccagaaagcggctcccacagtgcagcggcgggctgaagggcttctcaagtgccgccaaagtgggagcccaggcagaggaggtgccgagagcgagcaagggctgcaagagctgccagcacgctgtcgcctctcactggcattctccctcaggcccgtcacacaccagataccacgctcgtaaccactgggccacgctgcagagtctcctgactagggagctaaacaataaataaatgtggcctagctcagcagctcgggcggcgggaggagcggcagcggcaaggcagcccagtttcgcgaaggctctcggcgcgccgcggcccgcaggcacccggcacgcgccttccccgccgccaggatgcccaagaggaaggtcagctccgccgaaggcgccgccaaggaagagtccaagaggagatcggcgcggttgtcagctaaacctcctgcaaaagtggaagcgaagccgaaaaaggcagcagcgaaggataaatcttcagacaaaaaagcgcaaacaaaagggaaaaggggagcaaagggaaaacaggccgaagtggctaaccaagaaactaaagaagatttacctgcagaaaacggggaaacgaaaactgaggagagtccagcctctgatgaagcaggagagaaagaagccaagtctgattaataaccatataccatgtctcatcagtggtccctgtctcccttcttgtacaatccagaggaaaatttttatcaactattttgtaaatgcaagttttttagtagctctagaaacatttttaaggaggagggaatcccacctcatcccattttttaagtgtaaatgcttttttttaagaggtgaaatcatttcctggttgtttattttttggtacaaccagaaagtagtgtgggatattgaattatgggaggctctgactgtctcgggtgtcagcttaacattccatagatggggggttagtttttatatcccataatacaaagcatattaaatggcaatat

SEQ ID NO: 81411 - DNA, 1070 bp, Homo sapiens
tgaaattaaaaataaataaataattaaaaaaataaacatttaaaaatttgagtccctgcttttaattattttaggcatatactcagaagtggaacttatgtttaattttttgaggaaccgccatactttttcccatagcagtacacaagggttttaatttctccacatccttgttgacattttttattttctgattaaaaaaaaattagagccatcctaatgggtatgaagtgattgcggtggggtttgatgtgcatttcctggagaaattggtatttatttatttatttattgtttaggccacattttatttttatttttttcataattgagattttattggttgaggatcagtacagacatttcaatttgtacacaaatcttaacatacgtaacgaaattctaaaaagccatgtattgtaattcttttttaaagttattccagtgactctccagcttaaaatttggaagcaaattttccttaagaggttatcaagtaccagtatcttcacatgttggtcagctgttacatacggcccaccagttcacaactcaatagcacgtacactacatgttcaaatttgtaatctttcacagcacagtaagttattaggaaaacaggactaccacaaccaaagatgttacagagtacacacaattctgacagagagcgccatgatcaaagagtggttttctttaggaaacaattctactaaaaaacaacatggtaatagaagtaatttagaatgttcaagacattaaatgcaggactgactccatattgccatttaatatgctttgtattatgggatataaaaactaaccccccatctatggaatgttaagctgacacccgagacagtcagagcctcccataattcaatatcccacactactttctggttgtaccaaaaaataaacaaccaggaaatgatttcacctcttaaaaaaaagcatttacacttaaaaaatgggatgaggtgggattccctcctccttaaaaatgtttctagagctactaaaaaacttgcatttacaaaatagttgataaaaattttcctctggattgt

SEQ ID NO: 81412 - DNA, 3313 bp, Homo sapiens
cggggccccgctgcagagcccgcgggcggcaggtgggcggggggcagcctcgtcgccgggactggatccgccgggaaaggggcggcgggtgaatgccggcgagagcccgaaggggatcgggcgtggagagcccctttctgtcctggtgagttattttgatatttagggtaaaaaaatccctttcaggttctccaacggaggagctttttaacctctttccggtgaggtgggaactcatcttcatgatcgaatttaaaagaacaatggaaccctgactacgtttcaacaaaaataaaacttgtttttttccctcctattgggtgttggcttttaactctttcaaagccgattttgaaacggctgcagtgatacatgcgaaggtacttgctgcttattaaacctttatgacgttaaggttgtctttgaaaaatgcaagttggaggagtgcttctggtatttcagaattacgaagacaagtttactgtgtcgtcaaggctgtttaatggaaatagatttgataattacggtgctagctagctgatgacgtttggttaatgtagtttattttaccgagtaatgacgccaagatcatttgatctcctgatatttaaatatgattaaatacactgtttggtactttttaaaaaggtctcaaggagccgttatctgcaacttctcacacctgaatgttagaacgtacttgggtcaattcctagtctttaaaagttcataatttaattatttttaagaatttatattatcacaagccatgatcgaaaaactttcacaaaagaacattctgacaccaaatctcttcctgaagttactttctcgtaatgtaaatatgaataaagtaggactgctctcggtaatgggcgatgaagaggagccatatttgttgcatttgttgcatgtataaaaatctagatatgcttaaaacggaacagtattttaaaagtacaggtttcataaaatttagtagagttctctgtatagtctctaatcttagaaaaatgttggaagggtaatttttaagtgtagtggtttgaagaacaaaccagaagcgcacaaacctttgtgtattttagaatatatttgtcttcattctgcggagctcttgtgttgtaaaggtgcagaactacgtaaaaatagtgttgggcagacttacatagtacatctgaaatcagatactggtttattcgaccatatttctaagggcatttttccagtaaaattgttttattttttgagtagccttcctatagtggtacatgttacatcagttgcgcatatcttgattttacagaatctgtcttaagtaccaattttggtttttcaaatcaatgtttctgaaatttttgaacactgaaagtggttttaaatgaatattctgaatctagttctttagaatcctctttgaattgtgaaatgcaaaataattgttagcagtttaacctgaaagatctttttacatgataaatgggggaggagaaagactgaaatgaaaatgttgaagaccctgatttgaaattgagtgtaaaggtctagatactgtaagttttagagtagctttagagacaaagctagtatcccacttggtgagatcaagtaacttgtggtttaaaatttaaagtaaccagtggccattttaacttcactaatttctcttggaggagctaatttttaattgctcatgattgtaaaacatacttccggatggtaagggagatgttaagatgatttgtcttgaagaatggtaaactttttctttgtttattgcctgtcataaaaagagggaaagtaaaaaaaaaaaggttcataatcttaaatcagtccaaaaatttgaattttctgtatttctgtttaattcaatgcgttaatctttagcattggtcaatacagccaaaagatgaggaaaacaaagactgatagatactaagataagaaataactgcaaccataaatgtatacaggttatgtgtccatgagccatctcttcagtttgcccatagatttttgtctgtggaatattttcttgtttcatcacactgaatcgttggccaagaaatgcttgaaaatcaaaacattaatatcatctttcttcttttttttaaaggtgacttaagagattaaaattaatttggttgctgttggttctgaacaaataatgagttcttttatttgaggtaagagtgggttaatttttattgttttgacaaaaattagcttattaggcttttgttttatctttaataatttacatttcaattaatgaatgggtatcatttttaaaagttgtgattatgaatatgagtaaactatcaaataatttgacaaaagcctttaagccttttcactgcaggaaagattaaaagtatatacgcatagccattgtaacttaatgtaccctttgaatagtttaaaatactgaaggtcctttaagcctttgtttaattttgggaacaagagaagactgattagattttgaggaaaaccatgaaccaaagatagctttttttttctgtttaactctgtatattgtgcaaacaattttaatcttttaagtatttaaagaaataagcttattggagaatttgaactagtttgctattcatactgatagattttagggaagaacatttaaaaaatcaggttttgagcatagattttagtttcttttttgtaattaaaaagtttaaaaacacttatttttacttgctattgtttgcttcataattaagtttagaatcttatttgttttcaccaaaaggtatgccattttgaagactgagacgttggagttttatcctagaggataaaggaaatctttgggaaagtcagtattttatatagcaagtaagtaaatgtttttacccaacatctgcaattgaatagttaccaacatttaagtagaaaaataccattaaagtttgttaatgaaacaaactgtagactacttatcactgaaaggatgagaaaaccatcaaatttctttgcctgacattgaaaacacttctattactatcaagacagtcgatgcatgtaatttatattggagcaggaagacatttagtacttcttaataaaatggtgctttaggattgtggttaaatctgcagtaaagtcatcaagattatgtttttacaaatctggtatatacagtcttaagcctttttttttttttttttttgattgtacaaatcacattttaggaatggtctggaattttgcatttgctgatcgtaggattcttaacaacatttcaaaaactaaatagacactttcatatcttaggcatttaatagatttaaaa

SEQ ID NO: 81413 - DNA, 1050 bp, Homo sapiens
gagtattttaaatctattaaatgcctaagatatgaaagtgtctatttagtttttgaaatgttgttaagaatcctacgatcagcaaatgcaaaattccagaccattcctaaaatgtgatttgtacaatcaaaaaaaaaaaaaaaaaaaggcttaagactgtatataccagatttgtaaaaacataatcttgatgactttactgcagatttaaccacaatcctaaagcaccattttattaagaagtactaaatgtcttcctgctccaatataaattacatgcatcgactgtcttgatagtaatagaagtgttttcaatgtcaggcaaagaaatttgatggttttctcatcctttcagtgataagtagtctacagtttgtttcattaacaaactttaatggtatttttctacttaaatgttggtaactattcaattgcagatgttgggtaaaaacatttacttacttgctatataaaatactgactttcccaaagatttcctttatcctctaggataaaactccaacgtctcagtcttcaaaatggcataccttttggtgaaaacaaataagattctaaacttaattatgaagcaaacaatagcaagtaaaaataagtgtttttaaactttttaattacaaaaaagaaactaaaatctatgctcaaaacctgattttttaaatgttcttccctaaaatctatcagtatgaatagcaaactagttcaaattctccaataagcttatttctttaaatacttaaaagattaaaattgtttgcacaatatacagagttaaacagaaaaaaaaagctatctttggttcatggttttcctcaaaatctaatcagtcttctcttgttcccaaaattaaacaaaggcttaaaggaccttcagtattttaaactattcaaagggtacattaagttacaatggctatgcgtatatacttttaatctttcctgcagtgaaaaggcttaaaggcttttgtcaaattatttgatagtttactcatattcataatcacaacttttaaaaatgatacccattcattaa

SEQ ID NO: 81414 - DNA, 1023 bp, Homo sapiens
aagttaaaaatttgccaggcgcggtggctcacgcctgtaatcttagcactctgggaggccgaggcaggtggatcacgtgaggtcagcagtttgagaccagcccagccaacatagtgaaacccccatctctactaaaaattaaaaaaaaaaaaaaaaatttagctggatgtggtggcacgcgcctgtagtcacagctacttgggaggctgaggcaggagaatcgcttgaacctgggaggcagaggttgcagtgagctaagatccacaccactgcactccagcttgggcaacagagcgagacttcatctcaaaaaaaaaaaaaaaaaaagaaaaagtaaaaaatggttttaaaaaccaagttttctaagaaaagcataaatgactaatgataatatgacaattgactaaagctgtccttactgtttgaaagaacaacaaccaaaatatgtatattatacctgtaagttattaaatctgaaactatgatattatgaaatagggtaggtggaaatacgagcaaaatcattaactttcatagtctgcctaagctgaattttgctcccttctcctgtctttccaaggatggcaaagtgattttagactttgtcaattttggtggttagtaatttttgtgagtgatgcatggggaaggagatgctatggtagattacattagtgtctaattcttgtgatgatgcaaagtgagatacattttctgtctttggtggtgtgagaaccctatctactggtagataacttacttataagcacattatcagagcagtgtgagggatttcccttagacatttcttttaccgagattccttaagtcacttctgcccttctcttaagggtttacttggtttacgatttgtctgtcttcacaaaaccctctgttacttataaggtcagattaaatttggaagatcagaaatatgttgtgttccttttaaattgcttcatttgtcaatttcttgggaagataatttagcacctactcttagagcaattttgaagcagatct

SEQ ID NO: 81415 - DNA, 1037 bp, Homo sapiens
tattatcaagtatatattttaggaatgattagtgttggtttagttgaatagattggtacaattagtagtaatttgaaatgatgcctatggtttcctaacattttgtcttagtgttgattaaagacataataatgtgaaataatatggtaatactaaggaatgagaaagtggccttacaggtgggcaatgtaaactttcctgtagaaggattgaaagtaaatagatgtaagactagaaagtgaaacaattctgtactgtaagagcaatgttggctgtgttaaataactcgttcccaaacatcagatccacctggggagcccaaatatttacctacatttttggagttcttaggggctgaaacttacgcttgtgattttgtagtaacctattctagagaggagccaaatttgtgatactcaagagcttgtatgatttctgcttggactgtattgttaatacatacatacatcttttggtctattggcaaatgacccttgcaagatgttgacattttgggtataaatcatggtgcttaataatctgttttcattttttatgtataaaattaaattctttttgtcctctgcagaaatatgaacctcaaactgaatcctctaaaggccccatacaatgaagtagacattggtggaaacatttagtaagtattattcaatttacatgtttaatctgtttagaaattttaaatactactttggaaattttgaaaattcgagtcagaattgtaaagagggatttagtgaaactcaacacagtacaagaaaatcaacatggaaatttcgcttattaatttactccaatctattattttctgctttcttcacttaggcaagttaaaatgcaaacaaacccacatttgaacatacctctaacactattataaacatggatgttgctaaatggttcctctttgtttttgtaaataaagttttattgcagcacagctatacgctttcatttagttattgtttgccgctgctttctcagtatatagcagcagcaagcagaggagttctatt

SEQ ID NO: 81416 - DNA, 1027 bp, Homo sapiens
ctacccagttttctgtaggatcttgattttattttaatgcaagactgctgaccccatgatcctgtgtgttcttcagagatactcttactgatgatgtataaatgaactttgattcagtaaggtcagtttgtaggtctcaaagtactttggttattgtggtacatcagaatgatagctagtatttactgagatctttctatatgtcaggtaataaaaatcctataaaagtattctttctacagccacaggaggtaggtactatttttattttacagatgaagaactgtggattttgtttctaagaaaatttccaggctcacagaactaagcctaatttctttttattttttagcaaatacagtttttataagaatttgaattctatgaaaataaatggattactcctaaatctctgatgcctcagtgaacactttttccttattaacaaaattctcacttttggctttggattggctttgcaggagtgcagattgatcatagcttttttcatgtcctaagagttgtcagagttttctcttgtagcatttttttctttactttttttttttactatctttaaatatatgactgtaagagtatgataaatatgctgttttctaatctctgctgttgtcacataaactaatatattttgagtaattttgaaatgatattaataatgtcattagattttctttggattttttgaaaaaaataatggttttagaaggaaatctggataaattttatctctgtcctgtgtcagaaaaatataaaacttgagttttttaaattaaggtactaagataaataaattgcatctatagatattgaaatatgactgtaatttgataatgcattttcattctcagtgtcattgttcatcataatagtatttacatcaccaacttcatttagagcttgaatcttgtaacaatagagattgaaaataaattggtttataattaactctgacagagaatgatgtttttacttttatacttctctatagaagtacatgtccctt

SEQ ID NO: 81417 - DNA, 1666 bp, Homo sapiens
ggtcatgatgaatctgaatcatttatttaatgataaaatcatctgacttctcacttctcacttctcccttcagttaaaattatttaagtaatggatttgtttttctatgagagacatttggtattttggtaatgaaagtgtattattttagttgcatataatttgaaaacagcattttatggcaaatctatcaagccaggcagatactttgcatttttgatcttttttttttttttttttttttggtggctacatcttttctgtattctcagatatgtcgttaaagatggtgccacctatagtggccattttcgttatctaaacaaaaccaacatctgttggattgaaaaactatgctatgatcgactgctttatgtgtgtatgttttttttttttttcaaatcccttaagattcttttctataattagttttctttgaagaagcttggaaagttttctgcattgagatttagaatccacagtgtttctgtaatttagctttccaggaattttgaattttaatttttgtttttactttttatgtacacagtataatgatgttagtgttaaatattaaaaatctgactcttcactgggacttttttatagatacaaatgtatctgtggtagtacaaggactttgttactttggcgtgcagtcttatcaaggagttgtgtgtgtgttttgcatacaactttacaatttcatagttgaaagctgttacaaaatgaaagttttgtgtatggtaggatatcttcaaggtgggtggatgttttctgtttaaaagattaagatgccaacagcgtttttttcttttaattttttcatcaagcacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaatttctcagtttgggtttttttttttaagtggaagtttaattaaatgtttagttttattttagtaatactttggcctttgtagttgccgagtggtaaagtgtactgaatatgaataaagctggtaaattggaaatggtgtaatcgaaaacattttacttggtttatgaagatttacgtttttcacaaagttgtgctcttagatggtcatttggtttaaatactgttttgtttgtgctttcatgaaacacctttcaaaacaactcaatgggtaataatagaatctgattttaatctgccacaagattttaatgaacttgaaacaaactgcttgttgctcgaaaattcaggatgagtgatacacatatacttctgaattattttgtgttgattgaaatggtttcttaagctttttaatactataaatacatcttgctatagaatattcatctgaatatttaaattaatgt

SEQ ID NO: 81418 - DNA, 1054 bp, Homo sapiens
ttttggtaactattacaaaggtggtaggcattattttggtagacaaaatgagttcttgattctgttttcccattttacatgagaagaataaatagttcaggttaaattgttttgtgttaatcatactgtttgtgattcatgtcaaatactgcagcatacacatccatggttaatacacgagcaccatttgttattgactgatgtgaggtggttggtctttgttaaattcaaaaatggaattttggatattgttcttgctacgaaatttatctttgtgtgtagagtatggaattgaaacagtttggattatggattttacctagattggacattgttgattttgtttggtgtaaatctaaagtggatttcttcagtgagggagagacatggttctggcagattatgttgaataaggaaagttgattggatttttttgggtgtgtgaatatgcttgtctgaatggagtgcttggtaggatattgtttctggaattagtaatttgtttctgtggatctcatggttttgatatttaggagaatttgctttgtgacattactttgataatttgcaatcacgtatgtcctattgttaataacattgttgaaatgggtgtatacttacttgatttgaaatataagggaagtgttgggatatgtgttttctgttggatttggacgtggagtttcttgggttactgatttaaaggtgatcgtgtttggaccatactcttgaatttttgcctgaatcagtatgggaagtaaatatattgtgattatgagaagtttctttggggggaggagtgtaatattttcaaggttatataatgggttaaagaattttgtgaaagaacaaagaaaaatggatattcttgaataaaaattggttgcattaacttttgctccagtgcaacttgaacactagggaggcgctcttgagttgtaaaagttacccctttcttccagtggagatggaaaattcccccttaaattttgtctttagattatttttaggcatcataaagaaggaaaaacttgaatttatattatgaaattaa

SEQ ID NO: 81419 - DNA, 1935 bp, Homo sapiens
aaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcaggtaagttcacgatcattggtgataattttaaagatttatttgtttaagtttgccttgttttctgtaaatacgagaaattcttggatgacgcaataagatacagagattgttatttgtatctagtgtgctactttgagaaagtttccttattgatagtgatgcttccactgttcggtttatcctgttgttttttcttttaaggaaaaaatagaaatatttagttttttggtgcttaccgttgttgtgttataacaatatcgttaacatcgtcaggactttgttcctgataataaaaagcatcgatagaagccgggaccttacctttctttcaacttttgacagtaaatacctgggcacaggacttcaaagcaaacacagattccccctcccccttaatatttaagaattaaaagatgatgagaaataaggacaaaagccaagaggaggacagttcgctacacagcaatgcatcgaggtatgagctatcaactttcttcctttttgtctttttttttgggggagaaacctcagcttacaattgtttaccttgacagacatggattgctgtctgttttattgtgtttttctaatttggattcgttttttaaagcatgaccttgagattgctaatatgccacaccctaattttttggtagcaatttatgaaagttgagttgtgacttaaggcctcttacagcagtcaaaaggtaaggtacctttattcaaaggggcctttactgtaatgtacagtttttctgtcagtaaatttcagtttttaggtttttgtactgcagaaaaatgaccttgtcggtttagccattgctgcattgcaccattttacatacaaggcaaattttttctttgaagaatccaggatatctaaacttgtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaat

SEQ ID NO: 81420 - DNA, 1064 bp, Homo sapiens
atattataaattttaaatcatgcagtttaacaaggatgtgattcattatgtggttttccttcccaatttttacttttctaatttttataaataatacacttttctattaggctagtgaatttgaaagttttgaacatgatgtgttactaatatgctgaattctatttattttatttgactgaaagcatattgagccttgctttagaaaataagttaccaaatttttttgcattgagttgtcacccagtttgtagtgctgtcttaattgaattgcccatgtaaattactagattaaattgaggacagaaaagttttttactcatcctaagctgtttttttctggaaagtaatgacaatttgaagaaatgagaacctccagatatatttggcaaattattaaagattcagcactaaaattgttgctcccttgagtgtatcatttgcataggtctcacatgggttttggctctcttatgcaaggtttgtggttaacatcattgatcagactgtgctttctaattctaaaaaattgagcagtgttggtattctttcagtatttttactctcacctggaaaactacctggaagttgtcaggcatttgcttactggtagtggaggttacagctgtacatgaagcatgtactgactgtacttttaaattggtttgtcaagtatactttgaatcatatacctgatggatgtccaaaaatatttaagactctttgaaaagaagatagttacttttaaattagttaccctaaatttcatatcttaatacatgtacataattatgacatcacttccttttaaaatgtgcagctgtagaatgttagtggtgttttaatgtggtagattaatattacttctactgagctgaactgtccctgtaattagtacttggttccttctgccatcagagtttttattgcccaaagtatagtgtttagggaatactacgaaaatcacctttgcagcctgagccacagaagaggaaatgagtttgcaggtcaagtaaactttggtctgagaattactttagtatctggaaagaatgagtgcaagt

SEQ ID NO: 81421 - DNA, 1045 bp, Homo sapiens
gggggcggggagagaacgcagtgacgtctggccgcgtgcgcatgtcgggcgctttctcctccccctacccagggagccgcacgccgaggggaaaaggaagggaactctagttgggactttccggtgggcggcttctttcctggacgcgtttgctcctggcagtcttgtccgcccttgcctgtagcggtccgcaccctgtagtgtgttcttttgcccatttccgggaatggtttatcctctttgagaagcggctgcttttggagaaaaagtgcaggcactatttataaattttaaaggcactatttggaaatcttaaaatagaaaatttgcccagttttacattttcccttttcataccttagcgtcccttctccccgcccccgttcagtgtgaagagatgagtgggtttaattttgttacaattgaccaaaacgtttgagtgtcagaggcggatacttttattttagtgaaaacctcttgacgggtgttaacagctgtttaatacatggctcataaacaaagggaagattatttgaacttgtccccatgcgtttttacttggtaccgtacattttctcagttggcatttgatggagaaaaactcaggtcagtatgtgctaagtactatatatttaagattcacagtgggatagtttagtagaaaatagaaaatttcacgttcaataacattaaaaagtggcagaatacagcgttaggcaaccattactatgtaagtaaatgtcagaaaactactcttttaagtgttaatagcacttgctaatgcagggtgactgacagcttggctgatagtggggtcacttggccaaatcttcgcaattatcttccctaggcctccatttcgggaattctgagtcccggtaaacggttgggtttatgctcactgatttgccttgtttggaaacctttacaaggatttctggttaaaacttcatcgttcagcaacgatgtcttaataattaaattacacatactgaatttaagcaagcaagaaattcagtggatttatctactgtggacaaagttt

SEQ ID NO: 81422 - DNA, 1782 bp, Homo sapiens
tatttgagccctgattatgaagtgagggacaaggcttttctttttgaaataaatgatggaggacatagatatgtggtagccattcatgctacataatttagcattttattgttaatatgtttggttatgggtcttcttgtttggtatttcaacatgttctggactggatatcatactgaaaagtatttcagttctcattactgagtccctgtagtttggggaaaatgtgatcactgatcttgaaggagagaatgtttcagaagcatccggctaaggcaggattgtagagatagtcttgattttatactttggatttaattctgatgagtcattttgtcacttgtgtatgcttaactgttacctctgtgcctggcaagagctaggtatgagttcagcttttactttagtcctgaaaatttttgttcccagtttaggccagtgaagaagcacttatgattggacttgtaattttctcattttaaaaatgtagataatggtcatcttcattgggtcatgaagattaaataatatagtgcccataaaatgcttagcaaagagcccatcacattaaaagtgctcaataaatgtaagcttttagtaaggttattttattcttactgtttgtttcatcttactttcttgcacccctccttcatatcctaagttcttcttcaggagctaggttggccctgaggaactcgctggttgtcttggcctaccaggagagtttgtttaggccagttacaggagagatttgtgagaatgattttaggaggcaagtcctcatttagtcagcttgggtgcgttttacagttcatcctctcttagaattttttttttttttttttttttttgagaagagccagccttttgagagagcatatgactcttcctggactacaacagcttcttgtgtgaatcacagcccggcttttgccagttagtctgagtagataactacccacccccactcccccaagctgataattattaccctggtttatcctctgtctcatttcccctctcaagctgttagagaatgaatactgaatactgtggtgcactgctccatggatataaatgtaacagcagtaatatttacaaccaatgtctaattggctgtagcttgctttcagtgttcagtctaaaccataggactatatatttgtcttagcataatgccgaacatgcaagtctgcttaaactatagtcttaagatttgtgtgttttgggtttcctctacttcctctatttcctgtcttttttgggttataggtcagatgggttctactttttattcccatttcagactgtggagagcttctaaaaataccagtgtccatccctgcccctaggatctagttaatttttaaaagctctctgtgtttcaaatttgcatgtgtttctgtatgtttgcagtatctccgtgtgttttcaaatcttctgatggagcacttcgtgtactttaacccttggtctttccattgcctgtcccatttttaaattccctttttagtcttaatagctgcttgagttaggacctctggaagcaaaagtgggataggatgctgacggggaattgtaggcttgatggaagaggatgtttctatattaaatgtcatggcagatccagttctaggcatacctttaaaatgtatacacaggctgggcgtggtagctcactcctgtaatcccagcagtttgggaggcccaggcaggcggatcacttgaggtagggagttcgagaacagcctggccaacatggtgaaaccctgtctctac

SEQ ID NO: 81423 - DNA, 1020 bp, Homo sapiens
ggattcaaacagtggcagtttgactccagcattgattaagcatcttgtgaaaagttgctgtcaaattaatgggtaagaggaaacttagccgggtgtagtggttgattcttgtaatcccagcactttcggaggctgaggctggcagatcacttgaggccaggagttcgagaccagcctggccaacatggtgaaaccctgtgtctactaaaaatacaaaaattagctggatgtggtggtgcactcctgtaataccggctattagggaggctgaggcagagacgcttgaacctgggaggcggaagttgcagtgagctcagatcgcaccactccactctagcctgggcagcagagtgagactgtgtccccccaacccctgcccaagaaaaaatcaacatcaacaaaaaaagaggaaactaatgtatatgagactgcggaaaatagtaaaaatcttgcataattctgtagtttgcttctttttaaacactttgcattttaaagaagcagactcaaaatcacagtgcactgtgggtgtgattgatgccagtcacacattctgctgttcaaaaggccatgactctacatcaaaagattctagttaaaatgttgccctgaagtgatgctcatggggatagtataagaaacaaatgtgcaaagatgggtagatgggaggtactggaggcctcggaacttcacctttgtgcagtttgtcgtccattggcacacatgaactttggatttggccacacgttttgaagatttgtgctttgcttcaagtttgtttttttttgttcgaaacttagttcccagacaggttttgcatgagaatcacttggagaattttaaaagccaagctccctgtctgattggatttgggagccatgtagtaggtttgaggaattgtccaaagctctgggtgggtctgtggcatagctaggcttgagaactgttgtgtttatctgccgtctcggggaatagttcttgagtgtgttgtgtgttgacaatcttgaggcggagtctcgc

SEQ ID NO: 81424 - DNA, 1028 bp, Homo sapiens
ctctagtgggtagaggccagagatgctccccaacatccaagagtgtgtatgagacagctccccacaataacaaattatccagcctcaggcatctataatgccaccactaggctgggcacggcggttcacgcctgtaatcccagcactttgggaggctgaggtgggatcccttgagctaggagttcgagaccagcttgggcaatttagggagatgccatttctacaaaaaatgtaaaaattagccgggtgtggcagtatgcacctatagtcccagctatttggaaggctgaggtgggaggattgcttgagtccaagagcttgcggctgcagtgagctgtgatcacattacgtgcactccatcctgggcaactgagcaagaccctatccaaaaaaaacaaaaaccctatgattgagaaaccgtgcttgccttggtaaatgttggttgttagtaataaagttgagtccctttgcggtttcttctctggcctgatccagggacccctcttactcccatgacgttatgggcatacgtttcacatttattattgggattggtaatcagatcttttaatctcctttgaactttgggagttgctgaaagcaccatatattttataaaagtctaaagtttataacctaaacaatagctaactaaagacaagactcacagggctgaaaggaactcttggtcaaattggtccatctgtccttagggctttaatgggtgtaaatacattgcccgaggtggttaagtattcttttgttaatgaattctggggagaactccccttgtaactgcttttcacagcttggttatttacaaagacttttgattttacctgaatagaaagcttcttttgtcttttgtgtattagcacattgccagatcctgattaggtaggtatttgtgaagtgccttaactaatttgtaccttaaccaggcttcttgctagaatacatgtttctctaatgtatgcctgggtgctaatagtttggtgctatggaaactacttatatttggttattgg

SEQ ID NO: 81425 - DNA, 1086 bp, Homo sapiens
accgcgcccggcctgcttggtttggttttgttctgtgttttgtttttttcttgttgagaggggaatgatacttaacagataagacttcgtggattcatatatatctggtttcaaatcttactgtgttaactaggtgtgagagttaaatacttatgagcctcagttcagcctcatttgaatgaaggggacagtaatatccatgttcagagtttctgtcaagagcctgtccatagaaataacctgttctgtagcatcatgtaaacattcaggaaagggtagctattggggattttgagaatggtagcaataacgttatttggaatgtaaaagtataaatgtgaatttgaagattttggtcttatattactaaaattactatctgcaaatgttttaccatgagaatttttttttaagcagattcatgtgtcagttcttaaatatttttaaatctctctctctctcaaaataagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaaggtatctactttgccctgcagtacaaatgtgctgctagcctaggacaagctagcagacctttgttgttcatgaaaactcattagtatatcttgatgatgaaacctacagccattttttctagtaatatacagtagtatatctgaggatacaaatgaagacttctttctgctctattaaggaaaataaatgacctgaaccatccaattatagggaggaaagacaaatttttatacgcttggtttttaactttatttatttatttttgcaacagagtcttgctctgttgcccagcctggagtgcgcagtggcacgatcttggctcactgcaatctccgcctcccaggttcaagtgattctcctgcctcagtcacccaagtagttgag

SEQ ID NO: 81426 - DNA, 1017 bp, Homo sapiens
actcatgtaagagtactcagtagtgagtaactccacatagtagatttttcatggaggagttgacttagatatcggctctcaaaaggacaaataagaacacaagataattttaggatgtaaacattataatatatgctgtaataaagtcataatagttgagctagaatgcctggctggtatcttgaagtgataaaactagttgatgtagtaacactgaaatgattttgccctcccagttaataagggctccataaaaacctgtgttgagtaaaaactttcatagctctagcagagggccaggtgtgggcatggatagacaggctagagtaaagcgcactttccctccttcctttctctgccaggttttttcagagtgttttatgtttactgcctctacctatatttcctaccatttggttattcctaactccttctgtttggaccttttgtcctttaactccaaggtgatgctaaggccgttacagaatctgtggactttgggttatgtgattacattggattctagttgtaaaatgcctattctgggccatcttttcttttgaagccttgattttcttcagcttacttcatcatttttatgttgttgttgttgttgttaaagtcattgttgataatgtcctttcttagtgacattgttggatcatttttcataaagatgagacagggtcttgctctgtcccccaggctggagtgcagtggtgcaatcacagctcactgcagccttgatcttctgggttcaagtgatcctcccacctcagcctcccaagtagctgggactacaggcacgtattgacacacctgtctaatttttaaattttgttgtagagacaggatctccctacgtagcccaggctgatcttgagctcctgaactcaagccattcttctgcctggacctcccagggtggtgggattacatgcctggccctacacttttaaatacaaacatttcacaagtctcagctagtggcttcttttgtgcatgttctgaacctta

SEQ ID NO: 81427 - DNA, 1892 bp, Homo sapiens
tttagtggaagcagccgctgtcttacctttctgtattattcagctgtatattttaatgatgggtaagcggtgtaccatatagatttatagctgttaagtaatgaagacattgttaaactaatatttcctaggataatatgcctattttaaaaaaaatggcgctttattgtctcataaatagaactagcaaaacaacccttttgatacttggttacttgaattctcttcaattgcaataaacgtttgataataataatgggggtcaagaaaaaagattaatgcgtggtctcttaattttacagatgtgggaagaatatcctgatgtttatggggtcaggcggtcaaaccgaagcagacaagaaccatcgcgatttaatattaaggaagaggtaaggaaaaaatgttttaagggcatgcatttaaactccctatcttacttcattctttctgactctggtatgtattaccattaaaaagactgaacttcaggcatgagggttaagtgactctaatatgagctatctatgaccagatacagtaaggcaagaagttaataatcaaataaaagaatctaaccagaaagatcatataatagtgaattttttagtagagtattatacagaactgacctcaaaatggtttattttttaagttgtctctcatagtgaaaattgattatatatagcaagaagtttacctttttaagcccctaacttctaaatctcctagatatttattaaatgggtaacttgtttggtaaacaaacagagcaatagaaatagtttgggatttattcctgaaagaggagggagtgcttaattaatgtatctacttttatttaacttcttaaatttggtttccttgctcatttttagtgtgagatataataaaatgagtttcaaacatacttactctaattgtgagagattgatcagtgatttttttaaattggtattctataccaggcttggttgtctatagaatcagacttctttcacctttctcattttgtgtgatatttttgtggattcttattctgaattaggtttatagactagatcctgaagagagattcttttgtctcaatgaaatgtctactttctgctttcttgggaggactttgctagtcttagctatataacgtacttctgatgaaagttaaatattgatagccacaggtcagtgagttgggtgtgggtttttaaataaatgtaccttaaaaatctaattcaccctaacatctgcattacatttgtgatgttttattttgagtgacctctgagctgttttgcctttgcttttgttttccatagtgtctcgcactaggttactgagccatgtttgttaaaaccaatcacatagttgtagaaatctttccctcttttacatattaattaacacattctctgtagggtacaagattaacagcaataggaatagtttgccattttccttaattgtggagagaaagagctactgaaatgtctgtgactgtaagctttccttggcctagtgctgttagcagagcactgttggctcatgagtgaacatactcttaaatgagtctaaaatgaatacatcagtagttggtgcctttaaggcacactgactaaatgttgtggcatttttatttgatagtctcaatctgcagtatccagtatggtccccactactcacatgtggcttttaaaattcgcattagttaaaaataaaacttccatttctcagtcacaccagtcacattttaagcgcttggtagtcacatgtggctgatgggtactgtattggacattgtagatacaggacatttacatcgttgcagaaagttattggatattgctgttctggaagtcaagctgagataaatatttcctggctttagagataactca

SEQ ID NO: 81428 - DNA, 2639 bp, Homo sapiens
atctaactggaaaactctagcctcaacacatccattctctgtgtttgctgtctgctatacttatagaagtggacctcattggtggccctggtttaggttctcaattcctgggggagatatggtaattagaatttattggtgaatctttcttatctgaaggactagctgttcatattccttcaagcatgcttctacttctctccagtttgactgtgtaagccccctctgaggggtaaactgttgtggacttggtctgagggagactgcagactcatgctggtctcccacttactgtaaacatcttcctttcttccttcctggtgatcaccttatattccttggattcttagcaaacatttattgtactatgctccggggaagcagaattagaccagtgtccagagtgtatatacgaaggtctttgttttaaagagactgaaggatattaggcaatactaacaggcctttctgtcttaccagaagcacccctacccgtctgactgatagactaattgcgcattctttcattgatttttttttttttaacctaacaaagaaacatctccatttgcctgactttggctaaactctggtacaaagacgaacaaaaagtcttggtgtacaaggacccatctactggggaaatgcatatggaaacacgcagtgctagtagaagttgaataatattcataaaattgctccactgaccgtccgtggaaggcctgaattgttgttttttccccctaaggtctccaccaattcaggtttagggtgaccgttgtagcttttaggaaggttctcaatctgcacatcagccacctcctttcaataagctttcaccattacttgacctgttctcccatgaagaatattgatttgacatttgtcttgttgtagctgttgtctttagtatgacctcattccctataaagtgacccataggcaaattggtaattgtttgatttacagagaagccccaggcacttgcctgtcagttttttcctaggtatttcatgcctagcagctattacatgtttcttccctcttctctgtaggtgagaaatgagtggggtccctgcaatatcttgttggattttcaagtaaactaaaactgtttgggatagtaggacgcctgtaggttatggctctttcaagccttctaagaattcaaggagcaaaggaacatctactgtatctaataattattaaaaactacatctttagctgaacagattagttatatgataggtttattgttgaaaaataattttagggactgtttccttaaatgtattctagagacttaaaatatctagtatagtggttctcagagtttctacccagtatcagcattacttgaatttgttgaaattcatattttttaggcctcaactgagacctactgcatcaggagctctgactagggcccagaaatctttttttttttgatggaggaggggcagataggggcagggtttcactcttaaccgcctagggtggagtacagtggcaaaatcacagctgactgcaacctcaaactcctgggttcaagtgatccttccgcctcctcagcctccttagtaactaggactgtagacatgctccaccaggcctggctcaattttaaaattttaactttaatttttctggagaggtgtcttgtattgctcagcttggtcttgagctcctggactcaagtgaaactcccaccttggcctcccaaagtgctgagattacaggcatggaccatctcacttggcccagaaatcttttttaacaagccctttaggtggtcctgataacattttaaaattttggaagcactgatcttgtgcatgttatggtttcaatcttgtcaataagagtagtaaatgaaaaaagtacatatatatccatttttatttatttttgttactggagataaaataggaatcgatattatgtagtccaggaaggatcacaattcaagtttaaatggagctagaatctcttttagcatgtctaaaatgtgcatgttctgccctttggatagtaaaattgaaattggttttgtcggattatttatcttgaaggattcttttagaaaaaaattactttgttttgcttttgatcacagagaaaaatggaaacaggaaccctcagaagatgaacaggaacaaggcaccagtgcagagagtgagccagaacaaaaaaaagtaaaagccagaagacctgtccccagaaggtgcactgtttgcttaagatctctacttgggatgagcttaatctgctgtagattgggaaggataatgtcgtgctgaaatgagagctttaatgagatgcattgtgttttgattctgcgttttagatatctgtggttcactttcagccagcctacattgcaggtcttactgcttctttcttcgcagactggctatcgtggggcaaacatgtcttccgcttttagtaaaactccttatatgtttggccagggtacagtctctttttgggagaacaaattgtttaaaacactgtttgcctggcttaaagcatacttgagtggtttattaccttgttcataaaatctatataacattaaacaaataatctgattgtgtagagaaggaggtaggctgaaatagcagcaaattatgctaatt

SEQ ID NO: 81429 - DNA, 1386 bp, Homo sapiens
tattatgcctgtttaggtgtatatcaataggattaattcctacaagtaaaactgttaattcctacaagtaaaatagtttgatagctatttccagtttgcccaccaaagagatactatcatgaacaacatgctgtgtatgtgtttttatatcaggtaatcctgatgaacatttgtgaaacattcacgttctttcccataaatgattgaggattatcagcattagaatgaccttcctgttggaaatccagatttctagtgaattagaatttcagggagtagggcccaagaatatgcatgtttaacattccccaagtgaaatgttacattctgatgtatgaaccactgctctgggaaatactgttatataaagtagacaccaaatgataaagtgaagacttagccttttgtttctcttctcattttagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttaggtaagttgtaccccagaagtgtttcactggtgtgatgtgataaagtagttggttagattttggttctcataagtccggggttgtgcacttaatagataaaaataacagcctatgtcctgaagttgttttcagaaatctggttagctttcttgcaaaaagagtggtattgagccaaggggaataggaaaagagtagcaatagctcatttgaagccttcattcctaaaaaacaccacaagttcgtgtcctgtccaatggtgacttagtggcattatcttcatttcataacatttttttccattaaagatatttggattatattcctacttctgaattgctctttgaatcacagacgtttttctgaggttcagcttaacgtattgctacttgaatctgattttatcaagtactaataggatatgaagcattaataggaattatcattagtgaaataggccaggctcagtggctcatgcctgtaattccaacactttgggaggccgaggcaggcagattgcttgagcccaggggtttgagaccagcctagacaacagggcgagaccctgtctctacaaaaaataagaaaaagccgagtgtggtggcggcatgcacctgcagtcccagctacttgggaggctgaggtgggagaatcctgggagatggaggttgcagtgagttgagatcacgccactgcactccactccaggcaaaaaagctagatcctgtctcaaaaagaaaaaggaaaatgaaataaaggaacagatatatgcaaacactagtagtttactttatagaaatcaagtatttttttttttagattt

SEQ ID NO: 81430 - DNA, 2698 bp, Homo sapiens
tttgtgttgaagcttccagcagtctgggaatacttaaatttcatattcttattactgggagacaacatacagggttgacatttttaattttagaaatattgcttctctttttgcctgatgaaatagtagcaaattttttcttccattatggtttttctttttttgtgtggtagtctacttgtttacataataatctgatactaaaaaatgaaaaaaatagaagtgtccttatagttttctatatcttgcttatacaaatcagtataaatatagaatttttattttcaaattgagttagactccctacagttgtttaggagcattcatcagcactttaggaaaaaaaagtaagctttgagcctactgtaaatggcagatctataaaacaacatgcttttggaaccaaaagggtatggtttcttattctagtgacggttatgtgtggcagtttaattctgaagagatcatttctcatttattcagcattattcctcttgcagttacaaagaagatgatgactttgagactgactcagatgatctcattgaaatgactggagaaggagttgatgaacagcaagataatagtgaaactattgaaaaggtcttagattcaagactgggaaagaaaggaggtatgtgtatttggggagcaaattacattttatgtatgcttagtaagacttagattttaggtattttaactctaatgtgatgaattttagtctactgctgtatttgttgtgatatgtagaagtctttctgacccagtgtttcagagctgaggacaaaggtatgtgtacactatgtctttaagattttaaattaagctagtatagataagtgtcaatgttttataaagcagtgatatagcagagatacctgctaattaacattaagcaaatccacctttggttatttgtttcttaagctccttgtgaaaatatcaaactggttaaataaatattgtggtaatattgaagatttttaaatatctaatttagatatctcataactaagttgcattaaagtaaactttctgtaaaggaaataccaaaataatacttaatgctttttcttttggcttttttttttttttctttttttcattctggcttcgattgaggttaagaaagttaaccggggacttcgagtaggggaggttggaggaggatattttggtgttctatccttagtcttggagagagggatttgttttccgagttagtaagggaccaaaacaaaaggatgttgctgctctgtttttattgtttttgaataagggatttctttgatttcacctgcaaatttaggaatatgtaaaaagtggtttacatttttaaaatacttgaaatttttgattgagtccgttctgtgttgtttgtgagtttgtacttatttcaagttgaagtattttggtgcttcatccacaaagggagtcttcagataattgcattcttgggaagctttttaatatctggtgtaatatactctctttcaagtgtacttaatccttttgcagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggtatattttccatcatggattaaagaaatgtatttgcagcctgaaagaagggaaggttttaaaataatgcatggagatcacagctatctagaatctcagattttgctttgatcatctaaacatggagccatttacaattctattttataagattgtgaccttcagatactatatttttatatgtggctaccaagtttttggagttaactagcttatggagcgttattcacacattctttagttttcacaataagtgcatgagatttgtactgttattacccattttgtagatggggagaatacggcacacagcaattctgcaagtggactcaggttttgaattctgatgccctgaatccagagcttattctcttaagcaccttgttattttcctgtagttaggctggggtggcttagatgtagagagttaatattctggaactctctgggttatgatatacttaaaacaaattctggttttatacaatttgcagaaatgatgtgaaggaaattattaggttaactactgaaactgtgatagtcctcgtgtgtttagtttacttacagccttgaatgtctgggtgttgtatatgggaaatatgtggagctatagcacacaaaaacctaaactgggtaataatggtatcaagctcagcctgaagacatacctgtctgtgtggtgtgattagcctatttttgtgtctggaatgtgcatagatttttgtgtctggaatgtggacagtaattctggttttactactgtgcaaaatgtgctactttagtaaattacatgttttttctttgactcaaaactgaaaatatgtaccccttagatggtgaggtaggcttgtaaagcagttagaaatttgaaatcctctgaaatataataattctaatattaagttgctgctgttgtcatctgaaaggttttggtaataagaataactagtt

SEQ ID NO: 81431 - DNA, 1068 bp, Homo sapiens
agatacatccctgaatgaatttctcctgtaaattcacgctatggacacacatttcagactttgaaaagtcatgagtaaagaaattgtataactttttgatcggttgtttcctaaactgatttggccacagaatccacattttatgcaaaccatagagactgacctcactagaatgctatcctttaagcttctgggggtgaaaacaaccttcccttcagaagcttgtttctgaagggaaaaccaaattcacgcaattaaagggtttaaggtagatgggcggcatttctgaatttacaaatcctgttatggtgaagatcaactgtatttagcatatgacagctggaggcaatgttttgtactctttagaatcagataacagaaagatagttgtttctgaaaaataggagactctgactgccatataatagacaagacctaaagtgctatttaatgatgttcatagatttatttcaggaaaggggcaagttaactaaaaatattttatttgaggatgaactaactctggcttatggaatattaaccatgaagaaaggggtgatggagtgaggtggtgattcacacacatgaaatttaagtttttggccaggcgcggtggctcacgcctgtaatcccagcactctgggaggccgaggtgggcagatcacgaggtcaggagatcgagaccatcctggctagcatggtgaaaccccatctctactaaaaatacaaaaatagccaggcgtgggtggtggcgggcgcctgtatgtagtcccagctacttgggaggctgaggcaggagaatggcgtgaacccgggaggcagagcttgcagtgagccgagattgggccactgcactccagcctgggtgacagagcaagactccgtctcaaaaaaagaaatttgagtttttatgctttgatgccgaatatgtgaattgtggctagcgttttaacatagtagcagtaagaacattttctcagacttgggcttttgtttttcaggccctgaagcagagaccacgatttgtagctttaaagaaacaacctgcatatttaggaggggagaatc

SEQ ID NO: 81432 - DNA, 1808 bp, Homo sapiens
atggcattttctaggggcaggaaatactggagaaacttaactgtgcttcctcctgaatagtattgaaaagtgagggaaataagaaggaaattactcaaaggaatatactacatcgtttaaactgtgtagaaaattaggtgtacctgagatgtataggggtatggcttcatcattctccctttcccaagtgtgatcttctttgtttctgtattttaccctttaaactagctagtttgtagaacacagaaggtatttttagaaattatgtctttttggtgaattaaatgtcttgttttttgaatcagttaggttgcctttaactcataaattacttttagttctttctgatttgctgattaagcacatattatatatacgtgcaaactttcagtgtccttattttccagaacctttttataatgtttgcaatctgatgtcttacatgtaatcctaatttcctgccaaaatgactgtattctgtttcccaaatatattttcctaactctggctgtttcttcaattttaaatgtttttcttagatattctttttccattaatatcctgttgaaatctagcccattttgtagagtagtgtttctcaaactgtggttttaaggtagtgcttcccaacctttttggcactagggactggtttcgtggaagacaatttttccacaggctggggaggagggagggggatggtttctggatgattcaagcacattacatttattgtgcactttatttctattattattacattatactatataatgtagaatcagtgggagccctgagtttgtttttctgcaactggacggtcccatctgggggtgatgggagacagcaacagatcaccaggcattaggttctcataaggagtgtgcaacgtagatccctcacatgtgtagttcatagtggggttcatgctcctatgagaatctaatgccgttgctgatctgacaggaggcggagctcaggcactaatgccagcaatggggagcggctgaaaatacatatgaagcttccctccctcacccgctgctcaccttctgctgtgcagctgggttcccgagtggggaatcctggtctggtctaaggaatacctgagtcagaatctccaaaggtgtttgtcagcccttttccatatattgtttagtatatctagggtggggtccacaagtatgatctgtagcctacccctgctttagaccaaagtgtatttaaaacaagccccatgcacctatacatgtaggtctaggaaatagtgtgggtggcattaaacaacccagtggcctgcagtggaatggggtgggccagccacaggattcaccagcggtgctgatagctttctctattgatggagtctaaggttacatgcttgtcttcactttttacaaagcctgtcttctctgtgataaaagatagcctatggaaggtgatgtgaaaagcctaaaggtaaagagtctgacaaggctgtcatagtaatccaagtctaggtaggccacttgttattctgctttttatggtttctactttcttccttatgttgaaagctgaagtaattgcagatgagaagaaatacatttgaggcttatgaatgacaccttgcttggctgttattgtgaagcattggtgtcgttgctgtttatgcacattctgtgttttggtgaactaatgatttttttgtttttatttattttttctttctgcagaaataatagtgtaatccttgctgatgaaatgggcctaggaaagaccatccagaccatatcattcctctcctacctgttccaccaacaccagct

SEQ ID NO: 81433 - DNA, 1052 bp, Homo sapiens
ttagctgggttgcaatattaaatttttcttctctctgccctttttacttctaagattgctttatatgagataatatggagttaatactttgtgtaatattaatattatttttgctttctcaatagacatattactgaaaataatcattcttcgaatttcttaatttcttaaacagtgaggttgcataacttataaaaaaggaataaaagtaaaggaaaacaagctattttaggactgtagaaataagaattatcctaaactgttaccaaactttatttgggcatcatgaatttagaacacagtgacttaagtttatctttgtttagcagatcttttctttatagtaactttttttaaagcacctactgtgtgctagatgttgcgctgggtgctttacgtataatacctgtaatcttcatgatagtcttcaaagctgatggcattctttcctgctactgatgaagaattgactcagagagtcttaacacgcgaccctagcgagcaagaatgtggcagagctcagattcggacacaggtgtttctatctagtctagagctttgctctttcatcactgtatataaactatttctgggaaattgcttgtaataagagcaagccattagcaatgtttaaatatttgagttgcatgttgtaaccatatattttcatacaaattcaaatttatttttggtaaatactttcattaaaattgtgtaacttaaacactggctgatttcattggcctaattttgagtttctaagaatatagttttagctttgttaaatcattagttaaccgttaaagacgaaaaaagagaaatttataggtttacaaaatagcgtaaagcactacattccaaaaatgattgcaaacaaagaaaatgaactctaaaaaattgtagtcagagaagttttccttgctatctccagttctccttttctttgttctttttacccccacttgggggcgatcacctgcaggcacttactgtcttgttctccagttcctaacttgacagccaaactgcaagagcgttgtcatgagtcttcg

SEQ ID NO: 81434 - DNA, 1782 bp, Homo sapiens
ccgcctttctgctaagaaatatatgtggtaggtagatcccattggtattaagtgcaaacaagttgagtttggtggctcttggtgtttgtgtgcttcagggttggggtggagaataggcaagagaaggaccataattaaggggagaatacagaatcatatggtttttttgttttatttttgcccagcatagcaatttttgtgttcttgctgtggggcatgcagtaatagctggtataagaggcccacctataccttttagatgatgatactctcttttgaatagctaccaatctggcaactaacagaataaacagaagaggcctaatatatattgtcagtgaagaataaatgtgtcaatttatacctttgtaatggtatttatacagagataattaacacttgaaagcacttgtgggttcccttctgacctggtggctcgttctgttttgtttttactttagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtaagctccttcctgtgtatttcaaaagatgctagaatgtctgaaatgccaatgctttttaactttcttagtagaccttagggaaaacagatggcatggtttggggaaagcaaagcgtcaaatggaggcagggatggcggtagtaaaatgtttcataatcaatgaaagaaggcacagaaattagcctgttaaggaggaaagcagtattgtctgctgaaaggctgaattagttaatgcacttgggaaataattgttaaatagataacatcagaccttttcactgttggtataagataatcaatataagtaaaatgaaatatacaaggtacacaagcactgaaaagtatgttatactcaaatatctgataaccgaagcatcaattttacatcttattcacgtattattaaagaactatggaatgtgtttattgaaaagatttttatgggagagatgatatgcacatttcataaaacttaaaattatccaatggtattcagcgatacttagaataacatctatattcattaatttggaggactccactcagtctggccccttgacaatagtctgattcctctcatccactttctccattactcattatgcttcagccattctggctatctttctgtcccttaaacatgccaagccattactattccttcttgactagaattatatttcttcttgtcttcacatggccaaccaccttaatgtttcagctcatcttaaacgaccacctcctttcagaaatcttttgcagattgcctaacctaaagtagccctttagacatcttatccctaacctgttttagtgtctatatagcatctctttttacatttatgttctcattcatctcatgtcattaaattatgtatgaaaatcgcagggattttgtttgcttgattcattgctggttcccattgtctagaatagcacctggtgcacagtaaacaattcagttaatagttgttcagttgatagatatatgctctacaatctttttttttttaattcaggattaaattttattttttacttttatttttatttttaaattttaaatttaaatttgtttagtaactttatagtttgcaaccatcatcattgtccagttttggaacattt

SEQ ID NO: 81435 - DNA, 2995 bp, Homo sapiens
ttttactcagtgggtgttcaggtgataaaggttccaagtctgctgttctattctgagtgtagctgatcttcctatcttacagttttcttgtggtttatttttacagcgtctggatggttccatcaagggagaaatccgaaaacaggcactggaccacttcaatgcagatgggtctgaggtatactatgcatggctttgttatttgagcaacttgggctctgcatcaaggggaaagtctctctcgcttaatgtattctgtttcagaaacaatttatagtgcaattcttttgccttgagaagaaaatgagaaatctctcatataaaagatggtgttttgttgtcactccagaaaaataaatatgtgcttatttatctcccctgttctgggttgacaacagagtggttctcctggtagcttccagataccaaatccttgggcgtggaagagcagtaaggcaggagtaggggagagttgggcaatagaattaatataagaaggttctgatctctgtactcttttggtgactaagtcctgaaaaatatatttgccatgtctcaaatttgttggacttctgatacagtgtggcttaatgttcttgctctcgctaacagcaacattttacaatcagtgtcgagcttggatttggcattatgaagtattttgtttggggggcacatatagaagagctacttaggatgaaatagaaggtatgacaacattgtagtttgtgcatatcaaatcatcagatgccatgggatttgagagaagtgggagagaaaagttttggtgtgaataaaactgtaataatgtgtagagctaaaggaagcagtggagacaacctgaagtagaagtgtttcacagagaatgctaatttctggagcctgagccactacttttttttttttttaaacagatagaacagacttagctttctgaagagctttaaaaactcttgatgcctgtgcctgttactacagaatgctctgctgtctgcctttagagtgtagaaatcctagttagactagtattctggctacttctgtagtctaaacatttacttcttgaggggcttggggcattaatctattcagagccaaggctctcgttcattaaggataagaggaatggaataattaaagacatcggtcatcaactaattcccattcctcctttccttgctccttgtttcctcagctgtaaaatcacaatgattctgataccccacttcataatattgctctgaggattaaatttggtaatcaacataaagcactgatcacattgcccagtgcatagtaagcgctctaaatatctgctatttttatcatgtagtgttggttgaaattggttttgtgttctccactcttagtttaaaaaatagtatgagtcgaatgtttcatattgccctgtctcaggggaaaaaaaaaattgctttttgcatagctctcagttgattcccactcactatgatggctatatagaacacaagttctctaccatttctgcagtattttaaaaattcctttaaaaaactaaatatttattgtgggacaaaatattatatgcttacttagaatattgggaagatggtaaagaatacaaagaaaaaaacaattgtacccctcattctagacacaacttgctgttcacgtctttggggtgtatttccattcctactagatggaaccatttatatgtttacctaattcggatcatgttgcatacagttttgttcccttcaaaattatactttgaggctaggcgcgcatagtggctcacacctgtaatcttagcactttgggaggccaagatgggggaggatcacttgagaccaggagtttgagaccagcctggtcaacatagtgagacctgtctctaccaaaaaaaaaaaaaaaagtttccccatgttattaaagattttacaaaatttaatttctaggcccatagcaagaccctatctctacaaaaaattaaaaaatgagccgtgcatagtattgtgtgcttgtagttccagctgttcaggagacaggcaggaggatcccttgagaccaggagtttgaggctgcagtgagccaggattgccccactgcactccagcctgggtgacagaatgagaccctgtctcaaaaaaaaaaaaaaattttttttttaaatttctaaatttttcttatgcttgtaccatttatttatttaactaccttaccgttagtggcattgagttttataattttttaacctttttcaacttgatcatagatgcagacgacatattataatccacgttatccttgctaaagagtgatatagcagattgttggttgataggatctttttgactccagatttcatttgttttagatatctcatcttaaattgtccactgtttatctttagacttctctttggagtgtggtggtgcttaatatttctcttaagaatcacagattatgtgcctggacactcctgttgatcacttctttattggaattgtttaattaaaattcttgtgaagcagctgtctccatttttatttctatggcataatgttgttgaatgtgactattagaacatggagaccttttcattgcatctctatgtgtatgctaaatatacccatttatcaagatggaactcaggactaccagtttttcaatgctgcttctctctgctacaaaggcatcagcttttgacatatatgattaaattccctgaaaatagaaatatttcaccttttccccccggcttatatattttattctttttctcctgcccccatatttttctgagcactcagacgcaggcaggtgtgctgtgcttgcccagtgtctactgtcattgctgtggatactgcagtgtcagtgcctgggtggttccacacatcgctctccagccaaacctgttttgatttttttataattttggcatgttttgtggtaattgaggatcctgtggttctcaacacttaccatatatgatctctttagtgcagtgttt

SEQ ID NO: 81436 - DNA, 1768 bp, Homo sapiens
aattgtttgtctgtttttattattgttgctgttaacttcttgtatattagttgtagccgggaggtagcactaattctctcactcccattgccttattagagtctactctactcctgttcatggcactgactttgcctcttaatcaaatgaaaattcattctaccatcaagtccctgacattcttttagcctccataaagtttgtccatcatatctcacttttcttcacacctgcaggggtttccaggtgtaagggcttattggactgtgaaactgtttctgagaaggccactgcataaagtagtatattgcattgtgtacaggacttctgtttcctgctctcgacaagggctggtggcctgggaatcaatttggcttcagcggacacagtcgtcatctttgactctgactggaacccccagaatgacttgcaggcacaagcccgagcgcatagaattggtcaaaagaagcaggtcagtatggagaggcttctggaaattgctttagggttgggggccagggggcttgttcagccctttcaggatgttaataaaatgctttttccctgttttgcttttatttcccctgaagcattgatttctgtttgttaactagcacagagatgttgtctttgggcccaagatgaacctattaaggaacttttctttttctctgtttgaaaagtacaacatcagcgaccttctatgtgtttatcttgagagagatatatgatgaatagacttagaactgaacattttctctattttagtatggaaaagttaaatatcctattgttcaagatggtttgtttttattatacatgacagtgttagctttaaaggtactttggaaaaccacacacttttttgtttatgaatcttaaagtctgttctatattggataacccgtaagtttcattcttggccaaagattctgtttttgtggaactttccatcactgaagcacgatttttattgatggaacaggccataacgacagatctttagaggcaattttatttaagactgtaacctgctgcacatagtaaaagtattgcatctacttaagctgcctgcttggatggcttacagtcttctatggttagagaataaattctgttaaaattttcccctcttgggttttgacagagctaatccttctctctttttttgggggggttggggggtggttcaggcataagcataacagttccttttcctacaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaagtaagtgccaggaagattgggaggtaggcagaatcaaattgattctacatcactgttggatataataggattttctaccacagacattagtctgttcattacctggaagatgccaggccagaaccacaaataggatagcattttcactttgagtttcttggttcctttttttgcccatcaccccccttcttatgtgttttcctctctttcttgccctctcccttacctttgcttttggctgctcatgtgacatatgacacagcaacagcagtggagttgtgtgttgggtgtcagcctagcataatgtcacctttgacttttctgcagtgagaatccagattggattggcagctgttttttttttttactattggcaaaaatgtttgtgtggagatt

SEQ ID NO: 81437 - DNA, 1099 bp, Homo sapiens
gaccgataataataataataatatcaaaataataatatcaatattatcaagataataatgatatcaaaataataataaaaataagtttacattttgagcagattgttgagtgtcttctgtggtggtgtttcagctatgttttttgtttgtttgtttgtttgtttttgagatggagtctcgctcggtcgcccaggttggagtgcgctggcacgatcttggctcattgcaacctctgtctcctaggttgaagtgattcttgtgcctcagcctcccgagtagctgggactacaggtgtgcaccaccacacctagctaattttttttttcttttttttttttttttttagtagagacagggtttttccatgttggccagactggtctcaaactcctgacctcaagtgataggcccacctcagcccctcaaagtgctgggattataggtgtgagccattgtgcccgctgcagctatgttaaaggtgtattcaaattagcccttcctaaataaaatgttttcagatagttttctgtttaagaggaagctagatgagaaaagcctagctcttttattttggaccggggttgagaaggttgaaaattcttggtgaattataactttctgagtaaaaggccaaaggaaagagctccattctataacattgctagtcacctttctggcttacccatgcaataggtgaaccagtaggactgtaactaattttctattctgctggtttagggttaccatcacagactcatcctgtagatagaaaatgcgatgtttgagaaatcatttttcttgaggcagagtttatattttcagcagttaacttgacctctttctgaaggatagttattctgaagtagaacactttagaggttatttgatgtttctaacaactacattttacttccacagctcaaatccttttaataaagaagagctgacagctattttgaaatttggagcagaggatctcttcaaagaactggaaggggaggaatcagaacctcaggtaattaacaatgaggagagggaaatttttttgagaagtatgatctgtgagagtctaacttttctgtaagaagattctgttaga

SEQ ID NO: 81438 - DNA, 1052 bp, Homo sapiens
actagctaccatttattgagcccttacaatgtgctaggcatacttctaagtgctttaacttactgaaaaccatctgttataggtactattgtcttcatttttcaaatgagaaaataaaggcacaaagagtaaaattacttgcccaaaggagtaaacatgaacctgttttataatgggatattgtaaaaatattcatatatttttaatccagttcacttatcgttatattacaatgtctctgaaagtatgactgtcctaagtgggtatttctccaagacctgtctccccttatttgtcaaaggaaaattgacttgtctgatatggtgagaagttctgaatactaaagaattaagatggccttctcttagtcctttcaccacttgaacttcgcacttgttacagtgtgactttgcctcgatctttctcaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttggtggaggctctgttctcactgagcttgtttgaaagtgcgtactgtaagtcttgggttgactggatcctggacatcgtgacagggtaggcagaggctaatacctacaaaaaaggaaagagaagctgggtcctgtcccagatctgtaggatgatccttccttctccaaggtttctttctgttgagatcacttttatttgttgttcatctctctatttctctcttattctctggttattcagaacattttcacaaagttcagctcggggaaggagataattgacatacatgtatatacagacttatgtatctgtatataaaagaaatatcaaaaataaaaatggtacaaataagtctaccctcactacctctcccctccgccacaatcccacttccacctgtgttagtactgacatcagtttgctagtggtttgctttgatttataa

SEQ ID NO: 81439 - DNA, 1373 bp, Homo sapiens
aggccaaggtttgcagtgagccgagatggcaccactaaactccagcctgggtgacagagcaaaactctctaaaagaagaaggaaaaaaaaaaaaagatggtatcttaaaattttttaaaaatattttttctgccaatctcttttttttgattgcagtatttaatctatttacatttaatgcagttattataaagtaggaattatgtctgcattttgctatttgtcttctatatgtcatgttttttttgtttatttccccattactactttcctttgtgttaaatatataatataccattttaattaccttaaaaaaaaaactttttttttcacttattttcttagtggttgccctagaaattacaagtaacatcttagaacaatttactttgaattaacatcaatttaatttcaatggcattataaaaactttgccccagttatagctcaccatccccatttgtgctgttgtcgcacattacatctttacacattttaaacccatcaatgcagttttataattcatactttatatagttagttgtctcttttttttttttcttttgagacggagttttgctcttctcaccaaggctggggtacagtggtgcaatctcggcccactgcaacctccacttcccaggttcaagtgactgtcctgccttagcctcccaagtagctgagattactggctcctgccaccacgctggctaattatttttgtatttttagtagagatgggatttcaccatgttggccaggctggtcttgaacttctgacctcaggtgatcggtgtgcctcggcctcccaaagggctgggattagaagcgtgagccacccacacccagcctagttagttgtcttttaaaatcagatagaaggaaaagagttacaaaaatgcatgtatactgtttttatatttacttactctattattccatgggtgctcttatttcttcatgtgatttgagttactattttatgtcctttcatgtctgcccaaaggactctcttttagcattttattttgaggcaggtctgctaacaatggattctctattttggcttagctcgcactgttaatttcatcttcatttttgaaggaaagtcttaatttctttttttctgtttctcacgtgggataatctcaattggcctatcttcagatttggcagttctctcttcttcaggctaatatctgctgctgagcctcaccagtgattttttttttcatttccgttattgtagttttcaactctagaatttctatttcactctttaaaaaatgtccgtttttaaacagcatttctgtttctattgatatcattttcgacctttctttttaattctctaggcagactttttttaactc

SEQ ID NO: 81440 - DNA, 1073 bp, Homo sapiens
tgtaaatatttataatagctgattagcatccttgtcttataagcctacatgctagacttccttagggatggtttctattacctgctttttttcctatgtatacttcatacttcatactttttttttttttttttttttttgagatggagttttgctcctatcacccaggctggagtgcaatggcgcgattttggctcactgcaacctccgcctcctgggttcaagtgattctcctgcctcagcctcccgagtagctgggattacaggtgcccaccacaatgcccagctaatttttatatttttagtagagacagggtttcaccatgttggccaggctggtctcgaacgcctgacctcaggtgatccacccgcctcggcctcccaaagtgctcggattacaggcgtgagccaccatgcccagcttactttttggttttctatatgtcccgtaatttttcccgtgaaaaactggacattttaaatcatatggcaactctggaaatcagatctcccctcccagccatgtgttgtgtttgccgctgctgttgtatttgcttgtttagtgactttcctgtactagttatctgaagtctgtattctttgtcatgttatgtgatccttgtcatgctatgtgtagtctctactcctttagcttagtggtcagctaatgattgaacagagatttccttaaatgctttgagcctgtaagtctaccagcctttgttgaagggctgggtatgtgttgttggggcacgtttcaatgctctggaaggcaattgacaactctgccttaactttcagttcctgcttgcacagttgctcaaggtctttctcaggctcagacaaatgacagtgactctgacagtgagtccaagaggcaggcccagagatcctctgcttctgagagtgagacagaagagtctgatgatgacaagaagccaaagcgcagagggtgtcccaggagcgtgcggaaggaccctttgagatctttcctctgcatggacacagacctgcacatgtcagagcttttcagagtatctatcctatgaacatctttcctcccagtttttctt

SEQ ID NO: 81441 - DNA, 1198 bp, Homo sapiens
catctgtccttacatggttatataacccaattatcatagtaatttggcatattacatgatgcccttaatgtgtcatgaagtcctggtttttagtggaaagtactggtgaccagcctgtaggaatggggatgatggcatgagttggtatgtagcatagtttagggtagagacttgcaggaagatagattggatttttgggaggagaggtcagtagagtttccaaaattgtttgcctaagaagttttaaatcatattttactgtgccttattccaaaaactatttgagacagtcaaaaaaatcttaacagctgaaaaatcattggttttctaataacgaaaaatatggtattgaaggtaacagtggtgaactgaatacgctgatgaaacgatataagggtttgtcacaatagagtcgtgatgattgaatcctttatgacacagtgaagtctataaacttgtatcttctaaaaaggatattagagctaagtcacagttctctagcatgttatctaagcaggtttatgtacagtcactgagaataaagttgatctttaatttgaatagatttttagcagtcattattttaagttgactagtttcaaagacattcaacatttattcatttttttggtagtgcaaggattgagtccactctatttttgacaatttgcatggctcatatgtcatcacaggatatgctagcatcaacataactaaagtaagtctctgtttttttaatatgttttattgatcctattcttaggttcatcaaggcttataagaagtttggtctccctcttgaacggtaagttcagtgtaatagtcccttatcttcctcttttttgcttttattatatagtacgttcttttttggtaaatttttccatttaatactaatgctgggaacatttttttttctggaaacatttatttacaaacatttatatattgggtgcctgttcattcatgtctctctgcagagggatgacaaagatgataaagacaggccatccataaaaagactttcaccttcgtgagggagataaagcaagtatattcaaaaccatagtgcgtgaaataatttccagagagatgttcatgtaactccagttgaaaagaatgtatgtagttattatttgtatcctagttcttagatttaataatgtcaaaggtaaaaggctctttatgattttataat

SEQ ID NO: 81442 - DNA, 1052 bp, Homo sapiens
caattctttatgatggaaaatgaatgtgttagccttcagtcaatgtccaggggttcttgttggagccttagaatgaccactaaaggaacgcaaagaaaagtgtctttgcaggagaagattatgtgaggcctagtggcatctcatgacacttaagaagagtgggcacagggtcctaaagtgtccccatatttgttcctcctcaggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggtaagcgaagttggctttagtgagtcttcgcaacctggcactcttggactggatttctgttgctaaagggcgttttaaggacaggcttgaggaccacacatgcctagtgatttcaggtgtttattctgagctgcgtttctgtgagcttaatattctactctcctacaggtctactcacaaatgaagttgatttgcagaaggtgtagagtgaagaaaaagatgaaatggtttttttttgtgttgctgtagaaagtttaaattcgtcggagtgatgtaaaaacccaggggcagagcttggtggacacctctgtattttggctgcaaataagaggtgttatagatcacaagcattgttaattatcttggatatatattgtgcgttatggcaaacacaaaggatttagagaattaattggaataaataaaatattggatgagtatcgtaaacatttttgggttacgttgagattttcatgccactagaatttgttctcattggattggacatgcagtgtgttttctctttgataccagaaagtgattttgcctgtcctgtgtgatatctttaaaagcaagaggtataggaatgcttgtgaggagagaactctgaagtagttattggtaaggacaccctcatagtgaactttaaagaaacgaagagaggccaggcgcagtggctcacgcctgtaatcccagcagtttgggaggc

SEQ ID NO: 81443 - DNA, 3294 bp, Homo sapiens
aacacttgagagttttttgaccttcgctagtgggatgggtaggaaaacaaaaagagaaaccttcagcactaatattataccctcagaatctacttttgttcatttggaaacaaagtagtataaaacaagcaggaagattaaaatacaactataaacatcagtgaattaaaaaagaattccaaatcttaaaagactgaatgttcagaggttattttacagacattagttgagaaaaaaatttgtcttatagattatatcttcaaaataacaataagccagagatatattcagagagactaagaggtcagggttcgttgatacatgttttctgtggaacttctgcagattttcatttaactaatgtgaaactggtatttttcaggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaagtgagtatattttgtgtacatgcttagatggtcgtaccgtaagaaaatagatttgaagttagactttgtgtagttccatagtatttttactgtctcttctttaacataccaaaaaggcccctcttctaatgtcttcctgtttttaaactttctttagatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaagtaagtaaccctaccatgctagagatttctagaagatttgttgtgtaatatttttatatcgattacttatttctaactattttcgagggggcatcaaattagaaattagtatagtcattcttggaaatacttccatctttagcagattgtggcactgtttcacggatgaagataaagggaaaagacagtagccaggtgaaattttggggaaactgtaggagaaatcttaaaattctggtatttaattataggtcagatttcattacaataaatacccaggtgagtttgttaatgataaaagcattccttggccttagttattggccctttgtttaaaagtacatttgaaacaaccatatttcacttcctcacgtaaagattgaatgtcaccttggtattctttgtaatggaattaaacattggctgttcttctcccacaaaatcgagcctcccaccctatctgttgcaagtagcaaggccatggttggagctataagcagggaaggctgactggctcaaattttggtaggatttgctccatgttgtgctcctggcagttcaacagtgctcatcccatctggttttaggagggtgacagcaccctgccttaagcactgagaccagattcagtctggcaagagacccagttgttgtagcaaggaacagatcatgtcctggcgtagctcagtgctctccggcaatgctctaagaagcattttcaatctaaaacgaagctttaacctagctccagggattccctgctcctggaaggaggaaatccacgacggctgggatgctctagcagatgaagccacaagcccctcctacctgagttgttctaccctgttaacagcacaggtaggagccattgggagagctggatttctccatcccattttgtaaaatgagaacggctcgtgagggattttcagtgactgggagccatggacatgagataggatctgaggctttatctatattttgggtggttggggagggaaaggactgtgctcagtttttgttgtctctgtttatcctgatccactaaccaggatgtgggtggtggcgggtgcttctcttcctttcttgttgaagattctgccggtggagacagataaaaagcctcaggggaagcagctacagacccgagcggattacttgttgaagctgctcagaaagggtctggagaagaagggggctgtgacaggtggggaagaggtgagtacgctgccagctggttgtttttcaggggcctgaggctcctaccctgcagaattaggtaggaagagagaggccctctctgagcactgcacagaatgtcaccttctcatgggcatattttgtttttgaggttccagtaatgatgctttgcttggtaataatagaaatgttcatttaggcctggcgcagtggctcatgcctgtaatcccagcactttgggaggctgaggcgggcggatcacaaggtcaggagattgagaccatcctggctaatatggtgaaaccccgtctctactaaaaatacaaaaaaattagccgggcgtggtggcacacgcctgtaatcccagctacttaggaggctgaggcaggagaatggtgtgaacccgggaggcggagcttgcagtgagccgagttcgggccactgcactccggcctgggcaacagagcgagactccgtctcaaaaaaaaaaaaaaaaaaaaaaaaaaaaaaaaaattcatttaagaccacggcatcttggcagctttcttacaaacccatccttctgaaatgttgcttcaaattcatcctctgctccccagtcccactattccacacatactgttactgtttctttatcctactttctcaattttggaacatagttgcagttactgcattgaatacctgtgggtttgcctgttgttctgtctgtctctgtggttcttgtaatagtggatcccagagataaaatggacagttgtaatgcacagttaattcagaaactagaccttacttgctgtgtgaaataccaactaaattctcagtgaactcagctgagctttatctccttttgtttccccaatttataatttcagttcaggcccagaaagatggaatcccagctaagaaatacaagttacaccctgtactagcagcccatgtgtgcatgttctttaagtgctcttgcagctatgtcatttatattgatttccctgtattattataagcaaagcaaatttgaggaaaaaaacccataataccacacctcatttttttcaagtaatagggtcataagtctcattcttcatataatatgttgagtatgcaatatattatgtgttaggctctggaaaggcagaggttagatcatgttacagatcatatctgattaggcagataaacagtattttaaccttttccttattatatgtaacttgctttcaggttttttaatgttactattatgtctttaatatattatctt

SEQ ID NO: 81444 - DNA, 1067 bp, Homo sapiens
gtcaaactcctgacctcaggtgacaggtctgcctcagcctcccaaagtgctggaattatgagcatgagccactgtgcctggccaatacatacgtacatttaaatactagcaacctaatcagttattagctgactttgtataggtatataatctctttggtactcagtttccatccgtgaaatgagaataataaacttacgttgaagggttgctatgagaattaaatgagaggatatcagtaaagagcttctgcctctacagttgtaactggttattactggaaagtttagacttctctgagtcccttgaggctatttgcttgaaaacaagcttctaagtatagacagtgatgaaccactgggggcagtgcttctttttccagaaagtacataagtagatataaaatttgtagcaaaaattcatagccctgttttgtttcctaggatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaaggtaatgatgcccttctgttcatgcagatatccacagcctttgcaattcgccatttggatttagaagtagaatgagatttgagggccctggaataattgtctttttatgggtatgttcaagaaggatgggtggggccgttgatgggatacctgcacctgtccttgcagagagaggggaacctgcaagtttggggtgttctttaaaaaagaaggcctttacttggtcttttatgacatatttcagggggaaatgtttgaatgagataggacaggtgagagaaatcggcatttacatgtaaatacgaaatacgttctcagattcatattagaggagcacaatccacaactgaatttgaatacttgaagagtttgagtcaaaaacaaatattagcaagagttattggaatataaatggatgaaaagccttgctattataacctttacattaggggttttatgaagttcattctaaaccaaagaattt

SEQ ID NO: 81445 - DNA, 2255 bp, Homo sapiens
agacctgcctggacaacatggtgaaaccccgtctgtactaaaaatacaaaaaatagctgggtgtggtggcgtgcgcctgtaatctgagctacttgggaggctgaggcagaagaatctcttgaacccaggaggcagaggttgcagtgagccgagatcatgacgctgcactccggccaggatgacagagcgagaatctgtctcaaaaaaaaaaaaaaaaaaagtacctgaagtcattttatatattcttctgcaacctttccttcaatgtaattgagatttgtatagagttcatttacaataatgtagttaatacagattcctaaaccaaagggtatgctgttaataaaggttgctacatgatactctagagagttctgccaatttacaagcttaacctcttgatgacatttctgtgcattttatggataaaggagtaagaagcccaaaaatagcactgatgaaattgaagttataattgggtacatttagagatggaaatgggaataatgtgtgagtaagctgctaatcagacaggtttgtcttcatgatgtttcaggattttattttactttttaaaaaataaactgagaccatcatatttacccattttaataacacaacataggtaagaaacctaaatcgcacggtaggattgcacaaatgacaatgactccttgtaactcttttttaaaagcctaaaagtggtgatgccaaatcttcgagtaaatcaaagcgatctcagggtcctgtccatattacagcaggaagtgaacctgtccccattggagaggatgaggatgatgatctggaccaggagacattcagcatagtaagtcttgaaatcggggggtgccagtgtctgcagccgcggtacttgctgtggctctgccttttataggtccagccagagcttcagttgagctaagcaatagtacattacttgggaaacacattgcttacagtatcggaagaccatgtgctcttcagcaggctggcaggaagagattttcttgtcttttattgaggggaagtttaaggagtggatttcatgtcttgtgctcctagttaagagaggctctcagggcccttagaggcatttgggaaagagaagtgttcactgagcaagtatttattgaatgttttctgtgttccagcccccagagttaccatgttgaatagataaccatttctatcatcgtaaactgtacattggagtaggggagttagataactacacaaatcatgttggtgcccctgtgacagggctctggaggagagagagtgcatactgtggagatcctgtgagaagggaatttgacctagtcaggggttgccaggagggcttgtgtaaggaagtgatgtttgagttgggttctgaaggaagaataaaaggtaacaggagaagaggggagggcaaggcgatggggagcgagtgcatggaccaggtcttgcacgggattggatacaggccagtgtgtcctcaaggtccctttgcccctggctggagctgcaggtatagatttcactgtgccaccatcccttccccacctctctgtggtctcttctccccatacttccacaaatccattaatcaaacggctcattcaggctgaaagaaaaagcggttttctttcaaatttgaaaatacttccatcctgtggcagcaaaggaccctgttgaccctgtcctgtaacctctctctgacttctttctctgagttctctaaaacctatacacgtatgtatatagatattgttttctttgcacttaactctgttttcttaagtctcttttttgcctgtgagctctctgaggacaagtattgttttatataaaggtcatttagatgctagaagtatatcaataaatgagtaaattgaataaatgaataaactaattacatagccagctaaccaatctgtttcctagtctttcttttccgagtgtttataagagaaaatgatatctaatgttctatggtaccatgatatttaaaaaatgctcttacaaatgactcatttaatcttgtttttatattatgaaatctttaaaagatgcagagaaatttcagggatataatagtcattgataaatataccatgaagttttgtcaaatctgaatttttttaagactcaaaatataaagctgaatcccttggtgttcctccctctcaacctatgctttttctgtctctctctctcttttttttttttttttttttgaggcagagtcttgctctgttgcccaggctgga

SEQ ID NO: 81446 - DNA, 1043 bp, Homo sapiens
cctgctactcacttgtgagaggtgctcagaagttgcctctcctttggaatagggggatgggtgcagaagtgacatggaggaggctgcagaggcagtgctccttgtgtgggtgtgcccatttgcagatctgctgacttgccacatgggctgtacccaagttggacattgagttcaatctgtgagcattaaataccacctccactaatgcgtcagctccatgaagacagagattttatgtctctcatctactgctgtgttctcagcacatagaatggaatagaatggtgctggggacagggaagcactcaggagtatttgttatgctgtgcccagtgctgtgttggcctgtgaagcagcaccctcaagtagttgatgatttaattttacatggaagaatatgttatagcagtaacatacaggaatcatatactaataagcattataaaaagtctataaatggatagtccggaaaggccccaggagggaatgaaatagttaggaaaggccctttagaagggagtgaaaattaggaagagggtctgaagttggacacataatcatgaaagacttcattcatttagggatcagaatgaataacaaaacagtataagctgaataacaaaaacagtggtatcctactagtgggagtatacattgtcacaacctttctggaggagaattcagcaagatttattaaaagactaaagcatgcagttttgcttccaggaatttagttttgagaaggagatagagatttaaacatgtttataatggaaatggcttggaagcccaacagtaagaaatacattcaatgtggctaggcgcggtggctcgtgcctgtaatcccagcactttgggaggctgaggcgggtggatcacttgaggccgagagttcgagaccagcctggccaacgtgatgaagcctcatctctacataaactacaaatattagctgggtgtggtggcacatgcctgtagccccagcccctcaggaggctgaagtgggaggatcgcatgagaccaggaggtggaggtagcagtga

SEQ ID NO: 81447 - DNA, 1058 bp, Homo sapiens
tcggctcactgcaacctccacctcctgggttcaggcgattctcgtccctcagcctcccgagtagctgggattacagatgtgcaccaccacgctgagctaatttttaaatttttagtagagacagggttttgccatgttggccaggctggtctcaaactcccggcgccatgtgatctgcccacctcagcctcccaaaatgttgggattacaggtgtgaaccactgcgtctggcccccaggactattatttcaacttccgattaagaagaacccagctaacatgaacaaacgaaaaagactgagggagaagtttacattctgtatgacagtgaaatggttaaaactgctaatcttgaaagagctcttgtaaattgagaacaaaacaataactgaatagaaaaatgggcaatcaacagagtgaagagacagtttatgtaaggggagaaaatattaccaaccgtacatctgataaggggataatatccaaactgtgtaaggaactcagctccttatgtagcaggaaggcaaatgctcgattaaaaagtgggtaaaggacctgaatagacatttctcaaaagaagacatacagattgccaacaggtatatgaaaaaatgctcagcatgactgatcatcagggaaatgcaaattaaaagcacgatgagatatcacttcacacttgttaggatggctagtaccaaaaagtcaaaagataagggttgccaaggatgtggaggaaagggaacccagcgcattgttgctgggaatgtaagttagtgcagccattatggaaaacaatgcagagatgcctcaaaaaaatcacaaacagaactaccatatgatgcagcagtccctttaccaggtatatattcaacgaaaatgaaatcagttatgttgaagaaatgcctgcacttacatattcattgcagcattatttacgatagccaagatacgtaatcatcctaagtgcccatcagcaggtgagtggataaagaaaatgtgtatatacacaatcgaatagtattcagctttaaaaagaaggaaatcctgtcgttcgcaac

SEQ ID NO: 81448 - DNA, 1104 bp, Homo sapiens
atgtctgtttgtaacatgtgtcaggctttcagtttgaacttcagcaaagtagtgcttacttcagcagcatacctacaagaattggaacaatacagagaagattggtgtggaagaaaacaaaaataaaaaataaggctgggcgtggtggctcacagctgtaatcccagcaccttgggaagctgaggcgggcggatcacctgaggtcaggagtttgagaccagcctagccaacatggtgaaaccctgtctctactaaaaattcaaaaattgggcaggcatggtggcgggtgcctgtagtcccatctacttgggaggctgaggcacgagaatcgcttgacccaagagatggagattgcagtgatctaagatcgtgccactgcactccagcctgggcaaacagagcacgactccatctccaaaaaaaaaaaaattgtagtgaaagtgaaattcatccatttcttgcagtcatcagatcattctttcttttcctgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttgtgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgcc

SEQ ID NO: 81449 - DNA, 3121 bp, Homo sapiens
gacatggagcatcttctcatggttttttttggccatttgtatagcttctttggagaaatgtctgttcaaatcctttgcctgtttttgagttgggttgtttttgttgttgagttttagtaattctttttttaatggtatcatgagcagtttaccatggtccaagctaaaaattttaatactcttcacactgagttggtttttaagataattttattaactagtcactcacttgttgcatatttaggttgatggtgttattaataacttacaaaataatttctgtggctctttttctcatgggctgggtccaggaatatggtaatgtttatggatcttaccagatttttcctaaagggagtgagtttgcaaaagccatcagtaatttttcaagtgtgtacttgtgtcactgcacacttgagccttatttcataggatgtattttgctaataagtgtaaaatgactctgttattaatttttttgattcctaataatgtgagcatttgtccttgaatatgagtatatgaggaagagccaagtgggtagtgaagagaagtggatgggaatctggcttcagtctttcgactaatccttgcatctctatttcaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctcagaaatctcctcacgattccaagtcacccctggatcataggtctcctttggagagatcactagaacagaaaaacaacccagattataactggaatgttcggaaaacataaaggacagctcgtaaaggagagagtaagagtcaccaaacacgtggatatttttggtctgatcctacagtagccggttatctagaccagtaagtggagttttggacatgctgctgctgtcaactcactggctgaaggagcacttcaaggaatgggaggcctttcactgggtccagctctgattcgggtcaccactcctgcactttggcaccccatcccattccagcctagttctggcctcccactttgacgggcacttggaggaggagctgactgtgtgtgtaccagcttcactgggatgtgtttccccagtcaaggaacaggggatcttcagagtcatgaatgttttcttgccagggtcagtgttcccaggaccttagtgcatggtcggggcaggaactggtgcatggaggctgctgggacctggtgaacagtgtgtgatttggttgatttggttcactctgacatgatggatgctgctgatggggagtggcgagttggggcaagcgggtggggacaagcataggacttgaaggggagcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccagggaaggtaggtttctctggctgactgagtactgtgagtgaggcaacactgatgccagcatgggtcttacttgactggggagtaggctgagtgaggggtagggtggggtaggtggggagtagtgtggccagggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagagg

SEQ ID NO: 81450 - DNA, 1040 bp, Homo sapiens
gagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcat

SEQ ID NO: 81451 - DNA, 1115 bp, Homo sapiens
gggtggctctgccctagatgaggcgatgtgtggctgctcccctggcccacagatggtagcagaagctggggttgccaggctgcaccccgacggtgtgttcgttcctttctcctcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaaggtaagggggagggggcggctgtagggcacagccctgccctttgtctctgccctgcgtggacactgagaggctgagagggcctcgggtgcctgggaatgggggaagacggagcggagcggggacacaggagcaccctccctgagcatcccaagggggtgggtctcagcttcctccctccttcctcgagccagcccggcctggcaggcatagctccacttcacaaatggggagcctgatgctctaagaggccaagtgaccttcccaccccaagtgcgtagtcagctggaatgctgagctagaatttgccccaggcccgggtgactccagaacctggcatattctgagcggccccacgaggccactgcgggctgctggttttcaaacccaaggaggcctcagcaagtgggcagcaggactcaggtcctgctcatggggccgcagccacacacacagccatggacccacgcaagtggacactcctgtc

SEQ ID NO: 81452 - DNA, 1035 bp, Homo sapiens
tggtggggggcagatggaagtggaggggcaaggctaaaaccttaaggaactgcctgtcagtgagcactcctgggagaatcagaacactgggaggaaagaggtcaaggagacagccttcctgccacatagatagaacattctggtggatggaaatttccacgagtgcttcagcctttctgcctggcttacacagaaatggatcttagagctactggccagaagatcacctttaccgaaagcatcttgcagtcatcctcctttccaagccgccttccagtaagactcacaatggaaggtccccaacctggagcaaggatacaagccaagtaagtgaaaaaaaggcactgtttctgaagcataaagaaaacctttcacccctttacttttaaaatcccggtatccatgacaactggacggagggtagaaagtggctgtcccctcccctcttcattgtttaactttcagttgctgcagcaactgagtatactgggcccagccagattctctgggtgctttcttctttcttagttccccctttattgtgggccctcctcagtgccaacattgctttgtctctcgctggagaagcctgtgagaacgaggatgggcaaagtgtcaggctcttggtgcagctgaaaatcctttgagatggaagaaatggctggaacaaaggggcagaggaacaaaaagccctgaactgcttcgcccctgcctcgtggggtctttatcatcttaaaccttgggatttgtgagtgtctaacttttcctttcccagggatggcttggcagggatacagacagagtgggcctaggaaactggttgggcaacagtctcagcagagactgcttcccagggagacagagcctggttaacttaggtcatcctctttttcttcattccttttttgattcttcttttttccctccctccctccctccctccctccctcccttccttccttccttccttccttccttccttcctctctccctccctccctcctttccttccttctctccctcccgcttcccttc

SEQ ID NO: 81453 - DNA, 1062 bp, Homo sapiens
ttggctatggactttggtggggctggtgcctcccagctgccaatctggaggcgttcccacagctgggcagaattttgcgccgcgcgctgctgttgctgctgctgctccccaggatgttgccccctacaaatacgcctcctgtgtccgcagccctcatcctgccatacagcctcagccggcgccccagcctgcggtccgtgtgcaggggcgggagccactcactgcctccatgttggctgcagcacccccgcacggaacagaagcagatgctgggagaacgcgtgttcccactcatccaaacaatgcattcaaacctggctgggaagatcacgggaatgctgctggagatcgacaactctgagctgctgcacgtgttagagtcccccgagtctctccgctccaaggtggatgaagctgtagcagttctacaggctcatcatgccaagaaagaagctgcccagaaggtgggcgctgttgctgctgctaccactcagacaaggaaaaaccgattcaaaagccaaataacccctcatggaattcagctcaaggcttgaagtcttcctagcttgtcctatggacctcaacaccaagaactacaaattgcaaatttaataggtcattttgtatcaaaaggtcaattgtgaagcgcctagaatttttcaatgatacgaatatgttctctgggttctgctgtggcccagacagtgttaacttttttttttctattgtgggttttgattttttccccccagaaattggtttcatttgattacccaagtcttacgtttctcaataaagaaaaaaaatctccattaaaaaaaaaaaaagaagaactgtggtctgcaccgcaggtagccatacagtggagggacagccttgctactggagacccgcctgaaccagttaaaagggaagaaaaatgccctggcatctccttcctttctcatgccagtgcctgccattggctgaattcatctaaaagccagatgacaggaggtctgggagatgcagcctgcagatgtcccctcctcctaaccatccgtggctcactacagagcagag

SEQ ID NO: 81454 - DNA, 1048 bp, Homo sapiens
gctggaaagtggttcagccgggattcaagcacaggctgtctggttttagaaccttcctcttttatcttgcctgggagagttttcatcgatgccactgttatgtgttggcattggccaagaggcaggcctgggattgcttgggatgtgcctgtttaacaatcgtagtcatttgctgactactgtggttaagaaatttttcattagagacaaatttccaaactaggaaggaagaacttcattgtcatttactcctgatgcagacttttaaaatttcatgagtgaatagacatgattccatataaatgattacatcacatgcaaataccatttcccatagcgtcatgattaagggctcctatggattacccagcggggagtgatgttggtgattatggaaggtggccttgtttccttgtttaggaatgctgggatttgatctgattattagaggcctctcttctagaggccaagcacctccccaggccacagaggatttgaaggtgatgctgtgtttgttcattacattttggaagatattcagaagagctgtgccttgtcctattacattttttttttctggtaaaaaaataaaaagttgcctatgattcaatcctttcttttttttcttttttttttttttttttttttttttttacgaaatagccccatggtgtcaagcagcgtgagtaagaatgtacagatagtgacatggatatgtgtgcgagtgcgtagagtgatggtttgctctcgggtataaacctaaggttgctgtgcctttacttcccctctagaaaaaaatgtttacacaaacattaatttgagtttatggtaggcagcagaatctaattctgagaatgccagctgtgtcatctatgcatgcgttcattcattcatgtggtcactggttgcctgcctagttgtgctaaatattatgttaggcaccagaagagatacagtgtgaccaaaacagacatgatccccatggaccggaatagaagtccttgtagtgcaatgttatgggagaacagaatagatgccctccctctgg

SEQ ID NO: 81455 - DNA, 1813 bp, Homo sapiens
tttctgacactgtgctatgttttgaattctgtaggaatccttggcggaagttgccttcagcattttaggcctgtctaaacaggtagaatttatctgacatttctttcactcccttaagcctcatgtgagttggcacagagacatgtagctttggcaaagaatgagaaagaaggttctggggaagttttctctgttaatatttgaaccaaaagacacggtggggcttggaaagtatctgatgaattgtttttaaatgtcatgaactatttatgtgcccccaaattatgtttgatcagataggtgtggccctgatcagtaataacagactggtatttggtccttttattaactacttcctctccaatttcctttccaaagccacgtgtcagtttcaagcattgtcactatgagcccaagatccagaattattattttattgtttagttttggtgttcagttgtcaggctgtgccttttcattggtagttttttttttgtttgttttgttttttaagtagaagtttttgcttttcctagtttacaggacacacagatttagctgctgtatattttattttgtgtactagctacctgatatttcggagtctctactcagtggtagcattatcttagtcatgctaatcctcttaggaaccctattagataggaatcatctccattttattgaagggaacactgagactcagtgaaacctagaacttgcacaaggtcacccaactgggttggaaatctggcctatgtctttttttactttctacccctgttatttgatttcaagctagtgctgtttcaaccatttcaatcactgcactctgttttgcatcccagggaaattatttcaccccaagacttgaggggtttcaagacccattccaactaagatttcagaaattcctctacctcctgagtttggaagtagctgttctgtgcattctcaggctcaatgcaaaggtgaaatccttcatgacaggggaggccttaaaaccacatccatgtagacctggaatcttgctaaaccctgttgtgaagataaacgcagcatggtcttgataaatatgtcatttaagagcaatttcctgccagatgactgtgtatatatgaagctgggtaatctggaaaagtctctatcctttatctgatccaagtgatgctgtaaacaggattgttagatttgtgtaacgaagctagcaatcacatctaaatattactacacttaattcctaagtgttcatgtgagaacaacttcattgtgtttttatgtttttgaatgattgtaaccttttaaatatatacagatgttggcatttcaaaacccaggaaaattcttgtggtgctattgattagatcaaggtactttttttggtgtgtatctattattagcattaagacacacttatcaaataagatcttttcaagatccagagtatacagacacggtggatgttttggttatcgtggtcttcgagaagctggggttacttctctgaatactccacttatccccagcagagcttctgagatatctcctagggatcctttagtttcatgtagagtcggtggctttctaggatgtgagagcaaatgcagaggctggtgtaaatggcaggggaaagtagtggaagaatgtaactaatactcccttgaaccctacaatctgatgtgccgggcacagcctcatctgcttttgagaacactcatcggtgttgtttaatattcattccaataagaagccattttactataggttatgaatggtaattttgtatttttgtttaaactattttctaatgcaa

SEQ ID NO: 81456 - DNA, 1017 bp, Homo sapiens
ttaaagagcttttagttggtcacctaaactattttattgttttaagtaccaataaatgaaactttataatagtcttattgcacagttattaaatataacatttcatgatgccttttaatatgtataatgtttgttaattgaacttcatttggaaagtgtttgaagattgtagttttaatttctgatgtgtgtgtttttcatagtccatcttttagcaatttataaagtgaactatttcttttggaagatgactaagacattgctgaaactatattggcctaggtccatttttcaaaatcatgatttgtaaatttactttgaaatttaactttaattgttaaagcaaatctaacagtgattgcaagatataggaaagtcatagctgcaatgtctatattttcgatttagtatacatttaaaatattgcttctcaaagcatattttagagggtatgtgttatattaatggtgaaataaatatatagggagttgggcatataactctctatggaaaaacctctatttctttctttttttttttgtgggggtgcgtggaggagacagagtcttgctctgttacctgggctggagtgcaatggagtgatctcggctcactgcaacctcagcctcctgggttcaagcaattcttgtgcctcagcctcctgagtagctgggattacagccacctaccacaatggccatgtaatttttatatttttagtagaggcagggttttgccatgttggccaggctggtctcgaactcctggcctcctgtgatccacccatctcagcttcccaaagtgccgggattacaggtgtgtgccactgcacctggccttatttcttctttgtagtagaaaatatactgcaggagtcattaaaggtgatttcatctctgctttgaacagatcactgctctggtggtataaatgagagattgtagaggagagaggttaaagaaggagagtcagactcatgactttatagtagaaaatagactcatgacttcatagtag

SEQ ID NO: 81457 - DNA, 1050 bp, Homo sapiens
cagcctaggaacattttttaaaaatctcgtaatattggtattctggggtattcctgatgaaataaatattaattcttctctttttaatgaaaaaagtaagttagtgatgtagtttctaggtttataaagcaggtgaaaataatgcaacttctactcaacgaataataccacaggcactatgcaagagtgtgggggaatatccaaagttatgtgtcccccagcggctgtaactccatcctcctgtgcatatggaacattttgctgttctttatggtaatcactttcctatcttggtgtttatatatggtgtgtgacagttacggtggctgtgggaaccataactttaagttctgtgacttttctgtgagtaaaaccagccataatgttgaattaatgtcattgctcacattgaatttccttgttgttataagtggaagacttatcacatatttgaataaaagctctgttttcatttttgataacatgtaaatgatggtggttaggtggattaattttgtcatttaattaacatcatcattcagtacagtgaggacaacttgggagaatatatatggtccagtctgaggggtgatacggtttaatcatacctctgtccactcctccatttgaaagtagaagatacaagaccatcattatccttggctaatgacataacactttaatcaaaagtgttattatccactttagtggatcccaatagttttgtggaattatcttcaaaatgggattggttaggtagagcattgattcaattaatagaactggagaccatagcatgtgatttttcaggcttcagagcatcagcaccgtttactcttggctctgcatgtgaaggcatggttattgatgctggaaatcaggcagaacgattgcatttgattgcattattgggaaatgatagtgtatggtataaaacacatacaaataaatctattgatattgggaaattcagtaagttgaataaggttctgattattggcataaagtggacttcagagagtactgcccaactcacctgggggtcctttt

SEQ ID NO: 81458 - DNA, 1002 bp, Homo sapiens
ttttggaacatcttttcaataaaggaagggtctattgactctttgatctgtcttctatgtctcttaggttttctttttcatttttcccatgactttttcctctcgggaagaattcttcagcttgatcttcagcttgctcattttcttgtcagttgtttacattgtactgttctgtttaccaattgttatgtttttcatttttataacctattttgtttgacaatcccatccctttttgagaatattaagtattcatttaaaatatcctgcttgctgctctatttcttggatatcagtttaatgtattgactgtctcccatttaggacattattttcttttacatgtttgattctctggagcggtttgcttatcattttatttgtgtttttctcttcccccatctgtggatgttatttttgcttactatgtcctgcaatttggtgatgatgaggagagccggggcatgctgcaggacagggtgagccggtagttcaggctaggttcttcccattcctcctggttatcacctgccacttaaagcttttctctctgcatacgcctgtgctatctgcttctgcttattttcaggtgcctttgccgggcattgctcagcctcaaggcataggacagtgctggcccatccagctctctttttgtgctgaacccaccagtcacactgagctgcactggccatcttacctgctgcctccaagcctggagcattcgtggttcacctgccatacacccttccaccctcctaccctcccactccaccactacccagaaacatctttgctgtgactctctactgctcatgtctctggatatggattctttcatgaactgatctcatgtggctttcatctttcagaactgtatgaagtatgtccttttttttcttaaaatttctctctctcttgctcatgttttctcagatgtagcattttaaaatagtgaaaaaattattgcctacttgttggtaaatagttttttttaatcaa

SEQ ID NO: 81459 - DNA, 1568 bp, Homo sapiens
cgagccctttaatctctgtgcagggagacattagcctggggagtggggaaaggatctttatttaatgaaagtcccaggcttttacatgtattttaaaattctgtcttgttttcttttccttttaaaggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtaatcacagatagctttcaaatctgctcctttattaaaaacatttctcagcagtttctcatgtcctcttagacgtgaacttgccaaaattaattcttttattaggacagattaaaaataataatatagaaaaaattccttatactgtttgttgaaactgtatgtttctcttcaatcaatgagatacactccagtgaaaataatatctacattgattgcatttcagtctaccaaatgtggaagaattattactggtactgcagtggtgacaagtactaaagcctttctcattaggaatatctttatacttaatagagcttcaagctaccccttgtaagcatcaattgctacaacatctgggttaaaactgcatgagttgagtgcaggatgagattgctatagaaaatttagcaaatttctatttaattggcagatctgctcactgtggaaaatactaaattttaatgacagactatttaaactacagagaatggtccattgtgcataacatttcaatggatataaatactgccttaaaagaaattgttgctgttattttggtcatagtaggcaaaatgggcaagattgaataattttgttctctgcattggcttgactaaatttctctttaactatactatgcaaagtatttcaagatctgaaagactgatttcagaatttccaacctattgcatttgttaataatttgaaaaactcagttggtttaccataataatgtgttaattgacctctgtcctctttgtaggtatatgatcgagatttaaccacatctgatttcatgggttctgcatttgtcattctcagtgatcttgagcttaacaggtaccgtatttttacattttaattgttattgatgagttttagagggaacttacgataatgttaaatggtgcttgttgaggtcaaatgacaaaaataacatatctgaacaaatgaaagagagctttaaagtgttataactgtcagtgtatttttaaggatttttgctttccaggtgccaaatatattagtcagatgttaagtattttataatgcattctaaagtgtgtattggatttcatactttgatttgttaatattcagtttcattaacataacttaaaattaaaacaagtgtttacattttatttgagtggtaggggagggggatcagttaaccaactgttgaattaaacaatgccaaacagtttctctactctgaatataactgttttattttcactaaattttgtgctttcttaacatcatgtctaatccttattcagaggtaggagact

SEQ ID NO: 81460 - DNA, 1028 bp, Homo sapiens
tgggactcttcttttgagcaaaaatgtggatacaaatcataatcttattttatttgggattatattttataattctaaggctatattagaacaaaagcatctttgatgatgacttatttgaaaagtatttttaaagccaattgaagtacctgctttttaagatgtgttataatttagcatgtttataatccaatataaaaatataaagcctatttataattaggtctccagtaatgcttcttgaattgaggcagtggggtgggtgaggagaatatttttcttttgacatcacttatgcttctagttgtagctttttatgatgaaaaccgtgattgatttactagtaaactcagagaagatagcttaaagcagtaggaaaactgtagtgtgacttttcagttaccttttcaaagattcaactaaatatctgctatttttaacttgagttccttttattacttctttttaaaaagtggccctgttgacacttgtgacctcaataaaagagatattttaatgttaaaatgtcttaaattaatgttgaaaataaaagtattttttctcatcccacctaaagaaggagggattttctttagcttcttcttgatcttgacagcattgctgctgcatccgtgactctggattcagtgtcagtgatacagtaggtgaccggtgacttgagctgggggctaggttatagcatgcaatgtaaatagttatttgtcacgtggttgacaacttgccagctgatatcgtcaaaaaatttcttatatattcaagtggggcttgtaaaggtagttgatttctccatgaaaatagctgcatattcaaatgactgcctttgtgaagttttctatagcatattagattatgtttagcagtaatattggcacttaaaagatatttaatattgtcaaaatttagagttttaacataatgccattttagtttcaatttatttcaaattgcagaacagttaatactagactcagcttggagctgtttttgtaaaagatctcaaagagact

SEQ ID NO: 81461 - DNA, 1004 bp, Homo sapiens
tggaattattcccaaattaatacagttttttttgtttgttgtactgtttttttgttttcatgcattcttcactgaattcaaatgcccactcctagtaacacctgttacctttttattttcttggttaaactcaaaggattggagaactgaatactcaaaacagccacatttatctatgtgcttattgtacacctacctctatctgcttgtctgttttccatctatgatctaatttagctcatctatctaatttatctacccgtctctatctgtcttctatctctatttcatctgtcaatcaatcaatctaaatgtcacactgcactgacccactgctgaatgtcgtaaccctgatgcttctgatgccttattatgaagtctaggtcagtattaacctggacagaatgacttctagaggctttcctcctccctggaagctgtagccttgtttaggtgaagctatcaatttatcagaactttcaaagcttgtatgtactccacaccagagggacagagggactgtcttccttaacatctcatcaaatctctcctctcagtgatgtttgactcagtttgccccaaaacctctcactgagcacatacacttgcggtagaacctgtccttggatacagggtgaattagactcagtcatcagaattgatgagcaggtaagagaaatgagaattagtgacggaggtattcaaagggtgcagtgagaccattatcctggcctttcaggtgggtggagtgggttggacgctggtctctgtgttgggctcaggaaagccctcagataaaaaaagactggaggctgaggcgggcggatcacgaggtcaggagatcgagaccatcctggttaacatggtgaaaccccgtctctactaaaaatacaaaaaattagccgggcgtggtggcatgcgcctgtagtcccagctactctggaggctgaggcaggagaatggtgtgaacctgggaggtggagcttgcagtgagccgagatcgc

SEQ ID NO: 81462 - DNA, 1011 bp, Homo sapiens
agtacaaaaattgagtgacaattttatcttataatttaaaaatattaaatttaatgcaaagcttttatagctaatgtatttgtacacagattattcatatctctggaactgataccatttttatctacaagtataaattgcaacttctgtggacttttacatgtgggaaatttaaaaggttttctttttattctcatgcaaggatttctgtgtagttctaggagaatttatgggtccagtatcctcttcagatgatagagaggagctgcagagaagaattttccctgggagcctgttccatggatgtatggatcttctcatgtcatgcaataaaagctgttgacaaggaacagtagttttacatgttgaaaaagcttgaaaggaatatttcagtgaaacattttataggctcaatgttttctctttagttttcaaagcagtggtcaacatagttggaatctgactttactactcatttttcttacgaagttgatttttttaatgcatttgtttccattgactacttactttcccataatgacttaggaaaaacaattaatgacagtcaaaatgggatttattggcaccacgagaacactgatatgtttatccttctgtctctgagactatgtatggagtaccagtacattatttggcacctggcaggtatgctctggtcagtgccttttcttacttctctctttgttggttggctgattggtattgtgttatatgcaagagagtattttggagaattatcccgtgggtattgcttggcatcgtcagttctggagtgccacctagttgaatgtaatcttgctttagatggccgtaggctgtggctccagctcctgacttcatgccctccttttaggatttctttcctcctgacctctctgccactcttcctggcctgggacagataagaggcaccacctggcctcggacagataagaggcaccaagctgacctgtccatccttcctcagtttcctctgcagccatgccaagg

SEQ ID NO: 81463 - DNA, 1050 bp, Homo sapiens
ggattaaaaataataaactatccaaagtatgaaaagtgatttattttaaacaaacataatggcattttaactgtctttgaaaataattcatcttattctgctgatccaaattccgtttaatttttaatcttagtaatttggtgtggattttatttcaaaaactatagtccctaaagcgtgataattaattagttttacataactgtcagacaggaatatttcctatgttttatggattgaaggagctctggggtacttgaaacttaaatcacttgccaaaagccacacaggaaaaaaaaaatcagtggacgattttgaaaatataaccgaggatatttctagcatcaaggatgcagcagatacagacaagttggaaaatgatttagggaggcaagaggttgtgcgcactgcacaattttcagtacagaatcaaatattacatgtcatctactctagcacaaagtagagaattgaagctcatgttgaagaatagtttataaaaaatgtgaaaattgagggtgtattaagacagaagtatgcagataattattttaaccaggtaatttcaggctttgcctcacagtgagggtatccaggataaccatatctctctactaagattcctttagcttgccagggtcaggctaaggatttaggaaaaattattcatcactaagcacacttagccatttggactaaggtgaagtgtagaattagttcagtatctgctacattcacccttggggaatactgcatttaatttgtggtctaacagggcttttcttgtttttttttttgtttttgtttttttcccaacctggtttctaaattctgtgatccaatatattaagcctgatgtgaaaaacagctgaaatgattttacatgacattggctacagccgaggtctgagttctctatgtttttctgatgcaagaatagttagtacggggatttaatacctcacactgcacccctagagcctaatactctgggaccaacattcttgctcactttgtattcacatatttaatctctatataaaggaaaca

SEQ ID NO: 81464 - DNA, 1013 bp, Homo sapiens
tatttctctggacaaattgcaccccatgtcgttgatctgcttttacagccaggcttgacacattcaccattttcctcctgttccctggcttccttagcctctgagatttacagcttttaaaactctagcactcttttctgccccttgcctttgagttaaaagctgaccagtctgtaatataaaacatagaattatggtaatgaataagaggttaaaagctatcatggcaagtaaaacttgagcaggtttgtctgactgatatggtaaaattatgtgttgaattaaaacattaaaacgctgtgggattaatggagaaagacaagaatgggaggtcagaaacaatgctaaatcagcacattaactgcctgtgggctagagaggctggctttaatatatgccttttgcaggaaagggaaaaaaaagtaatttagtctgttttcttcaggtgagtagaacaatggcattttaaatctaagaggcacctagtaaatacatttatttcaattcctttcctacataggggaagaaacagaggctgcaaaagatttagttagttcaagaaaaaacagtataatttggagtttttgactttgtgagttttgttacggcgctgacattcattcttttgtgcgttcagtgtattcaaatcttcaaatctagagcacattgtatgctgggcagaaggcacagtacttgaggattcagtggacagtgatacagaaaaggctgctgtccttgggcactgatgagcctcgggctactacaagtaagcaggcagtggcagtaggtggaatgagggctgcaggtcctggcatcatggataccaatttgggcttagaatggaagcggaggcttccttgaagaacagcggtctaagctgagacttgtaggaatagtggtaattaacaagcagacaggaagaagagctttccaggaagacagcaaaacataggcaaaggtctggagaggagagagagcacattctctccgaaaaccttgatggagtggaaaaa

SEQ ID NO: 81465 - DNA, 1003 bp, Homo sapiens
gtacaagagagaagactttattcaaagaatcttaagtaatctatcttctttggagcctgtctctctaaaattggtaaaagctattttttctcaggtctatgccaacgttagacgtggatagccataagcagttattctagtagaaaagcctgtcaaatgttttttaaagaatttgcttcacaaattccttaggcccagtgtaacctaacatttttaagtaataggtgatgcagcctgatgtcattacttttgtagtaaaccaggccacagccttgattcatgaaacaaatgataaattgtacttggaggctcaaggtgaatagctgtgtgtagtgtttgacaagaccaacatacttcactcagctactgctagtcttaaaatgcaggtattttaagaagaaaacaactcgcgttctaatgattaactgaaaaagagaaacattttattctggacaatgctgagaaatggacagtatagcaggtttcatacctacagtagaggcccagacagaaaattgtggtatatgctgcccaggggcacatctgatcataaattaatactgtcgaaagaaaatacaaagttaatctcataaactgtaaaaagagaatatagtaaacaatgggttaatgggaaaattgttagagaattgaaatgtttttcagtccagattatgttacctttcagtacacatgacaacacctatgttacccattgagagagatcagccaatgaagagtaggaaactatattggtttgctcagcacatgtgtgcagattattcaggatagccttattatagttgacagtatgctgctgagaagctgccaggattgtaatgtgttggggttaattcagcactaggaattgaaaccatcatggccaccactggcatgatgcatatgccaagattccacaccaaatcagtgattcttccttagcattcttagaatcaaaaagtgggttcatatagctaccttcctgttacttaagctttctctttat

SEQ ID NO: 81466 - DNA, 1034 bp, Homo sapiens
aactctgtagacctctggactagataagctataatacttgcatgttttaattgtaaatctattcatttgcttccaaactaaacaacatagacactcattctgtgtctgtatctctctttatctctctctctctgtctttctctttctagttctctctctctctctgcctctgcatgtgtctttctcacacaaattcaccaacattaaatacctggcttctgcagtttcaccagttccatttttgtgctgaacattgttgaaacaggctattctttttcagatgagcgctaaaatgcatttgattctcatttcctctatggatgatcatattttaaaaagacttttagaagtgtcaggtcttctcctttctattattatcatattttaaaattgggatctatacaaaatataatttaaatgatcagggtacctgatctagatggaatatttgtagtatttaaatctagtttcctgtttgtcattttttaaaatcagatcttatcaagagatgtggaccgtgtgaaaagaatcactatggcaatatggaatacaatgcagttccttaaaagctgcttccagtgggaatccacattaagaagtacaatagcattcgcggtaagcttcctttcttatgttcaaactatttgcttcttatttgcatctattcatctttctgaaatatattacagcgtaggtgattacgtgggggttgtctttctaagacagtacttaggtcaaatttacctgggaaaccccttaaattacccaaatcttagtcatatatggtctcttggtaaatttaagagcactactgttgtatatatatgtttaaatgtttctccagttgttgttacagctacatttgtatagccctgcattgtgtgtattttttttctttctgtgccagtgaccgcccataatttctgaaaaatggcatctgaaaaatcacaggactaaataataactgaattgttcaatttacattttaagtaaattattcccaaactttgatattaaagatgtttattcatttc

SEQ ID NO: 81467 - DNA, 1057 bp, Homo sapiens
actcagttcttcttgttaggatgaacattgaaaatctttctcattttgtcttctgggtctttctctttcccctatgtttttcagatattttggtatcttgccttttctaaggtttacttagttatattaaattaaggatatattttttcttttttcttccttcagaaagtaacattcttgactttcccatttgaaaaacaaattaatatgagatgttgacttagtgaatgaggccaaatagaactgaaatattttgccttgaagtaagtgcacctgtatatttccctatgaatagatttgtaaatatatgtggtattttatacacatgtatatacatttatatacatacacaagacgtgtacatggccattcccacacagattttgactatttgaactattattcatagttcatgttatttcagtgcttagacactgtcccaaggattttataaatttagttctcacaacaacctgctgatgtaggtggtgattactatcttctttttacagatgagaaaaataagcctatagaggtcaagtacagtgacagagctcatgtgtgtgtatgaggtagaggtggaattgaaacccaggccatcttgctttagtctgtgcaggcttaacccttcagctattctgcctctcactgatgcccaggatgcaatgtttgttgtccttgtatttacatagtgacaccgggaccaaccatactgattgtttcagatctgtatttagatattatgtgtggggattaagcctgttccaagctgtgatgctatacaggaaagaaaccctcattacatgggcgagaataattctttagctcagttattttattcacaagtgatgatgagaccaaaattaaagaagccaaacatggaaatgcccagcccctgggcatcacatgcatttggcatccttggaatccagctggataatttgaaaaaccctagagccttggttctagactgagtcccaaattacagtctgacttgtttttccccacctttgaggaatgcttttagatgatgtagagggattttcaaggggagaag

SEQ ID NO: 81468 - DNA, 1041 bp, Homo sapiens
ctgtgttccaaagcggggcttaaaagggtccaaggcttcactttgacttttgatcaaatttgttttcataatcctttcgcagtgccataacaccccgtgcagcattctccttttaggttattatttcagctaaatatgtagaaaataggtgaactttaggattccctcggtgcgtccccccaacctcacccctcccaacacacccccattctgagatgtttcccctgaattaggcatatgcaagaccaacccacatttaggacgtgataactttgtccagaccatcattgtaaacttcaaatgatacacagacacatttgaaaaaagatctcctctctgcattggagaatcctaactcaatcttgtgtgtctggagagctgatatagcaattttatcagactctgtatctcttatattgctttgattataactcagtgtttcctaaatgacactgaaaagcttaaagaaaggttttactagttctttcccaatggcagtttaggaaatatcggggagctgtctgtttgtgaagagcataatgaactccttaaattcatagtctgtgttgctgctgtaggaaggagtggggagtgcaagcttgcattccacctcgagcattttctacccactatgcacagttgcatcattgagaagtaagcattcctcttagatcagttcaaattgctaatatatgtgtcctacagcctgcaatataatatttacgtagcttccgaaagagacctgcaaggattccctgtaattcaagatggtagtctgactgatgggtgtagaaggatttttttttttgttttaaagaaattcttgtttgtcccatgagattttcacacttttcggctgacggcactgtattttactcatcctgtataaagctgtcagtgtattcattatatgtgtgtcttgaagactctgagcagatgacgggaacaattgctggagggggaaaacacatttgaatcaaaatcttcagaagagcatttctgtagtctctcctgttcctgcttctgcgtggactgtccctc

SEQ ID NO: 81469 - DNA, 1029 bp, Homo sapiens
ctcccctagtgttttatcaagcagtcgtgtattcttatttgtctttcaatcaggtatttttgatcactgtctggaattttgaactatatatgatccccttggcattgttgctgatctttgtctacaatttcatcagacctgtgaaaggcaaggtcagcagcatccaggacagccaggtaagcaaggattcggagttctgacatttgactgccgagaaatgtgttaacaacaaactaccaccaccaccaaatcatggcccaagtccatttcgtttgaggtgtaaggagcagccctgcaaaggcactcattttgcagtggaggtcttctatcatgaataatctggagtcttctttctgtggcatcttacgttcctgagtcttggcctgcatgaagggagcctctggttcatggttatcatttccatgctggtagcacatgtctgtgtgctcatctgattctctgtagagttcctgtgaacaacctcctcagtcactagcgagaaacctttgctggctctgtgggccattgctgggcatgcagagagctctgcagggctaactctggcctttccatgaaggcaccttatgcaatgttctctctggcttgaaggctcaggagattcccagaggcttgtcaactcccagggcaatcagagagtgggtgggcttagatccatctatttgcaggtgcccacatttgtctggaaattcccaaacttcctgtcctgttgaagaaagcaagaccctttctcaaagacatctctccgcatctactcatctcacttccactctgactctcctgctcctggccccctcattgcaccccataagatctttttctgctctgctctaggtggccaggaacttgtatttgtaggctttttttttatgatgtaatctaggcattccagcttcaagaaccaagtttttaaaacaaaaatctaaagtcctaagacttgattaattttctttctagatggatcaccttcacatttggtttcccaagagtcaatcaaaccctgactgtttt

SEQ ID NO: 81470 - DNA, 1063 bp, Homo sapiens
atagagcaatataaaaccacttagaaatgatattgattcaaaatccaaatactattttatattcatttcccaaagcaaaagaactacttgagaaagaagtacactccagaaagagtacagatctccccactccattttaatagcacgagctgtggcgttgactccatgtgtgtgtgcgtgtgtgtgtgcacgcgcacgtgtgcgtctgcatccctgcatgcccacaaaatgcctcatgggaagaatttctaaatgacagctcctggtgcattgctgggattcccaaagaataatttttaatttcatgtatcagaaatattgctgcttgttctttgttatgacagatgctaagctttttttcatgctaaatgccactcaatctatttctaatgtttataattcttcaagttttcaaattataggcttttaatattcagtgggatgaaacagaccaaacatattcttatttaaagtctaaaggtatatttttgcatctttagtctagatgattgaaattactgggaggattttgagataaaaatttttgcattaatctcttctgagaattctgttcatcctgtgacaaatactactcagtttttaagcatgtcagaaggattttttcctgacatggtcaattttcaggactttgtctcctgttttgcttagggaattaatagagaaatgagaagttttctaaatcagaacatgtaggagagatttaaagtaacaccctgattgtgtaattaattcttagttgtaaattcattttgatggtgttaattctctgcctgaggctcgaagctagtttattgcacctatggtgctatactcattggatacccaacgccaacaaggccttaagaaaggaaagatttgccctgatttttaaaattttttttcttttttaaaaaagaacaattgtgttacaacacagacacattatttgttcttagttctgcttacaaaagttagcaaaaatactcaatccttttaacattttataaatgaataatgaaaaatggtgggcttgtactcatcttcatatgatatatatttttag

SEQ ID NO: 81471 - DNA, 1095 bp, Homo sapiens
catgttggtcagaatggtctccatctcctgacctcgttatctgcccgccttggcctctcaaagtgctgggcttacaggcgtgagccaccatgcccagcttcagaaagtattattaaaagtatagtctacagtggagtcaattaaggtgtcaatttaatgacacctctgaaggtgattaataacaatttcgtgcaatattagaaataaaaagatgccattaaaaagtacattcttttgaaaagtaatcctgacatcggtatatagacagttgtagctagtaactgactaaaatatatgaatatatatcacaaataatcattcttcgtgtgtcatttttaaatatccagatgatcaaatttattttaatgcacaaaaatctattttttatttgaaaataatgtatttgtgaaataaaaatggaatagttttataggtccaatataataaaaccaagttatcagtcatcaataatcaaaaattaattgtttacttctactcttaaaagtattaacaagtccagatgataagttattctgttactcaagatatagtaagactctttagcctagtctttggatatttaatactccaaacatcaaattcattataaagtaacaggactcatgagcatcgttattttggcatactaactcatgctttcttcacaaccagaacctcactatttgggtgtttcacagggaaaaaaaattagacagttgaaataggaagtttttattaaatcgaatgacatggaaacttgagtcattttccaagaaattgttttgacctaaactggatgctgccgaaaagaggaagccacttttggcctttgggtcaaattccctcatgctttcaaatgttcctttataaacatgaatacttatgtggcagacagagctgggttttcaccattgtgcccattaatagatgtcggtggactcatgaattagtacgctctggcagcatatctaatttgtagcacaaactgaggaattagagtaagggaaaaaattcaaattaggataaaaaagtaaaagtatcttgaaagtttgatattgcagaaggaagcaatgaacctggttttccttctgcaca

SEQ ID NO: 81472 - DNA, 1036 bp, Homo sapiens
ctgaagaacactgataggagaggagtagggtgagcttcagaaaacctgtggagacagaggaagtcagagttagccagactgacgggattgcagaattctgcgagggacgcggcagcctccacggggaagtgaagtgcttggttctgtgggcttccctttatcacctcatggcaatgaggtagcaactgaggcttgcgcgttaggagtggtagcatctaagtgactgaacagatttttctggggggggagtcaatatttaagttgtaaaacaatgatttatctcttgtgtcactctattggtaaaaaccttgttattataacatgttataatattttctgtatcagcatgataaaaaatgaagtaactgagttaaatcttgcttttatgttttctaggaatctgagaaaaaggggttgattgaaagaatctatatggtacaggatattgtttcaactgttcaaaacgtcttggaggaaatagcttcttttggagaaaggattaagaagtaagttctaaatttgtgttgtggtgtttgcagtagacctgctatccacaaggacagtggggtaatggcagtggtgtgcgacaaagggaggcaagaaaatacaaaaacacaccaaagcaacactgttgggttagcactgtctgacttcagttggcttcttaacttcacagttgggtggtgcctcagaactggggtgaccatacggcccagtttattccagtcaccccaacataaatattactagtgttccctttcactcaaaaatatatcagtttgggtgacaaatgatagatatttaaaatgttaccctattcagaaataaaaagagaagcaaatgtgctatacaggagcctttgctatctgaaccacagaacttagtaaatgccttgagtaacttttctctccaattctccaaagaaagatacacatctagtagcaccatagatggataaatgtgaagttaagtcaccacatatatggatgtcttaggacaggatactactctgtggccctttatagagaaagttgac

SEQ ID NO: 81473 - DNA, 1343 bp, Homo sapiens
ttataagcatagtaaacgtgtatgtttaaaaaaagtaagttataaatgacttttaaacaaagttgatgaatttttattgaatttacagttatacccattattaatatcttaagaaaaaaataatttttgctcacagatatgatgcctatttgctttattcttgtaggtttcatataaattggcaaaagattcctgaatttaccctcaaaatgtttaatataaacatatttgaaagcaaacatgaatagtaaaatgaggagggcatcataattctttattcatttcctcactcaactatcagttattgagtttcagacactgacttggtctaagttggtctaagaatgagaaatgcaaccataattacaataatgatagcaacaccaactgttatcgcatgccagccatgcactcttctaagccctttaaacacactagctcctttgaggagctacttaaaggaataggattacatcattcaaaccaccctataaagtaaggattgttaatatcctcattttacagatgaggaaactgaatcacagagtgattaaatttgtagtccaagatcacacaactagtagctatgtagcttggattggaacctgtcctcctcattactacactataatgtcattaccctcaagaaatctctatttcaatgagggagaaacagagtaatagccaattagaattcagtagcattagtggtagggagaggtaagagagaattctgggagagatctgatcagcccaggaagagatgtaggagaaagacagaccgcaggcaattctgaaacagaagaaacttatcagcatctctgagaataggaagagatagctgggcaaagaattgatgaatgagggcttcagtagtggagagcccttgtgcaaacgctcaaagcccaagactatgtgggagatacagggagatgtaagggattgagttagtgtgtccgtgccatggaggtgcggttggcagtgcctagagatgaggcatgtcatgcaggccttgaggagatggaaaaagtcagtggaagaaagttcagtgaggcacgtattgacagcaaggaggataagaggacacagagtggggtcaagacccaggaaggaagatcatgttgtttggtaaaactgtttccattctggaacatctctaaaagacaaaagtgactgttgtgccgttgataatgtaaaaggaaatgtgtctgaggagagaagagggcagagtgatttaaacaggctcccaaccctgcagtgctttgaggggcagctgtgcccagcacagctgtggtggccatgtctgagatgtgtcttcagcccatgaacagagtactgttctg

SEQ ID NO: 81474 - DNA, 1008 bp, Homo sapiens
gattgcatttagatttaaatctgtaatttattaatagtagtgtttacttgcttgttccgtgtctttttatttcttctgtatctttcctccacttgctaggaattgaaacactcttgctattcttttagttgtcatcttagagttaacagcgttatgtgccacagtctaatattgtcacttttaatgtcttcccagtcagtgcaggaaccttcttaatctatgttccacatctctttgatatctgccatctgtttcttctttgtgatgccttctaaatactttctttggaaaatcttggactgtattagttctctgcagtttaaaatcctgtccaattcattcattgggttcttaacttcaattattatggtttgcatttttcaaaattctacttcatcaatttttcttgtttttcattttcttttggattatatcttcaagcatctcttacatgatttttaacatattaaacattatgatttaatatattggattagatttcaatatctgaaatcttttctttcagattttgctggctcttactcatggtgtcatgtgtctttttgtggtttgcatttttaagaatacacctatattccttggattttcatgtggagagtactcaaacatcatagttgatgatgcatttccttggagaggattactgtttaagtcaccttgggatactaccagtcccaggacctaccaatctaggtcctttcttaaatttttttgcttgaggcttttcaagcaacactggtagcataaactgaaatgatagatttctccacttagcaccgagggcatgatttatgtccactctatggtacaatgtgtccctccttccttattcttatcctgaatatgtaagctttatgcaatggtctcatattaaaatctccccgtggagagttcctaggcttcccctcgtgcccccaatctcccatcgtaccatgcagacaacagaaagcagctcagaatcccaatatttggcagaaaatattagag

SEQ ID NO: 81475 - DNA, 1142 bp, Homo sapiens
gggttgtaatttaataatcttcaaacaaaatgtttacgaaaaatgccaaagattctaaatcttatcatcccgtgtctgtttttcttcatgttgtatctcactgggttgctttctggctgagccagaattctgcatgatttgatttacttcaagttaatgaagctggctggaaaagagccttgcagaaattataaaagctccagtaaatctcgtagttgtacatacaatagatacccaagaacctcttttgttaaaccagttactcaatcttctgtgtaaacaatgcctcattgtcttgcttctaactatcatctagtttatcatagtctgtcattttgtaacgacctaagtcagacatttttaaacagacatgtgagatctgatcagtcatttgaatgaaaactttcagcagcaaaataaccccttatttatttaaaagtggaaccaatactttattgttgttcttttgctatagaatttcaaaatgaaattatttgcccgacaagaaggcatcattagttagacttgtttcctctgtagcccgattgaaattctcagtgttaagtttaggacccaaacaccagctgggacgtaagagcaggaccgaatcaaccttgaataaactgtatatagaaaacaattgttagttgattaagtagacattggatgtttgttagaaaggaatgttagttgtaagtgacatgttaagatttatacaattgtcaaaaacttttaggaaagattccagaatgcttttgataaaatttatcgattgtggattcacagtgtgataattaagtagggatgttgaagtcttgccaagttttcctggttcccttctcaaactttatcttcccatttctagccctgtctctctatcttacaggcatctacacctcagcaagtcagaaactaaacatcatctgtctctccctgtcttcagaaccccaaccctcataatctccttccagcttccttatttcccttaccaggactggcattttctgggcttggaatttctcggtcatcctctttttttttgttcctcgtgctgttgtcctcgtctcccaacccctaaagcctagtaggtccagtgtcaatgcattaaccacttctgttctgatttccaccacccaagtgga

SEQ ID NO: 81476 - DNA, 1026 bp, Homo sapiens
tcttagtcttgtatcttgttatatcttatttgttacatattcttgtatttatttgttatataaaggagatccacattgtgaattaatgaactcagtgttatgccaaattttactattcatagcacatttttcatgtttctggtagatatttttaagtaacttgatataatagattaaaatgtatatatttcaaaagagaaaaggaagcagtaagaaataagatagaggagggcctttgacaagatggcggcaggaggcagtggcgttggtgggaagcacagctcgaaaagcgataacgattctggtttcctggggctgcggcccatttcggcggacccagcgctgaggcggcggcggcggcgaggcccaagaaataagaagtgggactggcggaggcttgcgcaggagccgctggggctggaggttgaccagttcctggaagacgtgcggctacaggggcgcatgagcggtggcttgttgagagaggccccaaatgaaaaactcttcttcgtggacaccggctccaaggaaaaagggctaagaagagaaccaaagtccagaagaagtcactgcttctcaagaaaccccttcgggttgacctcatcctcgagacacatccaaagtccctgcccccaaagacgtcctcgcccaccaggtcccgaacgccaagaagctcaggcggaaggagcagctatgggagaatctggccaagcagggcgagctgccccgggaggtgcgcagggcccaggcccggctcctcaaccctcccacagccggggccaagcccgggccccaggacaccgtggagcggcccttctacgaactctgggcatcagacaaccccctggactggccattgtttggccaggatgagtttttcctggagcagaccaagaagaaaggagtgaagcggccaccacgcctgcacaccaagccgtcccaggcacccgccgtggaggtggcgcctgccggagcttcctacaacccgtactttgaagaccaccagaccctgctctcagcggccca

SEQ ID NO: 81477 - DNA, 1026 bp, Homo sapiens
agaacaacaacacattagctgactgaaaaaaggcagaagtaaaaaagtggacttatctctaattctgcactggcttcactctgaatcacatatttcagatgaagattttacacagcacctcatttaagtaaacacaataattgttgagtattactatcagcactaatacggatacatgtaactagtgccttataacttgcaaagtaaaacctcatttaattggacactcacaaccatcctgtaaaaggggcagttgttttctcttgtttctgctgtctagtgtttcctgtaatatattataccagtatttgctgagctcctacaatgtttcagacactgtactgaacactgaaaatacagcagacaaaagacagatgacagttcctgtcctcatggaatttttattctactgtggagagactgagaatttaaaataaataagaagagccttgtattctagaagacggtaagtgctctggaggaaaataaagcagagaatgaagttacagaaagatgaagagagaaaatacaatgttcacaaagattgacagggacaccttactgagacttgaccaggagcaagaacaaggcagcatgaaagaatagcaaggtatgagcaaatgaaaggaggggaggaagggaggaatggagggagagagggagggagaaagggagggagggaggtggggaaggaaggaaaggaggaggggagggaggaaaggagacagaaaggcccaattcatggtcaggacagtgtttgaagagctgtgtcagcacagctgggagttggaacagagagagggagggagggagggagcctaagaggtcaaagggggcaagatttggtgtgacataggaggccgtggtatgaacgtttgagttttgctctgagagcatctttggaggggaggaatggtttgggaggtggaccctggctgctacatgagaaatgactgtggcatcgagggttggctatgatagcctaactaggaagcaaatgtaatagtctaggtgagagttgatgag

SEQ ID NO: 81478 - DNA, 1039 bp, Homo sapiens
cagtaaacggcctgtgcacgtgcacgccggagcctcccgattggccaacactccctgatcacgcacggccttcctgcgcccacccacgcgtgggagcgccaatgaaatgactcagtgaccatctacaacaaatcagcaagaagcagggctcgcagctgaccaatggccgcccgccgggggtgggctgtcccggcccttttccaggcccaactgggtttgttaaagcgacaggcctctcggcgagccggtgccccatcgggtaccgcacggctgccgcggcggccttaccctgccgcgagcgcctgtgacagcggcgccgctgtgctcgcgaccccggctccgggcctctgccgacctcaggggcaggaaagagtcgcccggcgggatgggcggggaggctgggtgcgcggcggccgtgggtgccgagggccgcgtgaagagcctgggtctggtgttcgaggacgagcgcaagggctgctattccagcggcgagacagtggccgggcacgtgctgctggaggcgtccgagccggtggccctgcgcgcgctgcgcctggaggcccaggggcgcgccaccgccgcctggggcccgagcacctgcccccgcgcctcggccagcaccgcggccctggctgtcttctcggaggtggagtacctgaacgtgcgcctcagcctgcgggagcccccggccggtaagcgcaggcgagcgcctggggttcccccgccaggctgcggggccggggaggggctgggaggccgcgcaccctcgggatgcccacctggcaggtgagatcagggcgggcttccgggggtggggtccggcctaccctcgcgggtaaggagagaccgcaagtcctgggtgcgcagctcttcctggcgccccgcccctggcccgccgggcctgaccgggaccagtggctcgggattttctaggaccgcgacgggagggggccattgggtgcggtgggaacctgtgattggacaatgggggatccagaaatctaggtcctgttccttctggtccaagaaagggacggtg

SEQ ID NO: 81479 - DNA, 1016 bp, Homo sapiens
ttgtttattccactttattaaatgccaaaataaatataatgttctgattattttttatttttatatcatttatccttccacctgacttttatatataaagtcttaaaaataattctgtcatgtttataagtcctaatacagcttttgatttttttttaaaaaaatggtatattatttcctggaaacataatgacttcagggtaaaataagatggtgtcatgctaatttttgaatctgaaaattcactgtagttttcctaaaaggggagtcttaacaccctgtgtttttgtgcatatttggcctaatatgttacatgaggataagaaagtttgattcatttttttggtatttccttacaaccattctgtgaagatagatataattttaagttctatgagttctctagagtggcttaattaaggttgttttattgtttgaaattttcaagacccctgtattgaaaactcaagagaaaatggttggctgttggtttttcacttctggtccagtctcgctgagtgccaaaattgaaagaaagggatactgtaatggtaagcaaaatgcttgaaagtccaaatgaaagatttcattcattttcttagctaattttaagtgattttaaatagtgttttttgtaattatatgacgtgtatagtattttaaaacatgaatagtgatacattttttatataaataattgatatttaagtatttttaaaaggaggaattgtttccagtcaaactcctgttttttttctgacttcaatcctgttactttagtaacaaagagtataactagaggaatgagaaaatgccagcatctgattttaatgttgcaaaagaatctccagggttgtattgctaaaaagagaactactggagtatgaaatgctattagacattctgattccatgctggcttgatatatgcaaatgcatgggactggaatgtagtgtattaacaaacttaacaatcagattgttactggaattgccattagtgaagggcccatttcc

SEQ ID NO: 81480 - DNA, 1855 bp, Homo sapiens
atatacgtttgattttcctcatatcttatttacctaggagcatgtaagagaaagaagggagagaaaaggttgcatctgcaggatgccttgataactacacagtcccaaataaaaggcctttttctaacctacctctaatggggttatcagatatgtttttaaatctctcgccctgagtactcttcttgggagttgctgctgtttacagccacagtctcatctatcactaaatatgaaactgggccaaggggaaaattcagtaagttagcgttaaatggaagtaaatatatgtatacctaagagaatgtcaaaataaacaccaaaccaaaagaaggtaggagtgccatttttagaaaagacacaactttaattcctgtcaagagacctaggtctactgatggcagtcactgcattgtacattattccagttcttcagtaattctgtttaaactgtgattttctttattgtgttggtgcaatattttattatcatttaacctcaggatattcagaccaacaggattgtgttgctgctgaaagtctgagcagtgttttaccgtccccagcccccctcccacatggtcacatgttcacttgcttttccttccatctgttggttttgtgagctgagagcatctctggacacatggaagggagccagggattcctgtgatacagattttgaaccagcagagtactttggttttcttcatgtcctaagggtttgatccagaaaccctggtgcttcccctgcagaatactgtacttcatttaacagaatgattgatttttctttcaatcagcatgttcaccaaaaatagaaaagttcttctaaggttaaattttgtatttaaaagttagttggccatttgatcagggaattttctacacacattaggcaaatgtatgcttttcatcctctgggcttacctctctcctctgcaatcctggaagcatcgtgcatagttctttcattgtaagccgctatttaaattcccacaatgcaaaactgttagaccagtaattgtgctactgaaattgtcacaaaacgttattccttgatttggtttttaaattttgctttcgtgtgtgtgtctttaaacaggtaatgtgtatttaagtgttgtctaaacagttgatttttactttagaaaagatcatcttcaactgtttattgacttctgagttatatagttcatgccctgccaaggcattgttcgactccatgatactaaaacataatgaaagaaacaaactccagtatggagaagagaaagtttaattatttggttccatctagaaaagcaacaacttaaaggaatccttcactaggattgtcttatcacctttattagataaatcatgaagtgtccctgtgaaattgaagtgaaactatctctgtaggacttaagagaatagctaaaaggtgtgacttgccttattgaaatgatactggcatatctgactgtaagcagtaggttgaagatatcattttatgaatgtggagaattctacattgaaacagaaaatacctgggaatgaagattaaaaatgtagctgctgttatttgcttggttattcccctcttgctcttctttagtttgaaaaaacaaaaacgtggccttggaattttcattttgatgcagaaattttgaaattgaaaatgtgcatgttttggtgcacaaaatccttctgtgggcaaaactttgtttttgttttgcacagtaagaaacaataggcaagcgttatgtttttggtaagttaactatgaaagctttcttatttttattattaaaaatgtaacaatttaacccacaggaaaaaaaattactttgtatgcttgtttgaaccctat

SEQ ID NO: 81481 - DNA, 1031 bp, Homo sapiens
tgggtcaagagagccaggttgtgagagccaggtcttggaaaggaggataccagtagctggctagttactagggaggaaaacaacgcttcaggatgctgttcagccaaatggtagggtctgtggtcccgctgttgggaaggcagaggctgggacctctcaggagcttgtggggtccagagtggcttctgaatgaatgttctggcacctggaggaagcagccttctgcacctgcatcagtcagcagattatggtgttagtgactttagccaagttcttcctgtacctcgtgccttatttttatttcaatctatagaaaaaagatgaatcctaccacctcttggtaaaatggttctgtaaaaatgaaatcaaattaccgctgatatcagaaagtgacacaaaacaagaaaacatgagaaattcagttgtagggtataggttttgtcagactaaattcgaggtaagcaatacctgcttctctcttagaccccacacttaaaataaaacaaatgtttgccggggtgtgtggtttcttgtcggcacgctctgatgtgtgaggtacaagaggccagagggtgagcatcagaatggaaataataattattttttataccaatgtcttctcaagcttcaaagaaaggagcctctctccttgcacatgcaaacctcaatttgggagctgaggaaggtaattttcacatgcaaatgcatatgagttgaaatgagctgaggcaatgagcagattgttaaagagacaccattcctcttctcatccagtacaaaggagcaggggcttgggagaagcagctatttcttaaaggagcaaagggaaaaacctagtgagtttctttgcccctgtcccttggacatgtctctgcatccatggagctctccaagaactaatgattaaacttggcaaaaactaactaccccttagtaaggtacttgagtggagcaaaacgtgtaggtttgagtctgattttgttgcagatcccattcttctgcagactgatcatgggacctcaggggaatca

SEQ ID NO: 81482 - DNA, 1044 bp, Homo sapiens
aggccattaattggatgttagtcttaaattagtcagtgattcttagagttgcttttttgacttgttctgtttttttcaagttttatctgttctcccttctttttcctgacggttattttggaggtatcctataattttatgtgccatagaaatagaactgtaagcaagaagcccagtggaatcaattgcttcttgctctaaataaggcatgaacatttcacaacatttcaaagggaaattaacttgtgctccttgcaaatgttttaaagactatttctgaagcagcctgattggtgggccaggtctttaaaagtttgtgcgatcttggctgttgataacatctgcagcttataatggccctgaaaatatttacaggttatgcagaccttttgagggaaggagtttgtgggaaatttctttcttcctacactcagttacagacaaagcctttgaaacttgaccaataggatcataattgcatctgatgtgatttcccggtcagcctgaacatgccttaagtttctttaccagagagagtgaaactgaatatgtcaacagtgaaatgttcttttacaaaattgttgccgggatcaggaaataattgaccactgctttaaaaattaattttttttcaatctgtaagtcatacttttgctttctttctccagctgaatttttaatggattcagttgtcatccacaaatacttttatttgcatttaatttttaaaccagaaggatctttgcatcaagagatgtgaaaaatatgagaagggaagcgggggctacttttttgaaagtttgatgcccagcaaactgcagttctgaccttttttctcagtttgttctggtgactcatacgttatagagtacaatagcaacagcaattttgtggtggtgcagtgtgctgggaagtgctgggggcaaaaccaccatactgggtgtgtttttttctgtcgaatgctgctctttgacaggttgtgtggctccccttagtggccattgtcgtctactgcagccttggatgataacttacctctgtgat

SEQ ID NO: 81483 - DNA, 1032 bp, Homo sapiens
tttaaaagttatagagtaaaattcacttttagggggagtttacagttctgtgaattttaacccatgtataggtttgaataaccacaaccacagtgaaaataaacaatagtttcattacctcccccatacgcttcatccccgcctcccaataaccccagcaaccacgggtctgttctccatcactacagttctgtctcttttagaatatcctgtacatgaagtcaggcggtgtttagccattggagactgacttctttcgctcggaataatgcctttgagattcatccaccataatgtgtgtatcagtagtttgtgtcccattactgctgaagagcgcattcagttttcaaacaagtgagtgcctttatatagaacaaataagatattttcaggtagacctctctttggacacattttgctagtagggtggtttgagtttctccctttgtttgatggttctgtaattgtctttcttacaaaatattgacactttagccatttcactatttcacgttgaaattttccctaggtaatcaaaattgtgaggttttactttaacttttgctctaaaaccaccattccacaaaaccgttagcattcaagggaagaaaatactcactggggagtggagagtcggccaatttaaggcagagctaataagtattgtggttttgtataaaaacctaaaaagaacacttttgcatttcagattcctgaaagcccaacacaaatgatttctgaaagtccttgaacaaatacaagggcaacacttaaaaatattaaaccaggtggtttggagcccaggcaagcatgggacctgtgagatgacagtgacactgtggagtcggcctcagccctgcctgtcaccagggccttctgttctctgccttccccagacaccaggcccacagggacctcctgcactgttgtcccgtcaagcagggaccccttgccatcttctggactttagtagaagcatagcaaaaaatggagtggcaagagtgcagtgttgtttcgggtaccgagtctgcc

SEQ ID NO: 81484 - DNA, 1809 bp, Homo sapiens
tcatatgcagggtttcatgtgcagagtttttcatatgcataatccttatcacatatatgatttgaaattatttttttcccattctatgagttgtcttttttaggtctcgttttaatcgactcagtagatattattttgaaaaggtttttcttccagcacattagagacggcctgagattcagcaagtgagcatgatgtacccagtgtggtgcttggcatcttgttttgcgttgctgccccagctctggtgctgcaggtgggccaggtggccacttaatgactgactgttctgaatgctatgaagaatgtggatggctccttaaataattttttcagaacaagagttgttacttccttcatttgtcatctcttcttctaagtttaaatgagaaaacccccacattttctgacaatgtggcctatattatgaacagaaagaaacttgggtgttatttccacttaattaaccatgttgtaaagatctatcctaccccagctgtacataggaatatttcccctctgtttgtagaactttagatcttgactttttttctttttcttttaattacattttgtttcctagccagctcttcttcacaaattaccaaaaaacccccacaagatttcttaatgtttttcttgttaacttaattagtggtcctaatgagggatgtgaactggaacttagctttgtgttttcagaaacatttctgagtcaaaatcacatgtcacacgttttcctcccccataatgaaattggacaaattaagtacattttctttctcctcctttttctcctgccagtttttgattggatatttcccttctgccagatgcaatctgcttttgtcttctggctttcttctgaactttttagttttataagttgaaaaatataacctcctccacgacaccaatctggttttgtgactagctagttattctcaacgtctgaacttgatttggctgccgctgtctgagatacaaaatgtgatggcttctcagagccaagctagtgtggttttcactaatctttttctcatttaagatttagctccagatgaaggtgaaatattttacattctggccaattcgtaagtttgttggcactgaacacttcgtgccatttgctgcaagctgccttatttttattatcagagcatttgaaaaacatgcaagtattttagagaccacatgaaggatcttctcccttgactggagggggaaaccaagactcaaagaggttgtgagttgctgaggatctcccagcaaatccagcgtaacaacccacaaaccgcaaatgatgacgatgataatccaagagtcaagtattaaatataaaacaaagtattaatatttgtattatcccctttccccaaatctaatttctaatggatgaagatgaagaatgaaaccgctggctggactggaaagccccagcctgttgttttgtgcctgcctctgacagacccctcgcccagctgtctcaaatcctctttgaaatgaggcggggaaatcaataaatgtaatcaccctctttgagcttcaatttccccacctgtgaaccaagacctccccagcaggtggtgagaatcacatggtagcatgtgggtggatgtcctggaccagttagtggccttgttgatctggaggtaatgcataggataaagtgacaaacacgcacgcagaggctgtcacctagcagtgttgcagagtaagttccaatacaacagcattgtcacttcgtaaatagctgattggtttcacctcctgccacattttagcagttgctcgtggctgtctgaaggg

SEQ ID NO: 81485 - DNA, 1119 bp, Homo sapiens
agatgatcagagggcaaggcaaagaatgttccagaggctgattaaaaatggcaaactgtaattgatatgcagtcaaatgcagctgtttgggaaataaacaaaggcaagacccttgccttatacaacaacccaaataaactccaaacggattgaggaattacatgtaaaaaaaccaaatgagataaaattaaaatccacacccataatataaaaatgaatacaaaatttctttctactcatgatttaagtttctggaaacctctgtggcaacaggaattcacaactgattagcttcagcatgtacagactaaagagtaaagacccgaaaattaaaattaaacctatgataggagaggtatagatagataggcagacaggtaaggatgataaaatattcatggtagatttaggtggtgagtgtgtgggtgtccactgtaacaaatgtttgaaaacttttgtcatcaaatgttttagaaaaaggaaaaaaaaattataattgagtaaaatgacaaagatatgatgccacagtgctgcagaaggttttggagtaaggaggctcttgggtattgctggaagcagttgggagccctccctggttcttggcagggaagtggcagtctagccggtacgggggtgtgaaaccagataagttatccaccgcccactgcccatttcctcaggacctctggctctgcctcctggcgtccagactcagtggtggtgcccgcgcttggctctcacagaggctggctctgtccccagcactaggggctgtggacctgcagcaacaggccctccctgcttgctctcagcccttggctgcctggggggcatgcagaaggagtgctgaaaggaagcggagatttccaaagaagcctggtgatgttatggaggatggggtggggacagggatcctggctctgtatcttcagtccttggcaaaatgccctgcccatgattggaaggaaggacatgccagtgaatcttggggaggctgctggcaacctcggcagagatgctgggggcttgcctggcagggggcacaggttggagacacatggagtggattgaaagcaatggtgaggaaggtttcagcgtggctaggtggtggtaccagcc

SEQ ID NO: 81486 - DNA, 1028 bp, Homo sapiens
attctttgaggggacatggctgaaggctgccaggaaccccctttcctaggttgctcccgtgcctttgcaaggacttcagcttccacttatgtctccttatttgttacttcatttatttccttttgttattctcatttgttaattattaatggatctcaaatgtttatacatattaaaaaaacttctctcatcaaaaaagttggggcctttttctgatcttccgtgtaaaatcaaaaccactcatcctagccttcaagattgacatcagatgatgacgttcagcttttctcatttcttcctgtgtcctgtgcagcataataggatgaatatggactttgacgtcagatggagctgacttggaatcctggctctgccagctgactggcagagggggtaagttatttaacctctttgagagtcggtttcatcatttgcaaaatggaaacagcttacctacttcacaagacagtcgtgagaatgaaattatttatggcaggaaatctgatgcattggaccatcccagggcagagcctaggcatgaaatctgcaggactcccgggctcctccaggaagtgcaccctggcttgttcctcctctgtctttgcgtgttgtgctagaaaagtatggatttcagagtggggggcctgttctgtagcttctggtgaaagtttggcagttggaatcaccaccctggcagattctgcttggggacttccccagggacaatctgagtctgtttttgagctactgttcttggatttttttttttttttttttgagatggagtcttgctctgttacacaggctggagtgcagtggcacgatctcggctcactgcaacctccgcctactgggttcaagcgattctcctgccccagcctcccaagtacctgggattacaggcgtgtgccaccacacccagctaatttttagtagagatggggtttcaccgtgttggccaggctggtctcgaacttctgacctcaagtgatccactcgcctcagcctcccaaagtactgggattaca

SEQ ID NO: 81487 - DNA, 1157 bp, Homo sapiens
gcgcggcgcggccggcccgccgctttgtgtgtgtcctggatttgggaaggagctcgccgcggcggcggcggcgctgagggaggaggcggcggcgagcggagccaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagcccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaagtgagtatgtgcccgccgcccgcggccactgcgggaacttttcctccgaggggctgcgccctgtttgcgaaacccgagttgccaccgtcgcagctgtcgggcccccgggctcgggagcggcggggtggggcgcagggcggctctgccgggagggaggctgcagcggacccgggacccgggctcgttcgtctggagccccgcgggccctggctccgcgcatccccgcgcgggaagggcttttctctttctccgtcctgacagcccagccgtgtttcccggctaggcgcgaggactcggtagggaagttggtgccggggcgggctccgcggttcccgggccccgcgacccgcacctcgccccttccatgcgcaagagcctctccgcacacagcgctgatcccctgcggcgc

SEQ ID NO: 81488 - DNA, 1004 bp, Homo sapiens
tagaggcagaaggtagatgagtggttgccaggggctgggggcggatggaatggggagtgactgctggtgggcacagggtttctttttggggtgatgaaaattgttctaaaattagtttgtggcgatggctgcatagctctaaatatacttaaaaccattggattatgtactttaaatcggggactttaatggtatgtgaattatatctcaataaacccttttttttttttttaaagaaatgtgatcaggttgaaaataacttgttatgctaccttaaattacgttaaaattattacatacatttgacaggctgatgtctctctctcttttcatttatgagtttttcagatccgtgagttgcagcaatacaacaaactgataattgaagcttagcaacagggattcaatcccgcagtagaaatgggcaagcaggagaaaaagaatcttggttctatgtagcttcagttagggattgaggagctggatttaaaaaacacaaatgctggtggagggcagatttttgacaatagaaacctcagctgaatctgaaatgatggtttttttcaggatagagtttaggagctgagtctgaagggctgtttgtatttccagttttattatgttttccaacaaagaaagacattgctgttttaagatgttttaaacactcattttttgatatgccacattgaccacaagtggtagtaaggactgaggatgaacagaacagttcattttaatgcagtattgttgtttcttttctttgcagttttattttatttcttacatagttccagggtctgagcaggagaaagaatctttaggatgcagtagttttaggatacactgtttcaagtatacagtgatttttataaaattaaaattccttacagaacgaaaggttttaaaatgtggcaaaggcatttttgttttgaaactgtgtgcatttatccagatttaccctggcctttcaataggaaaagacctagagaataattgttgtt

SEQ ID NO: 81489 - DNA, 1120 bp, Homo sapiens
ggatatagtttcttgatttccagtctgagatgttctgaaggaaaattctgaacactttagagacaacaaagtgcctaatgagtgatgcactctgatccctcctggaaaatggtgtttggcatcagcttagcaagaggaggttttccagttatttgtaaagatgtgatgtggctttaagtggggatgggggagggtagcagccccagtgtttgtggacattgagacctgttgacatttgggaagcataactgagttccactatttgaaaagattaaaactttgatatatgtacacatcccctcatgcctgcacccccatccccgagggtctggaaaagaattgatttgttctgaggaaggaacatatatttggaatataaaatggttagtaaacaaaggatctttaaaacaagttagattgttatctcaagagaagcatacttcctcggcatgatgttttcttttgttaaattgctttggttttatttgactcaaagtattaacaatacctttgattttgagacttttggacttttgaagactaagtttttaaatggtcaattttactcgtttgaaagtcccagataccatttttgaagatttctctccctttttttccactgatgccggctttacttatgttttattttcaaatcttaaggaaaaactgatatttccttacttgaactgagaaatagtcgttttccctccctcttttcttccacagtaaatacatgttgagtacttactggatgcagttctttaggtttagaaattatttgatactgtaaaatgtcttaccataagtttttaaagatacccgtcaaactatagatgttactgccatgtttattaaaaaaaaaaataaaacgaaacaaactagtaagcaagcttaaaatttttctttttcctgccctggactacagatttttttttcttttttttttttgagacagggtctctggtcacctaggctggaatgcagtggtgtgatcacggcttgattctgccttgacctcccaggctccagtgatcctcccaagtaggtgggactacaggcacacaccaccatgcctggctaattttttgtatttttagtacagacgaggttttgctatgtt

SEQ ID NO: 81490 - DNA, 2009 bp, Homo sapiens
ttttcttgccaccctgggctttgaattgaaggccagtgtgccaccttttctttggctttgttagaacgttgccctcagggtcatatgtgctggctgctatgaattcttactgcttgatggacagagaaaggtgagggttagatatctggacagggcatgacagggcgggtcatcgagtaggaacattgggaccttttgcttccaggcttgagcagtgggtgagaaacactgtcttcccattagggcagtgggtgaaacactgacttccctccatcctctgggcagccttgtcaggtgggtgtggaagctgaggtgtgtctgccccaggctgtgcagtcagccccgtgttctagcttcccgtgccgaacctggccctggaggctgtctgcctggcaagggggctgcacaaagctcggaggggcatttctggtgcttggtagatggtaggcctgcccccagtgcactgataagagcatgggctgagagtgccacttggattcggctacagtgggcggcagagtgggggtgactggtgttgcttttactctagagcagaggaggcagatgaggtagatcggggccccagggatgctgagctgagctgggtagagagaatttggttttgtaggatttggagacagagacaaatttggagtgtttggatgttcggggacctgcaggaggtatgtgaggtgtgtaaaatgcagcccctgttttaaaaagagcttacattgtctcttgagaagataaggtgtgcccagctgtggaatggaaccagatgcttttatgagtgaggatggagtgagcacactgggaaagagccctggaattggaggaagagatcattttgcccagagggatcttggaggtctcctggaggagggtacttagatgatcagaaggattatactagacttgatggggtggtcttggcatcagaactttaaaaatgtattttggggctggaagcaaggctggagaggaaggtttgtttaagttgtagtgggggatgaggctgggggcaaatcagggatggttttccaggtctgtaaaggctggggtaagaggaatggttggttcttaagagcaaaaaaaatcccttacatattggttctcttatttgtgctaagttaaatacatgggaggctactggtgtttatgaaataaccctgagcctttttggggaggtagtagtggatgtctgatggaagagatagaagactggtcccaggggttcttagtggcaccttcctctcaggtcatcactgtgcttttgcacattgcagttatatttgactacatttgattatggcagatttacttagaagggcactggaaaaaagcctcccaaattacaactgacacaggaaatgactttattttcttctattttttttctttgcttttctcccccaatcaacatacatttttaaacctgtcatctcacatgacctgccggtagaattgatatgtttaatttctgtagaaaataactggaaatatttcacaagctccagtagcttcctgttgtagggacccttaggactttggaatgagaagttttctattgagttgtcatatttggaaggataaaggtgccctcttttccctcgatccacatagtagactcctgtgtgcgggcatttgtttggtgtctcacgttgatgcaaatgcagccattgcagagtgagccccgctctgttactggatctccatttgctcaaaagagagcagtgtccccctccaaatctgcatgtctgaaagcattcatgcaggttcattgcatgggtctttgcattttacttagacttagcaaaaatcaggtatagtctttcctgaaaacaaaagtgaccattgtttttaatcaactgcagggtgtttggagttgtgaaatatttagggtcccgagtccattccagattcaacattgggaaagaatgagaaagctgaagcctggggcaggctctgtctgcagaaaccatgggctatcaccccctctccttagcagc

SEQ ID NO: 81491 - DNA, 1049 bp, Homo sapiens
ttaaaagtcatagcgataaagtctcagctttttgagagagtgggtttcagacatattttaaaatactactatacaggaaatctgattgttgcattgaaacaggatttgttatcacatcacggttagacatacccaaaaggcaaaaactacagtggtcatgatggctttacataagattttggaggagaaactgttagctccatgaaagcaggaactgtgttcactcttgaatgcctgctacctgcacatggtgaatgttctataaatgtatattaaagaaatggaggtccttagagttccaagatcaccgtcaatatcatcaccctaggcttcctcgtccttccagttacttcttttccagaagagtccattgcctcctttatatgaggtctacagagcgcgttcagagggctcttatcattgattcagcaatcacgtgtacacatagcactagaatgacttcacatatttgacctgtttaaaaataacgtgcagctatgacgaacagcgaacctttgattagggacacatttgcctgccgccagacactacaagtattatgtgtattgcttttttcaaattataatagtaatagatgattatgagaagaaaattagaaaataagttttctgtctctctataaaaggaaaataaaaattatccttaatctcaaggtaaccattgttaatattttgttgtgttttcctgagattttccccctagacttatatgtgtatctatatatttaaaaaaatgaaattagtagtatactatgtacacacatattgtgaatttctgcccataacattatatctttatcacctggaatgaggtctttaatgaaattattaaaattaaaattattctataaatgctaaatttaggtattttacaattttttttttttttttttttttttgagacaaagtcttgctctgttgcccaggctggagtggactgcagtggtgcaatctcagctcacttcaacctctgcctcccaggttaaagcaattattctgcctcagcctcccgagtatttgggactacaa

SEQ ID NO: 81492 - DNA, 1406 bp, Homo sapiens
gtaccctgcctcccactcttcctggcaagaccctgctcatctttcagggtcgtctctgctgagaagtcttcctgacctcctcggagatagggagttgtggggccttgtctttatgttcccagggttctgtctattgcgctattaaaactttttttttcatttaatttgccacttgctagagagatggttgttctgccttcgttgtgcaaaattcagtgatacactaatcctctcctaacctcttaaatcattttgactttcacagagtgatagtgtctagagagggtttttgttgtactaagttattggttccaaagaattcattttaagaggagtaaagaactactatagtatgccgcttactgagacaaaaccgacttctcacataagcccaaaggttttgttatgttggattttaccattagagttaaagatgatgattggttcactaatgtgctttaccttcacagtgtgcctgtagacctgtagtaaaagaaggctaattatgtttcctgatgtcttttatttccaactataagctaagcctatctcattttttttttttttttttttttttttttttgagatggagtctcgttctgtcacccaggctggagtgcagtggcgtgatctcagctcactgcaagctccgcctcccgggttcatgccattctcctgcctcagcctcccaagtagctgggactacaggtgcccgccaccacacccggctaattttgtttttgtatttttagtagagatggggtttcaccgtgttagccaggatggtcttgatcttctgacccgtgatcctaccgcctcggcctcccacagtgctggtattacaggcatgagccgccgcacccggccaacctatcccatatttttaaagaagagttgatcaagtagttacccattttaactaaatggataactataacattctttaatggaattgttgacagagggataatcagtgtttttgctaattcatgccaccctcctttgttgtatgttagtaatatttacattggggcaacaaaatagatcagtatttccattaatgtttacttaataacagctgctaaaaggtattactgtttgcagtaacacaaaagcacttacctgattcttatgccagcttctatagggtaggtagtgacagcccattttgcaggtgaggaagatggggtttagaggtgaggtgtgtctgcctgagagcaggagctggtaaatggcactctgggctcatgggagtcacgctgtttttttttttttttttttttcctaggacctcaaggttgtgtctaagacataatttacagttctcgtgtaggtcttccaaatacttagctacacagctttggggcgttttctcagccaaatgcttttctttagcccttctcata

SEQ ID NO: 81493 - DNA, 3605 bp, Homo sapiens
ggttctccagtgtagagtagattgattgccctgtgtccttcaggcagggtgcagtagtaagttattgatacttggctgctgagctgtcgttcaggccttggcaactgacgctctgcagaacggaccaggagtgtgcggtggtggagtccggctggcctgggttgcagatttaactttcgcctctgcctctgtgtgcctctgggctgtaagctttagtttgcacggttaacggggatggcctctcccatggtcggttggagtgtgttgcacagcgtctggtccagtgttggcactgtataaatgccagctaactggttagccacctaaactgtcagtctgcaacccacagctctgcagtgaacaattgaacctcatttctttaataataatacaggattcctgaaaaccaactgtattattgtttggaaaatagtttaaaaattatttccttctaactgagacgtttaccctcttgtctcccttcagtctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaagtaagaatgatgctgactgctgctttctctctgcctctctctctcctctcctcctccttgacctcccttctcttctgagtgcacgagttccgctgggcagggtgcagtcgtgttgcatttaggacgtggcatgcctgctgtgcggaagtggttcccagtgggggtcttggttggctttcctttgcatctgggactcttggattgcgggactgtggcgtggctggaggccatcatggctgctgtcaagactgttcaaatcacatgttagaaataatccagcacactcctgggctagacacttgctgaccttcagctttgaattcctgatgagaaaggtgacctggtgtgcttggaagtccctgagccttggcagctgggggctgcttatgtgtcagctctttcatcctttgtgcgaagtgatattttttgttctgcaggacttccttagtttgaatggacttggaatatggttaaataaagggaaggtaaagcactaactcatatcctgtgaaagtggtccttaggtcctagtgatgatgttatgatactcaggtgtcctggttatgacagagcacctggcccaggtgggagacctctggacccatttctgcaagtcccaggttcaggctgtacttgcaggtagctgtgtagcagggtgcatttttaaacctctgggattctgttttcgttcttttatacctgtttactgaacagttgtgaaaatcttaagatttcacgagtgaaggaactttggaaagtatttactgttctgggggtcagatggtggtattttgaagcttcttgtatatttatctgcaatatgcttattttcccttgagaataactgagctcttgccttcatgtgatcagttccttaagaaccaggctgtttggtattaaaatgtgactctgagccttcaccttattgcattcagcaatagttatgtatattggctaggaagcttttcctcactggtttgaagtcagtgtgttagctataaatagctattatttaagtgttggcccagttaaagatgtaaggaacccatgttctctagttatgaagaaccaagaaaccccaaattgttagacttgcctaaaataaataaaaggcgagaccccacaggggtgaagtgtgtaaagtaaataaaggacagacctcccaggtagcccttcagttcccgttcaaccagtcctgaggcaggaaaaggatctgtgtaccctgatctgccacgcacttttctattctgcagaattggatcagtgcgtatgtgaacattgattagtgagggcaggggtcccactggctgcagccagtaccttgtagagctctgagaatgcagtcaggccactttaaggttggctggagttggagggagatcttatgctaaagtcacttgtgtggttgattaaaactgccctatcattaagttacccactggtttgagaaaacaacaaaatatattttttaaataaccttgacatttaaaaattttatctgaaaagtaaaaggtgttatcaagggaggcagcatggagtagaaaagagatgttgaatgtggtgatgagggccaggaatgaccttggatgggccagcccttctgggctgtagttgggcttttttaggatatttctagggcagtccagtacatcccttagtggtgatcatatatgggcatgaggatgttttgaaaactcataagctctttagagaagggaggtgccatatgaaacgtcattaagtggagagttgttcacgaactaggtaggtagttactttggtcttgccataggtttttggctgtttctgatgagctactgattgaagacccctggggtaggggtgaggcctgcattctgggtccaagtctaagagtggcgactagaaatgagcaagttatttaaattgcctgggccttggtttcttcatatgtggaatggggtaaagcctgccttcctcatagggctgttggaagatgaaaaggaggaaggaaaagcaccgtgaaaatgttaacgatggttagaaggtgggctctgctggtgacagacagagccttgatatcacctgttggttggtcacctgcttccccaaggccacgccctgcagccttctccttgaccatcccagccctgctgatgttccttgtgatttcacaatggagtacttatataaaattggtaactgctttccgggaaattgacttcccttccccttgtcctgaaaactcaggcatgggcatatttcttggagattttctagttgaatcagaacttcctcttggtttgcgtagattccatttagacctgcattgtccagtgtggtagccgcttattgagtaagccacgtggcttattgagtacttgaactgtggcttgtccgaattgggactgctttaggtgtaaaatatacactagatttccaagacatagtatagcaaaaactctgtacaccatttcattaataattactatgttgataacatgttgaaatataacattttggatatattagattaagtaaaatgtgttcttaaatttcacctgcctgtttcctttttattctttttttttttt

SEQ ID NO: 81494 - DNA, 1691 bp, Homo sapiens
attacaggtgtgagccaccatgcccgactctttttaattcttaatgtggctacttgaaaatttaaaattacagatgtggcttgcattctgtgttggtaagctgctttagagcatttcttttaacaccaggagttcttcccctcatcatctttttggctgagtcgtcactgcagcgctcatagccccgcatgtacctctccagccagaacccttaggaatcatttggggagctccatgaagggcattgagtccaggcagaatggctaccttgagttcaacataagcattaagatggccattcgaaaacattaagcacagaagaatcccattcaggtaatcttctgttggctggctgtagaactacggagaacatctggagaaacacgtcaagggtgtgtgtgaaatcgttgagcctactcgattttgtcgtgctgttgcgcggttttcacttggcactgtcctttaaactccttctgtgccgtgactctgcagtgtctggcagcgtagtagactctactccctctatggacgtgatccctctgtgggttctctgcacacttctgtatttctcggttctttttggatttaggagtggattttatacatttttgagtcattcctaaagagcgattgacccttaaagaactgtgtacagtggtttcctttcagtaagaacatagttgtgtggcaccccctgacatgtggtgtggttgattcttcttccttgtcttccaacgccaccctcttatgagtctcttcctacccccacaggtgccgcttctctgtctcccttccctcagtctggcttttaacggtggtctcctgacatagtccattcaggctgctgtaacaaaatcccataccctgagtggcttacacacaacagaaatactgctcacagttctggaggctggaagtccaagttcaaggtgcttaccagattaactgtctggggagggcccacactctggttcacagaagcaccttttcactgtcttcacatgttggaaggggcgagggattttttttctggcgtcttttttataagggcactaatcccatttgtgagggctccaccctcatggcctaatcacctcccagagccatcatactggggattaggtttcaacataagaattttgaggggacataaacattcagatcatagcatggctggagttctgtcctgggctctcttttcactttccttgttctcatctcatccactggtaactgcattgcctcctgtctccacctaaacttccaagtatctccagcccagaacccttttgagtccaggacctgtcattcatatccatcccagaacccttttgaacccaggacttgtcattcatatcagaccaccacgagcatttcactacagcctctgatggtcttccctgtttcctcacttttgcctattttttttcttttctattccctcttaagtgggccacacttttgttcccctggttcttatgtcaggaatgtgggtgtcctttggacacttccttctccagttggataccaggccctttccctcccgaatggaatggaaatgctgcttcagctgtgttcctctgctcctcccccttacagcagtgacatagcctctctcctgctattgtgtcctgtggctccaccgagcactggggagcttttcagtatgcactttttttttttttggagaa

SEQ ID NO: 81495 - DNA, 1053 bp, Homo sapiens
cggccatctagtgtgcactttggactgatgagctcccctacctgaaatcctgtagcaagtccctataggataggcatgtggtacagtgtgaagctcctgagtggtcaacagctaccccgtgacaacatgccacactccatgtgccactccctcccgcctgcctgctgtgtccttggccccagtggtgctctcccgtgctgaccagccggcacggctcacctggccgaactctagccttgccttttcctctcaaggatgtaaaggctctgcagatttcgggaggcctgtctcccagcacctgatgggacactttttgccccactgtaaattctgggtgtatcctccactgtatgctgtcaccccaagggcaagcactgcatctgcttagtgaaggatttattgttcggaagatacattttccccttgagcagagagtagcgtatcctggcagtcttcggtgagccagttgtaccaggattatgaaatgcagatgtttactgtgtcattgttgctgtcattgctactgaggagtactgaccagaatcatctgcaactcttagttggcagagaggaccactatggcgggtagctcttttctttcctgccattgtggggatgattccaggccaaagatgatggagaagtatggaaatcatctgaaaggttgaagcttggcacgtgaagccattcatgactttgtaaggcagttttgctgaaggccagttctgccctgggagggacggaggtgaatcctcctgagtacctgtggttttcttacttcctgctgaatttacctaagtgcctgttgtttgcttgctgtggaggctttctggtatttcatttcaggtgcagatgccttcactttcccacaaaaaaaaccccaacaaaacctaagaccttactgcaactaagtctccaagtactttttaacccattgggatgaacagcctgtggtctgctcagatcaccctgagtgcgtgtgagaaggcctgggctttgccaggaaatccaggaaggcagggccgggctgtgttggaagctggcttagctggt

SEQ ID NO: 81496 - DNA, 1859 bp, Homo sapiens
gcagtggctaacacctgtaatcctagcatttggggaggctgaggcaggaggatcgcttgagtccaggagctcaagactggcctgggcaacatggtgagaccttgttcatataaaaaaatttaaataattagctggttgtggaggcacgtgcctatagtcccagcactttgggaggctgagatgggaggatccgcctgagcctggggagatggaggttacagtgagccgtggttgtgccactgcacttcagcctgggcgacataatgaaatcctgtctgagaaaaaaaaaaaaagattttgtaactaagttttatggctagctttgagaaaggaaaataataataaaaaaagaatgtgtaaatcacctgctggatggggggaagaggggcacattgtctttgtagtgagacttcactcatgtgatgtgcagtatttcatcttaacattttttttttaaacttaagctacttgtgaagagctgagatgtttctgttaagcactgtgtggtctgctgctggtcttctgcaggccactgttccccagactgctaagacgatcatgacacaggcttgcattttcaggtggactcttgggaggggcttgtggaccctggaggagaaggcagccaggagaggggcatctggctttgtgttgttggtaggaacttgtctcggttgccctggaaggcctctgctctggtcagctgctcccagtgtgggggtgatctttatttagaagggggtcacatgcccccaggcctcattgctatgccttttatagtcaggcgtggagctcacattctcttctgcctgattgccgacgcttgttgccgagatggtgaagcagtttgtgtgcaggttccctgggacctggcttagcccacctcatttcttggggcgtgtgccttgtgcctcaaagactttgcttttggctaattgtcattagtgatggtgtcaccatcctgggcctccttcagaagtttttaatagggatctcgtctaagagaccaaaaagctttcagaaccactgacttgtggtgatttttgcatgccaagtatttggaaaatatctggagccccttcagctctcaccagttaaacctatttgtacaattgttctggtttcttcctgtgcttgaaaagcctctttctttgttgcgttaatacctctgtcttgctttcctcatgtgtatgccagtgtgacattctcggcagagtggggatgacgtggagcgtgtgggcccgtggttaatcttgtcctgaattgccttgctcaacttgcgtgtatagggtggttcaaaagttaagtttggctggtggtgaagttggaagcatcacttagaaacacgcctcctttgggcatatggtgtgaatcagggactctggctataaaaggtggggtctctgagcaccatcctggttggaatgttcccctgacttggaggtagcgagagacagccaaggtgtttgttccagggaggctggtgggtgggagatgggatttttctgtctgtggcacaggcagtattaagtagagcaggctgtttaaatcacattttaagtaaaaaccaaagtgcacagatgatctgcagaacttctgggggataagaagctgctttcctcgaagaagttcatctccaaaccagcgcccatggctcagcagccagcatggcagccccaggggtacatgggacttgggcatgtgaggctggtgagggacagggacagctgggtccagcagtgcctttcctagggacggttgccacgtcacctgtctgccctgtacttccatttcctttctttgaactcggggggcttgcatcggactacctgtgccgtttcctcaaactctaaaattga

SEQ ID NO: 81497 - DNA, 1068 bp, Homo sapiens
cagctttcccctgcttgttttccccatggcatattaacagcgagatctgcaagaatacatcattttgtacagaacaggatgtatttcttttaaactacgttcctgtgtggacaagtggtatcatatgcaaaggtttaaggaccgttgatgccttgagatagtgccatctgtttgcctcaggtatgtggtgctaggacaaagctgccagacctcaccttccttcagtgagacaggaataggacagtatttgaaaagcatctaacatgtttccaagcacataggtttttggtaaatggtggcagctgctgctattttttttttaaattaaactatctaagagttgcattctaagaccatctaaaattctgagtcttaagctgtgttgactatatatgttcactaccataactaaatggtccttctgtattgcttttctaaattgtagaatttcaattattgtaaatagcgggccatactgtaggtgtggttcttgctaatttgattcgtactgttcaaattcttgtgtctgtccagataaactgtatctttacagaacattcagcgaggtacatatgtctatatcggggtgccagtggagtcaccctagtcatatgtaaactctatttatttggttccgaaactgaatttattttgtttgcaagtttggtatttgggagcatttaagaaatatccatagattcttgtatgatactgacattaaatcattaaataccatattttttaaatgcctctgtctgtttgcatggataacattaaagtggttagagtgggcacagttattggtaaagattacaaagatgtgcatttttatgacaactttaggtctcacataggtagccaaccatctgctccaggatgaagcatgtgcctgtttatcctcttctttggtaacgctaggtatatgtgtgcacacgtgcacgtgtgcgtgtgtgtttgtgtatgtgcgtaccactttattctcccacccagcctcttctcctgttttgtttagtttcattttcctcctctcacccccattgcaggaaacaaacactggctctctgtcct

SEQ ID NO: 81498 - DNA, 1748 bp, Homo sapiens
cagatctgtgaacccaggctgccattctggatttccggatagatgcaaagtgcttggacgtgttttagcagctgctgagaccaggagttgggcttagtagtaaaaagggggaacaaaataaaagaagatcaggagacaaagagcctacagtacaaaaaaggaaagacgaaggttgatattattagaaatacttcctgggcagccttactgtttgaattaggatcacccccacccccacctcccagaggtattagttgtaatgcagagacaaatggaaactagtcagatccttgggtcctagaaaagaccagctttgttcctggggtggtaacctagtacaacgtttccgttcctatttcttgacctctgaatggccccttctgctttgctaagtagatgatattattaggtgcttagactattcttcagataggatgtaaggatatatttttgttctcttcctcagtgaacttgaaatgattggattattttgtaatacgtcgatactacttttagaagcttttgaataactgtgtcaaagaagctttagaagaggttttaagcaggattgcagagaatgtactgagtgtgtttttccactcacaaggaaagacagcagctgaatgcagaagtgtgtgtctggttctaactctttatcacttcagggactgtccaggcagcaccatccgttgggtctcctgcccttcctcctcccacccctgccttacccctggccattcttttgtgaccagtagtcctttatgaatggaattctgagaatgtataattttctcagaagaatgcttctttagctcaccaaatatttcttgtttgctgaggggggaaaaagatcctccttggaaaagtcactgggtgccaaaggtgggtgatgaggagagatgaacttctgggtgtgcctagcaaagctgtttctgttgataggcgattaacaaaacagccaaacttgacctaacagactgccattttgagaggaatttgttttgcaggattaattggcttcgaggtgtactggtggctgtgcagtgatgacggctgtcgtgcctcctgtgtcttctgctcattgtgatgcagggcaagtgcttaggcctcagacacaggctccctgaacttcgtgttcagtgctttagggtggggggacttgagacccttgacttgactcggtcccactggaaagcttctgttgcttatttgggtaaccccaactctatcttattgggcggtagtgttatcctaattcttggaaatactcagtgtagaataaagagctgatgaaaatgtgtaagaagggagtaagtggtcattagagagaaatggtaattgggatgatgctctgaccccttcagcaaaaaataaaaggtgaatggtttattatgagctagttcagattctgtttttggaaatgagcttggttatacatagtgcatttgaaaagcgtgaagcatggactttcagatgccagctcctcagcctcctgtaactccagtcgcaaaatccctccagtgtatctaaataaatgcaaactcatcagtgccttaccattataaagctgggctggagaggcaggtggcctggagaatcaaatgacaagaagtatagggagcagcccagcttcatgatcgggggaatttgcatgaaaattgtgtacacttaagcaccattgtctattgcagaaagcacgatctggcctcttctactgactttccttccagctctgagattcagttttg

SEQ ID NO: 81499 - DNA, 1012 bp, Homo sapiens
taggaggtggctgcaattggaaagttccagagagcttactgagggataacggatgtaggacaggaggctggcaaagcacctcagtgatagggcagaaggaaataaagtggttagggaaggagttgagagcaggaaattcaggtaggattgatgttaagtcttagatctttgaagtgactttctctggtctggcttttgctgttaccaaagtgaattattcataagtgcatatgagaaatgctgatgtaactcgattatgtggaatgaatttaaattcatttaagtcattcttttccactaaagtaagctttccctcatccagaatctgagcagcccgatagccaagcaggagtttccttgtgccatggccagtgattgatgtcttcttctatgatgctgctgaaatgctggggactctgaagcgcagctggagtgatcaaagcaaaattaaaatactttctcagtggtttgggagttgggtgcgttctgctgtattttttggttttcggcatctgggtttggtgtgcatgcatggtgagctctagctggagcagacgttacctactgaggctacgctcttcgtggtttctccttaaccatcacccacttgatcttccatgaagccccccaaatcttccttactgaggactcttgcttccaggttgcttttgtgctcatccattgctgggttatttggtcagtgatgatggtttctctgtactttttatcagtaggttcagaggaccttgtttactcctcattcatctctctccccaaacagttgagaaaccacttgtgggttaggactcatgctttgtttataatgtttgattctccaacctcacagctaatgggaagcccgtggaggagatactctgtaaaaatccatctcccatgtgggcttgaccccacttagtgtctgagtggtttggtcctcatagttctcttgggggaggaggaagggaaggaggaggaggtggcgatggcagtggcagcagtggtggcatcttgg

SEQ ID NO: 81500 - DNA, 1319 bp, Homo sapiens
ggtcttctctcagggtagtgcaccatgagagggagcacctgtttacattttgtatcctggacaccaatcttgccttgctctggtgctggccctgagaggtgcaggaattttataaagagatttacaaaacatttttggatgaccaaattggtccctggttctagctggaatgaataaacaaactaaataacagtagagtgtgagagtaagtgtgtgtgctagagaatgtgtgcacatgtatggcctaggtgagttcttcactttgctgacttgtgaattatttggggtcctatggtcctccccatcattcttattcatgtcagtccaccatcattaaggaagtggaagcgaacacattgtgtacatatcactcccatagagagggagactggggaagaggtttgagttataagtcgcacctaggttaggtctggatgtgtctttgcaggtttccttgctagttccttggccagagtttccatcgtgtccctcagctgcacaattaaggtgcccccgttttgtgcaagtctcatgctaggcagtatgagatgacacaaactaggattctgttgtgagataagataaaaacacttgacatttaaaagagagagacaacttatgcggtgtgacgagacactctacgacttttgccagaagagaaatagaggcaacaagtgctaggagctcagaggagggtaagttccacatttggaactttggattaaaagaatatttgggtctggttgaaatcgaggcctttcatgagaaatgtccacacttgctcagtactgtttgccgaacactgtatacaaggccctcgactcgtgaatgagttgtaatgcaaaactttgccaggcatttggaatgtggagtatactattttgtaaagatgaggtctgaatggtggtttaggtcccaggccagtgtccctctgccccccacctccatatgtgccctcaagccggtttggcttagacattatttatctctgactactgtgtacagcttagttccatggggaggaaaaggcttgatgaaccctaccctggaaggctggtggctctgttttctgatggatgaggtaggagtggtggaaagctggtagtttctactttgtgcctgtttaaaaagccccctctgaggccttagcacttaacagatgttcaggattgggggaataaaggagctgcctttgcagaggtctgtgggcatgcagtgggtgagagagcaggcactgagtgccccgagtttcctgcctgtgtgggcaggaggattctcagtggaatcaggagcatctccgcctggtgctggaggaggtg

SEQ ID NO: 81501 - DNA, 1382 bp, Homo sapiens
tgatttttgtgaagcgaggacttggggtcccaagtctaggttttaggttccctgctgtaacccgtggccaccgagagagagttttatgataaaatgtcagcaaagtacctgacaacgtctcacgctagaatgagtttcgtacatgtttagttccctctctttttattccacgctcccccaccccaactttaaatcagaaacgtgagggtgctgattgaagctttttataacttttcttattgagaattgttctctggagttgtctccaagaacaaaggaattccagacgttcttcttctctccttgtctcttctgtcctccagtcaaagaaaaactctgcatatgatctttggcctggagaaatattaaatctatgttaagtatgcagacatgaatgggcaaatgaaggatttgtggcaaagaagatctgccgaaacaaataagtcatgtaaatgggcagagggaaatattaaattgattgcatctttcagctcctggtacttaatgcaaagataaagtagtgggaaaaggttgtcatttgaaataatggaaagatgagggagttttgaagctagctgggatttttctgcctgttaatagagtgacttggattacagactataaagataaagagtagggccgttgcatttagtatggatcatgatgctgattgctgtctgagcaacctctgtactaagggaggagaagctaacatccccgggcctggaagatactggatactagctcattaaactcttgtgagaagccttcattagcattatgggaagacttgctgtatctatattatgaaggcatttagatttttttttaaatgcatgttcttaacattttttgtttattaagtggggcagtagattaggactgaatggatttgattctctcatcctacatagtgtgcccagaagccagaaggtttcccagaatttgtattatggcagcgagggcaaatttaattagcagataggaaaagctttggagcagtttaggccaatccatttaattgtatcagcaattaatattttgagaaaatggaaataattaaatttacatttcttctaggactttattttgttatcctttaaggttattgtaaatgaggagacttttgaactcacagactaaagcaaactacaccagataatcattaactttttctattgtgtgccacccttcccaaccagattgttccatagtatcacttatgaaccaagaacctgtgagcttgcaaaacgcatttttaaggagtctcaacttttctgatttgtgttaaagtttaggtgtgggtcccagaaatgagtttcatggaggggagaggttgtctctctgggtgggtaatacaggggccactgggggctcactgt

SEQ ID NO: 81502 - DNA, 1057 bp, Homo sapiens
gtgccattttctgattaagctgagacctctgtaatagacacgttgtcattttttcttgtgtctaaaagtttgcttgactgcagtgggtctccagctcagagcaggtctggctagagaaaacaggaggtgatgactggagcactttgcccttatggaacgtgctctgatgtagaaagcaagaggattttccttgcagtcactgaaggtaccttgtgtacacagaaagaagacagagggagccccggatgcctcggtatccctcagagccggatccttcagacctgtgcagtacctgtggatttggttagtcgatgatgcgctgccattaaaacaaaggcatcggccctggaatagagaagttcagtgagaacctctgtactccatgggcattttctaggaaataatttcacctgccctgtgtaattctctggaagaatcacagtgagttggaaggaaacttaagacttggaaaaggattgagaggttagcccagaccacaccagggctctgaaggcccagctggggttagaacctgggacaccctccagcccactgtctcctgttccctggccatttactgccccactcccctttctactctcaggggccctggatctaatgaggggattcgtgcagtttgctgcactaatacattgcaagtggtgccaacctaaaggtattctgatggtggaatcagagcagtagcatcttattaggtcagaatctgtatctcctcttccaagatttttacatgatttagtgttttctgaattggaaaaaaacaaaaacaaaaacacacaaaaaaaccatgtctaaatcctagcatttcatcccatgttgatgaaagggcatcttttttttcccctaatctgtggttagaactctcagaaacttttagaagatccctcctatgttttggaggtttgcagatttgaaccccagttcctcccacagtgcttctccaactcctggaatgaggtaaacctccaggcagcctgttgacccaacccatgcatgccggtctttgggactcctagatgtggaccctggagtgaat

SEQ ID NO: 81503 - DNA, 2931 bp, Homo sapiens
gctgatactatcataatttttaaattcccataggactcactgttaaaggattacaaggctgacacaaaaaatactgcattttgaatttgtgtctgatttatacatttccaaagagtggaattctcactacaacagctgttctttgaaaggttagatctttgttctgagataaattaagtggaaaaaggtgtagagcattatatgtactctgattcttcagggcttaatttaaaaagagcatgtttgctggtgaatgctggttcaatcattaagaagtttttgagaaggaatcccagaaagtaataagcacttatttttcatggaaaggaaccggaagtgcttggtgacctccacaggtaatcttgtattatttttgcactgtttggaattttttaaccatgtgcttttatttcttctattcttttcaaaggtcagtaggtgttatctggacaatagggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacagtatctgggggcctccctgcccttcccagtaagagctgggccttcacaggaatagaggcctaggattcgccttcatcctcttgaagagccctaacagtaggtcctggctggggtctggcatagaatgcccttggcacgatgtgtgtgagtgtgtctttccttagtaaatggccttgaaaatgccatgtgcttctggcaggcctggataaggtttgccctgcataacccttggaaagcacagttctcacttgtaacaccctgtctgcaggtccatgatattgtaattaaaaagttatgggatcacaagggcctatttaaagggcatctggtctaaaggcacagttaaaagcagaatttgtgtcagtggctcccttaatttctcaaatatggttctgtttctaaattcatcccactggatgtctgtgttgagttttctgttgatgaaagaatgtttaaaaatgaggcagatccaaattctaatgtctgagtgtaccactgcttaattactttgggcaggtcacctcacctctcttggaaagaaaggtgatatactacatctgtgattttcaatttttttttttttaactagacccacagtaaaacatagatatacaccatgatcccaggacagaataagtatataactaaaataagtgttttgaaatcacttcttgtctgacacagcactcacgctttctattcatgtagtaccacgatactttcttctattctaatgctggtaagagatgccttaaactgattttgagaactaccaatgggtagcagctagcggcttaaaaaggatgttattaaggtccttttcaccctgattttgactctgttggctctcagctgagtgccccatacttagtgcacatagagttggcctctgaggtcagcctcctgttttcctgtgaaaatgaggatggaagagagtcacttgtttccctccttcatggctaccccctgaggactgggaagaatttaagaatttgagtatatgttcccaatagcatgatgtgtttcattgttcatctgtaagcatttttaaatattcgagatctgtatcttgggtaatttttatcaactttttatttgtaaaataatttcaagtcagttattaaagtaacaaaaataatggcaaacttgataccttcccgtatttttttttcatatttttccttgaatgcttacagaaatattaaagaatattatcacatcattgtagtcaccgatgaattattttctggtggcttatgattagaagagcttgactcggagtggaaacagataacatttgagtgctctttctgttaattcatccttgtcaataaccccattagctaacttccagcaaggctgtgttaggaatgtggaatcaattagatgaattttgaaaataacttggtctgttctaaaaggccctatgagatccaaactgttgtggcctggtgcctggtaactttgatggccattttgaaatgttaccgtagtgataattcttctggaatctcaagtcattaaaagtgatatggctaactctgggccctgtgctataaaaatagatgtcatgggatgtgtgaatcctttcttcagtgttatagttaatagcaactgaaggaacgttttggtcaaatcccgaatacttattaggggctcactgcttggctgcatttttctcctctgcgtaaatcatctatccatgtaattattaacccctaagaatgaatagcatttttaaaagggttccattttcccctcatatgactttggttcattctcctccttgtttctgtctctcagtgaactttccaaaagatgggttatgatgaaaggtgaatcgtcgttgataactgctcttacttatctgtgtatcgaaactgcaggtagtgctcttcagctctgtggctggatttagtgcctcttctagggaggggtgggtgttggcacaaagcgtatcccatttccctgaatgtcgtgtggacacgtgagaggacagtgcaccctttgggcttggtgctgcccccttcacgctactgaaccccagggtcataattaaaagctgtgttagctcttctctggttagaggcatacaggttggaggcttgtacatagccgtgagccggttggtctaggccaggaagcaaaccattggaaaatgtggttagcagtgacagttgacagcatgtttgcctgcagtagtggtggttggtgctgcgtgttgactggagttgcttgcattgggagagcctgacttggccaagtgtgtagcttgagaccagttggattcctctcagagagacagtcttcaccc

SEQ ID NO: 81504 - DNA, 1133 bp, Homo sapiens
gattggtgtggagggggcaggggaagacttgcctaggagcagggcctcgcaggatgcagaggagtttgccaagtaccagagattgtggggtaggtgaataaaggctgagtataaggataagtcaattcaggcagatgtcctctaagaatgaaggtgagaatgctggcggaaaccagttgtggccctgtctgccttccctaggagactggacctgactttacaggcagtgacggtgaagcagggcagtgccacgagcagatctgtgtttcctgaagggtctctggcagctgtctggggaaggagggaagctggcagagccgtgggtggaggcagatgccattgctatggagtgagcatggggaagggggtcggaggccttttggagatagatacagcaagacttggtgaaggatgaagttggggcaggtagaggaaaagcaatgagcttacggatgactggagactgactggagaagatgaccacccttgccattaactaggataggaaacaacaaagggtaggagtttgacaggggagaatgtttgtgctgttgagttgttgagtttaggtgcttgtggcacgagcaaggggagtgagctggtctaggaggtttttggaaacactgacctggctgcagagagggagatcctgggacacctgttttgggagttatcccagtggggaaggatcactgggaagggggccacccctttgggaggggtcagtgggacgactcccaagggaagaggttggttatagggagttaaaagaaaggagcacccctcacgcgagcccatttttcaaggatacatgtttgtcttttagattctataaggagtagctgctacacagaaagatgtctacgtgtgggtgaacacctggcgtatcccatgcagggaggcttcagcagaccttggtggcgatggaaccaccacagtgatccgaggattgggtctgaaggctcctccgagtctccaataaaaggggttgttttgaagggctcaggttcttcctgggcttttttgggacagtcttgctctgttgcccaggctggagtgcagtagaggcaatcatggcttattgcagcctcagcctcctgcctctgggctcaagtgatccttctgcctcagcc

SEQ ID NO: 81505 - DNA, 1251 bp, Homo sapiens
acattaacttcgcagtaaagtcactgaccccgaacctgtgtcacttcaggcttagccaaatgctaacagagcagctcaaagcttaagcagaggtatgtgcttgctaagtaagtgtgtgttttggactaattggtgactaccattctgaacattaactgccctttgtgttttaatgttgccaggaggccgattgtgtaacctttggaggcttccctgagtttggagaactgaattcatgtggtgacttcctatttataatgtctttgggggagctatgaaataacttttcttctaagtgtgatttttgcttttttaaaagtttttatgttgttgtcaattgggtatttcccttctatgccaagacgaattgtaggttcaggtttctatgcagcctgtatgtaaacactggccctaaagaaggactctatcactctactttcagtttcttgcattaaaacaagtatgggtagcggtatccttcttatttctgcttcctggtcctgtgtgagaccctgaaaggtcctaatggcagtgctgattagattgtggccagggttcacccacaagttccgaagctggggaaggtggaagtgctgttaactgacttgtcccatgtctggggttttgcagcctggggagaggtgaccacccctcgtttcagtccaggtagggttttatgtccctgtcaaaaatgtgttgtgtgaagtaccttgactttcatttcccagggaagaaagcccgtttcaattggctcaagcggaaaagagcactgtgggtccacttaatggaagagtctaagagtggcttcaggaagtccactgggggctccccgtgactctgcccacctgcatattgtcttcattctaaggatccaggtggtagcaaaagggttgttacaactttaaccctgcatccccaccttcaggttcagtacccaagggtgagcaatctgttccagtggcacagacctgtttcaagaggtctctagccgtgatagtgctaggccactgccctccaccagtgtgttccagagaaagatgctctgatgtgccagcccaggccatgaggttcccggcctcagtaaggaagaaggaggacaaggtggtcccttaggagaaaatgtggatattcaagaaagagggtcgcaaaatagcaaacacccactatggctgggcagtacagggttgcagaaatatattttgatgtgtgatcgcattggagctacttcaaagagcaaacacaccactttga

SEQ ID NO: 81506 - DNA, 2626 bp, Homo sapiens
cttacagtggtgctctagaagccatgtactgcttctggcttctccttcctttcctccaaggctcctcctgcctcctcccaaagctctgtgccctgaaagagccttgagccattgctcagatgtcaaaattgtattaagcagacacatcaaattaaaacttttgggatcactcaccaatatggtttcctgtacagtactgccctgaggggggattacaagtagttatgcatccatttcattgatgtatcatttttattaaaaagaaaaacaatccaaccaagagaggaagtgtagccagctgcctaaagagtggcgatgatgggagatgatattttgattacattaatccatatcctgttagttcactttgcttctgtcgctgctgctggtgaagttactaatgtgaactaattacatttgctctgaaaagccagaatttttaatgcatctcagcaagaaaggttaatattatcaatttaacagcatgaatgaaacattgtgtgtattgaacttgaactgtcctaaaagcttggataataaaaacccagtggcttcttttataactcactggataaacagttattggtgagacatggataaggctttcttctctttcagttttatggggggtggtaggcagtcagcattagatgctgtctgtttacagggtgatatcgtaacttcgtgaaattggaggccacatttaaaaaggcactccttccttttaaaagctttgcaagggggctgcatatattttcctaattagtgggaatattttcttttttcttttttcttttttttttttgagacagagtttcactttattgtccaggctggagtggagtggcatgatctcggcttactgcaacctctgcctcccgggttcaagcaattctcatgcctcggcctcctgattagctgggattacaggcatctgccacctcacctggctgattttttgtattttagtagagacgacgtttcaccatgttgcccaggctggtcttgaactcttaagctcaggcaatccgcctatctcgggctcccaaagtgctaggattacaggcgtgagccaccgagcctggctggtgggagtattttcaaagagaacaacaattcaccacaccccaacatggtaacagtctttttgttttagaagcatctgtgaattgccaagactcgtagaactaagatgtattcaaagtcagtcgattttctggaaacgacccagtccctgaagatagtcttttggggagttgagtgttttgagagggacaccccctctacagggacttaaaatggaatggctttttgtgtgtgcacatggtacctgcagtgatttcttgtgtttaattacttcctgcactcatctgacttacacagtggtaaacaatgaggatgggaacaggcggcagctgctctgtgccatccaccgtcttgggaaccccagcgtggcattctctctggggcagcatgttgaagtgtttggctggtgacattttggtgaccagttggctcctcattgtctttcaatgtggagattaggaaccgagcgaggatttggaacccttgcgtttgttctgccaagaacatgacttgcctctggcctgagagcagtggagtaagctgataggagctagaaatactgttttgggtaggacttacccaaaagagtgggctgagtcacagaactcccaagtttgagccctgtcaaataaattctgaattgttctcaggtatgtttctcaattggaatttttttaaaaatttaatttaaaaaagacttcgaaaagttaccttgttctcatttttcttctccctctttgccccgtccccacaatatcttagggcgaagaaaagcaggtttgagaaaagctttttttcatcatgtatttgtaatagctggagcctgctgagatgatgaggtagagtggagggagaaagagaccttgaggaggtgtggagggggaaggggtggaaagttctgtcgtcttctgtgcctctctctctctcttgctcagggtctccagtcagccctctgggtttgtgcccttcgtgctgcactgacaggtcaaagccgactcaggcctttgatgtctgctctaggagcaaaagtgattcctggtcccgcagccgttcccactgccttgtgtatgaaggtctgctgctctgaggtggatggtggctctaggcaggctgtttccgctgggtgcggttgttgctgcaggtttttctatatagcttggtcatgctcctgtatctagattaaaatcctatgacagatgggcctgcttatatctaaacttattcagagagtcttatgataggcaacaggttaccctttaccggggtaaaacatggtttattctacagtttggtcccgttgtaaggccaggagatagagtctcactagtttgccccggctgaactcaaactgctggactcaagggatccttccgactcagcctcccaattagctgggactgttggtgtcaggcacacaccaccttgcctagcttgaagatctttcttctaaatgagcgggctttaaagtgatcagtgggacctgggcaggttggctcttgcctataatccaagtgctttgagagaccgagacaggaacatc

SEQ ID NO: 81507 - DNA, 2060 bp, Homo sapiens
agagtttgcattgctttaaaaacattggttataagtgagtgtggaaacagtgtgttcactatttttatgctgtggctgtgctgtgcaggagctgggcttttcgtgcattttagacagaattgaccttggttaatgcttgacttgggaactatgcagaaacatccaggaagtggtggtggctgatcctgaccgtcctcagttttgtgaagcaacagcctctgtgcctctttctctgcatgctctgttgacggtctagtcttgagagagaacctgctgctgtcccgtctgtcatagccttcctagcaactcttaggcctgcgtgctgtgttttcatgatctcccccaaagcggcactttgatgttttttcagagtcaaagtatcactgtggatatttatcccaaacaaaattgcaaactgatcaaatgttatgtcttttgataccaaatcaaaaacgattcttggtggctgatcaggttgtctcctaaaaatttgccttttgaacctatactgcctttatgagatgattatgaaagtagaaaatagcctgtgaaaaatggtacctttgctaaaaagaaaaaaaaatttttttgaaactaagagtctctgttgtccaggctggagtgcagtggcactatcttggctcactgcaacctctgcctcccaggttcaagtctcccgagtagctggaactgcaggtgcacgccaccacatgtggctaattttcatatttttagtagagatggggtttcaccatgttgcccaggctgttctcgaattcctgagctcaagcagtctgcccaccttggcttccgaaggggctgggattacaggcctgagccaccgcgcctggcctgctgtaagaaaatattaaacttaggatgggaaatgtgatctgaacaggattcctgtgaaggtacccagtgtaggtcttagtctcctctccagtgtacatttatggaggggcaagatttcaccattctgtgaagaactctgcgtgttgacgactgctcacgcctagggaataaatttcagagcatgcgtagatagtgccattttctacttaaaatactataatccattatttacttcggaaaataaaagcattaaggctgaaagttttgggttagtaatcttgatgttttaaaatgccttagcattccttcatttgttttgcttgccacgtggttttgctctgatttacacacctctgtgcatggctaatccactgtgccactcttggggctttattaactcttctctgccagtttttcccttagagaatatcatggccattctctaagatgataaatgggactaagagtaaatgcaggctgaaaaagcatttaacaggtcaaggatctgaagcttttaagaaggcaaaacaataaataagaaacccaaacagagtcttgaagcacacccatcgaaacccaagtttcagaatttgctgcagccttgctgccaaatcacagtaaaagctgaaaaggcttttgtggttagttacgtgtgatacaagaaatcgatgtgtctgagagaagtaggatttctctttttgagggggaaaaatacagcaaggggaaatgttttattaacaataaatatgcggcttaccatatctgtagggcacagatttggttagtagtattttggaggcaggataaaggaagatcctaaaatctctgtgctgtgtagcttccattcgagctgcacatgttaaaaacattctaggatccacacagtttaaacaaggtggctggcttaggaaatgcttctccccattccttggcatccccacaaccctattcccctactttctcttatgtatctggactggcttttaaaagatatttagtgaaatttaattttctagggaaactccactttgtcaaaagtgtagtattcctcaaggatagctttgctggtcggcaaatctcagttgagtgtatttgtggtttaaaaaaaattctttctgaatagaaatacaaagagtgataatgtttaacattttatttttttaaaaagctttacgctgtgtaaattgtgggttgacttcatgttt

SEQ ID NO: 81508 - DNA, 1345 bp, Homo sapiens
actttgtatatgctttccttgtttgatccttatcaaaccttatgagaagaaactaccattctcctcatttgatggatgaggaccctaagccctggagaggccaggaaacattcccagagtccctcaggaggaggactagtgctgggctcctttcctcctgttctgctgcctctgagaggagccaggattgaatcgtagccttgtcctctgacctggaggtctgggagtaactctcttatgacttttttagcctagtagaattgaacatgaacttcatgttttaagggatggttgcatttgtttgaatggtcacttctttttctatcagtattagctaatatagggagaaggaagtcatgcttctcaagtaaagcaacagtatctgtgtatccatttacttgattgagctttctactgaattacaggagttaaattatactttgttacactcttgatattacaaaatgatggccatgcctttattataaaatgacaccagttattctttcctggaggatgtgccttgtgtcactagccgcactaagcacttccccactagtggccccatgtggttgtgtgtcatcgctgactacctgttacaggtgaggaagctgggtggtgcagagacagaaagccggtggcccagtcaggagctcctaagtggcagagccctgtctcctgggttccttctcctgtctttcttgcctctcacttgaaataagagaggacatcagaactggcctgaatggggccctggtagggcaggaacaggacacctctgtggttttgttatgatgtcctgaggataaaggagtgaaaaaaaaatctttgaggaattgaagatttctttatgaaagatggctgaaactcctgacagcttttcaaattcatctttggagaaacttccgttttctctttcctgttccgaggcttaaagctgccctgaaatctacacatttatcaacagtctcttgtcaagactccagggagacaagaactcttatacattgctgttgagagtgtaaaacggtacaacctttatggaaggcaaattggcgttataaatgcgtgttacctttgacccagaaattctacttctaggaatttatcttaccaatacacctgcccacatacaaattgcagcattgtttttgatagtaatacgttagaaataacccacgtgttcttcagtgggagactggttaatacactaagatatatgcacaaaatggaatgctctgctgctgagagaaaccacaagtatgccctgcacccctgtgaatagatctccagtatattaggtggagaaggcaaggcaggcttcttttttgtaaagttaaggagg

SEQ ID NO: 81509 - DNA, 1408 bp, Homo sapiens
gaatggttacaaattgtttgtgtgtttttgtaattagaatgtaatagcaatcgtctaccagatgagctgacattgtaatgacatgaagtcagtaacaattatgccttacaggaaaattaattctgtaatcctatcatcccatattttgcctaagagattcgatttggctgctgctaggctgcttaggcaggtgacagcatggtgggacacttctcatttttctggttagactacttaaccataacgttcatggtgccacctgaaaaaataattttatcgttttagacttttaaaatatttttaggctttttttttttttttggcttaaaaaaagaatctgttctacttgggtattttgttctccttatttcttagtgaacaaagatatttgctcgacttctatcccagaaggaccatcctttcttcttccttttccttacctctaagggatatgaagctgtgagagggaattgcatatagcaataccattttgattccagtgaaagttcttacctttctcttttgtcattctcaacctcttacctgaagagtccattccctcagtatatagagcatctggaagtctaaggtgcaggcaggactgaaagagctgagaaaggcctcacatcaggtgacactggggcacctggctgtgctcccttgttggggggtcccttggcctgggcagttttgcgcttctccctgtttccctgtgccctgagactttgtgggtcacaggcaagggggctggcctccctgatcaagggcccttggcctaggagggcccctggatttatctagtccagcttctcgtcgtccaggtgcaaaactgatgctctgagatgtttagggatttgtccaagagcagagttggagccacagtccaaatcttctgagcctagtatggtattctgtcatccttggtttcattttgttctgttcataaaaattgcccaaaactgctgggcaaagtggctcatgcctgtaatcccagctcctcaggaggctgtggagggtggattgcttgaggccaggagttcaagcctagcctgggcaacattgggagaccctgtctcttaaagaaaataattgcctaaaactattcagggttaaaaatttgtctctaagcttaagaatttggaaaaactcagaaaagtagccacctataactccagcattctgagaacagttaagtgtattttcttctagttttttgtttgtttttgagacgggatcttactgtcacccaggttggagtgcaatggcgtgatcactactcactgcagcctctacctactcaggctcaggtgatcctcttcacctcagcctcccgagtagctgggactacaggtgtacaccaccatggccagctaatttttgtgttttttttgtagagacagggtttcat

SEQ ID NO: 81510 - DNA, 2025 bp, Homo sapiens
acccaggctggggtgcagtggtaccatcgtaactcactgaagccttgagctcctggcttaagtgctcttcccaccttaaccttctgattaactaggattacaggtgtgcatcaccacgcccaggtaatttctaaaaaaaaaagttttttgtagaagtgatgcctcgccatgttgcccaggtgtctgtcttgaatgcctggcttcaagcgatcctctcccctcaactctcaaaaggctgtaaccctgattttaatggtagtgtaaagtgacatgggatgaaggaaccgtaacattcttaaagtttccccattgttgggcatttgcattggtcccagttttttataagtaaagaaggctgcagcaaactctgttgtactacttaatctttgtcctttatttcaaattatctccctacaatacgtcccttgaaataggatttctgtggaaaggtatcagtttaaagctcttgacccatatggccaagttgctttccaaacagcttacctgttgagactcggacctatgcttctaaagcctatgtgtgaaatgttcacattgtctttgggagaagcttcccacgaataagaaaaataagggaagaacaaataacataattgtttggatatatgctgtggtttgtgtggacgtctcccaccctttcccttccccagcccaagtcagtcttctgtataaacaacttacataatacagactcttcactgtttgtattatacatgtattttgtgagtctgtgtcagtatttgtttacacgggaattagggcatcaggctgtcttcctagggttcctctgtgcagacttgtagacagtatgggttctttgcgtgctgagttgaggtggccccaaacctttcagacagttgctcagatacctggcagttgctcatttacccttccagaccttcctgcctctatattagccaatgacaagcagatgctttccacaaaacattcgtgtgtgaactgttgacatttatgactgttttctgagcccacaccaggtcatttttctataaaatcagaactgtgagagctcagggcatgtggccatcctggataatgggtcctgctgtctggggagtcgttttcatcaaaattcacttttaaagaatagagtgtttattaacgaaaatatgtgagccttggctgggcactgtggctcccgcctgtaatcccagcactttgggaggccgaggcgggtggatcacaaggccaggagatcgagaccatcctaacgcggtgaaaccccgtctctactaaaaatacaaaaaaaaagttagctgggcgtggtggcgggcacctgtaatcccagctactctggacgctgaggcaggagaatggcatgaacccgggaggcggagcttgcagtgagcggagattgtgccacttgcactccagcctgggcgacagagcgagactccgtctcaaagaaaaaaaaaaagaaagtatgtgagccttatcccccaaatgtacctgacatgtgaataatatggctcaaactaatgatgtgtataatattaaattgactttgttattataagtgatacataattcaattttagttaaaatgcattatttcaatcaatatcaaatattgcagaaggaaaacctaaaatagtagccaaagttactcagatgagataaagaatatgtttagggctggaaaatcatactatttttttttttttttttttttgagatggagtcttgctgtgttgcccaggctggagtgcagtgacatgatcttggctcactgcaacctccgcctccagggttcaagcgattctcctgcctcagcctcccaagtagctaggactacaggcacgtgccaccacacctaatttgtttgtgtatttagtagagacagggtttcaccatgttagccaggatggtcttgatctcctgacctcgtgatcacctgcctcggcctcccaaagtgctgggattacaggtgtgagccattacgtccagcctttttttttttttaaataaagagggtctcaggct

SEQ ID NO: 81511 - DNA, 2074 bp, Homo sapiens
gtggtttcttgttttttctttctctgtgtttcactaatgaaacaggattacagtaaattgactcgtgtatgtgtatacatccatctttgctggtactatagaaaagtgtattgctggctgggcatggtggctcatgcctgtaatcccggcaatttgggaggctgaagtgggtggatcacctgaggtgaggagtttgagaccagcctgaccaacatggcaaaaccctgtctctactaaaaatacaaaaattagctgggcgtggtggcagtggaggctgaggcaggagaattgcttgaacccaggaggcggaggttgcagtgagcctacatcgtgccactgcactccagcctgaatgacagagcaaaactccattgcaaaaaaaaaaaaaaaaaaaaaaaaaaaaaaaaaaaggcattactgccttgttcctgatttaaataaaaaaatgtgttttaacaaggaatatgttaagttttggtaaatatagtttatcatatttaagttgtgtatactcattcatgttttaatttttatcggaagaggctgatgaattttatgaaatgcctttttggcatgatataattgtgagcttttgcttttatttggtggtgtaataaattacgttgattagatttcccaatattgaatcatctttgcattcctggaataagccctaatttgttatggtgtgataatctttggatatgttgctatttgatttgctaatatttttttaaaaattgtgactgtagcctacaaagccctacagataggggtctttagtttttttccttgtttgcattctatcaggtattgatattaggattatgttttttaaataatttaagaagaatttcaccctttcccagcatctagaagcatttacataatataggaaataacctgttttttttttttttttaagttagagtaaaattaactggaaaacttcataggcatcccctgtagtcccatcccagaacattttaaaacaaattttttagtttttcagaatatattatagttgttctgttcagcttttaagccttttctctggattttgatattttctacttgctgggaaagaatttatctacaatttgagtttatcgcacagttatttgtaatattgttatcatttctctggtaatcataaccctttctcattactaacacatatttttgctctttttttgcttttttcccccttaatcaagtttgttagaagtttatatattttattgtcttcaaaaaactaggtatattaattttatatttatcctgcttttaatttcatctcagtatttaatttttattcactttttccattcctttaagtttattaagttgaatgcctgtctcatttgctttttagtcttcttaaaataatggcatttaaggctatacattttctttgaaaattgcttttgttacgtatttttggttttagacagttgatctcctttttgttgttttctagatggtttgtaattaaaatatttatttgatctttgattctgacattacttagaagtatgtctgtccttgaatttttcttttgcttaccttttgatattgtttatatgatttatgaatgcagctctgaggtatctgagaggatttattaacgtttacttgcatccaagtacatgattaagttttaattgctttgtggacattaaaaaattatgcccttggtaaaatgcaaaggttttattttctgtatttagtaaatcaaacttactgattgcattatagtcagatcttccaaattcatgtatgttttcagttgtcaaattgacagttaatgatgcaccttttataatttttttttttgagacagagtttcactctgtcgcccaggctgtgtagtgcagtggcgtgatcttggctcactgcagcctctgtctcctggattcaagtggttctcctgcctcagcctcctgagtagctgggattataggcacatgccactgcacctggctaattttcatatttttagtagagatgaggtctcactatattggccaggctggtctcaaactcctgacctcaaatgatctgcctgccttgg

SEQ ID NO: 81512 - DNA, 1041 bp, Homo sapiens
aggaccaagtatgtttattcaggccactgtcttccccataaagactatatttgtgtacatttttctttgctgtattgtgagaaggaggtagaaaaaagatgtgcatgtctgcatttggaaacagttctgagagtggtgctgcatcagcggggctggattgccctcaactataagaaagtgggatacttatataaaggaagcataatacagcatgtttctcttacaggaaggactgtttcttagagtcctcatcctctgtctccatcactcagtatagcaaatcatacattccatcaatgttaatgacatcaattgtatgcctgtaagtatgtacacacgcacaggggcagggggcacttcttcactccacagctggaaaacttgggacaaaatgcctagccagcttggcccaaatttgagggtattgccatctgtatctcagtgcaggtgtttctgtctgatgttcacagtctgtttatccagagtgccccagaaaggacagtagtgttaggttaaacctgtgtatgtctgttcttggttttaataacagtcctgtctttggaattatttagtgtgttctctcatttctcaggaagtcaggatgttagtgccgaagcacttctctgacttggtccgacattgaagtaccttcccctgcattacagaagaacggccccccagggggtctgtttgatgaacacatgtattattgcagtgagatactctagaaatagcttcatgtccttgcaaaattgccagcacaagtaaggacctggaaattgttgctatgcatgtatgtcagaagatttcttaaccaattctgtactgaataaaataaaatttattttcaagttttgtagggacctggggcaatatgtcagatagagttgaatattttcaaggcatttttagttcatggggcacatagttggcttaagatatctatgtgtatcaggactgaaaggtaaagtgcccgaacctgctaatgaaagaggtgtctgtgtggccatctgaggttcagccacaatgtgtcttgcagaa

SEQ ID NO: 81513 - DNA, 1055 bp, Homo sapiens
gctgagtgcatgtcgctgcggcattgcaggcgtgtgtgcatgttggctcttgcaacggggcgtctgccaggggttgtctcgggcaggagaaggaggccagactggcaccacttgtagtgattggaatgtgtctagtccagctcttcagttccatgtaggaggttttaggatggagattgtgttttgggaactccaagtcactgtccaatttggagagtattatgtaagaaggcttatgttttctgattacccatccttcgatacagaccaaataataccacagtgataaaaatgggaaaggagctgtcgctcagctcttcttggccgtgttgtttgcttttcgatgtctaatttatgaaagcatttcaaagtgacatatatactgaacagcttcgtcttgccaaatgtaaaataaactggagatgagtttagcacagagctttgtagattgttgtcctcttggtagagtcggggcctaaacaccacctggcctctgtgccagtggacaggtgacctgcctgtcctactgctggtctctgcagctctctgtcttgggcaaccctggctctgagttccagagtgttctccagtaggagagtctgcaggggcactgtggagcacctgggtatgtgcacatctgttgttggctggcgttgtctctgatggcttggggtgtcacagagacatgacagtactgtcactgcatacctctcaagcttttgctgagtcctacatgagttgcaggggcagagagggagggagaaaacaatgcctagccacactgagaaaggggaaagtgctacagagtcctggaaggaagcgaggatggacatggacggggaagcattcataccaggcaggaaaagtgacttcatggaccagtcacagaggacagggccagggatcaaaccttccgtaatttgcctccacagtttgtctgagactggctacctggttgagtctgccagagccctgtgtgcaggtactaccactcactgtcacctccaggcaggaaaggccatgtgaatgcatgcatctttgcaggaacttgcccc

SEQ ID NO: 81514 - DNA, 1088 bp, Homo sapiens
agtcaccgtggtacacctgacgtggctgggactcctgattttttttttttttctttttgagaacaaagaatgtgtccttgtcttggcatggactgggtagccttgttcacctccccacccatctctccttattggtgaggcattgtaaaccgtgttaacaggtagcatccacagaaccctggaaaggttgtgaagtccctttggaagcctaagggttttgatctcatccaggttgtaatcttaaattctggtacaaattcccttgttacaactgggttaagtggttttaacctcttttgtgccttcattttgaatgcttagactggaaagtcgttcagagactcctgaccgaataaagcctacttccaaatgagtgggttgtccaggtgtgcttgtagatgtcacatacttctaacaaggctctgcagctgcgatgtcaccttgcccagcgtgacctcattagcatgtatgtggctttcagtggccatgtactttgcttctagagctttctttcccattctgggttcttaggagggggctgtgctttgtgtgtggccaggcagaagtccatgttttagcttttcaattctcttgaagaaaacaaatgttgttgataagaacacttgtcatggcatccgatttgttcttgtgagggctgtattagcaataaatagacatttagtttgcatatttaacacctcatcttctttcagcccacacgtcttcactacaggattagcttttcattacttagtagagcttttaattacctgaagctttcgtgtctttactgggatataacttttctccttattaaccagaaaaagtcacagaaaatcttgtaatttataatggaatggagtaatattcacaaacaggctttggcaggattttttttgttattgtgttttttgtttttgtttttttgttacactagttttatcacaagacaagaaagaggggaacttttagaaataaaaattatgtgctaaaataattaaccttcctgagtaacacacacagaatgttggtatagtgtttgcaccagaggaattacatatggaagaatgctgggatcttttaccaaa

SEQ ID NO: 81515 - DNA, 3904 bp, Homo sapiens
gtgggagatttgtttaaaaaatttttttatagaggtaaaattcatatgacataaaattgtccatttaaaggtgaacaactcagtgacatctagtatattcatactgttgtgcaattgccatctctatctagttccaaaatacatttgtcatgccgcaaggaaagcctgtaccccttaagcagttaatccccattcccctttccgctcagctcctggcaaccaccagtctgcattctgtttctatggattcacctattttgcatagtgcatataaatgcagttatataatatgtgaccttttgtgtctggcttctttcacttagcataatatttttaaggttcatccatgttgtaatgtatcagtacttcatccctttttatgggtgaataatagtccattgtatccagttgtatccagaagatttgcttttcattgcctaacttcagggcttcagacacctcaatctttgttctgagatggatgtaaacttaatgtatatctctctctctcacccaatgatcatgccaacaccttttttttttttttttttttttttttttgagacagtctcgctgtgttgcccaggctggggtgcagtcttggttcactgcaacctctgcctcccaggttcaagtgattcttgtgcctcagcctcccaagtagctggggccacaggtgtgagccaccacacctggctaatttttttttcttttctcttttttgtttttgtagagatggagtgttgccatgttggccaggctcgtctcgaactcctggcatcaagtgatctgcccgcttcagcctcccaaagtgctgggattacagacataagccaccttgcctggccatgccaacaataattatttagaagtatgttgagaatacatcccaataatagaagtgaaagctctttaaaaagaaaaatattcaaaacttaccagctgatcttatgtttcatttagaatggctgcattctttgcagtaccctagggttgtagaaattctcccccatgattgcacaacccactccttctcagccagtgtgcacctggagtcagctgtgtttggccttaaggtgtccatggtccagcagggagagggcagatgggtcagtgttgtcctgctagtgatgagtatcccatggtgggcatgctgatgccacgcaagggagagggtgtctggttctgtgcagtggcagtggtgcaaccccttaccaaggtaccgtggggacctgggttagggcaggaggaggaaggtgttctctacagactgcagggcttggaggcagcctgtcatggggaagggtgtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatgaatataaatccataaggtttttcaaatccccagaaatccctttcgtctcccacctggttttgctgagcgcctgtctcttctgtctcttttctgattcccacctttcacttttcctccatttttcgcttaatggatttatactttaaagtaggtattctgaaaattccaattttatgaatggtgtgacggtgagaactttgattcattgaaagataaaaataatcattacattttatactgcaagggtcatccttaatattcttcgtatttttaatatagctgcatgatttgagtagttgagttggggattggataatgtatttattgattgattaactctctgggggtccatacatacccctctttatatccctgtggtccctttttagtccttttgtaaaaacttgataatgttaacctctgccaaagttgatgcggtagttgtgagtggtgggacgcaagcgtgttgatttattcttggagacagcagaaacagcaccaccttcaactgttttgtcatgatcatcttgtaaccataattctgtgctaagtcagaattaatgttattttgttaattcaggttattgtgaaaatctccacaggaggttatttaagcaagtcacaaattgatgtttctgtttgtagaaaaactccagctcatccagccagccacattattccagggctgcatggtgtcagcgtagggaccaggctcggtgtagagaccaagggtgcctttccccttcctttccgcccgttaattgcctactcgcccagtggtaccttctgaacttttagaaatccagataggatttccacatggttcattagaattcatttatttttttccatctgtatttctttttgttgtactccctagatcattatttttagttactttttacatgcattggttaggtttttcatgtaatctctcagtaagcgtactgggggatgagtgacctcagtatttaaatttttcataggtgggatgaaatgtcttttctgagtgtgagtatttctgttccattcttcttttccaggcaggctctcattctgtgctgcagtttggattcagggagcactgacccttctgtcaggttgctcctgctatgaaggatggaagggcattttgatacatgaggcataactgtaattatccggtggggcttggtttgtgctgttttccacctcttcgtcatattttggaaaactgaggccaaaagcaaagttcattttcccctttaaaagcttctttaaaaaaatgatgaaagagctttatcaatgttttgaataacccagaaaatatttcttattgttgataatctgcagtttgcaagtgcagcgaatcttgtaggtagatttaccttgagttttttgaaacggtagaattaatgtattaaaacatatggtttttagttaaaataggatgttaaaggaatagagcgcacgaacaaaaaactttccacttgaacccatgttgtttcatctgacagtgggtatggtgtccctggcaggatagggcttccacctcctgctggtgccggtaggacagggaagaggtggggaacactgtgtctccatctcccaagcatcttacctcccaagtcagatccctggcattgtttgaatacttgcgtgtttgtgtgtggggtgatgttttcctgagaatgtggcaaaataatagaaggtcccagggttcctcagtctgcagaccatagctgagtggtgtgtgcctctagccatgaggtgaagcataggtgaaattcagatccataggaagacagacagactttgcaagttagtaagctaacttgctagaggaaacggtagactcctgtgctggctgccaactaaaaagcctttctccacagttctgttctcatgtacaccctcaggaccttggatgagcttgtgtgttcaggaaattgggcaccgagattttttttgtatctttgattttagttgatatgtagtccttccaaggaaagtattcgttggatgccctttctacactttggcattgtgcaagaggtatcaaattttaaagtaaaagtgcacaacctggccaggcgcggtggcttacgcctataatcccagtactttgggaggctgaggcgggtggatcatgctgtcaggagatcgagaccatcctggccaacgtggtgaaaccccatctttactaaaaatacaaaaactagctgggcgtggtggtgcgtgcctataatttcagctacttgggaggctgaggcaggagaatcactttaaccagagagttggaggttgcagggagccgagatcgcaccactgcactccagcctgggtgacaaagcgagactccatctcaaaaaaaaaaaaaaaatgcccacaactgggcatggtggctcatgcctgtaatcccagcactttgg

SEQ ID NO: 81516 - DNA, 1040 bp, Homo sapiens
agacaggaagattcttgatcttctttgtaagcaaatagcatcaaagagtaacatttctgtacctttgtggtatgtaccttgtggctaatttgtccatgaagggataggcattgtgttttgttgcttaagtcgcttaaggcctttaaagcatttccaaactcacctatttttgctctaaggggtataaggtgttaaaaaatgaatggaagttaactcattctcaccttgtctgctaacttccttttgttctttttctgtaagaactcataaagctgtatgcatcagctgctcccaggggccttctaaggcctcagtccaacaacagtgctacaggtgaggaaaggaaagaagacactatgtcatcatgtcattcttttagacttggtaagaagtatattcaagcagatcagatgctctcagaatcacagcgtgttgtactgctagtaattaaaactgaagtccacattgaataagaaataattttttattgattgctggcatttgtgagaaagggtttaattagaccaggatatggaggggacttatcgacagttccgttgtacattgttgacatggttattttctgtatctcattttgcctgggaatttgtcattctcttctattttcttatcagtagcactgcttttacacttattagccctagctgtttgtcttgcttatttaaacttgtacatggcacatgctcaaagatttttccaggcaaaatttctttaaagcaggatttgagattttctatccccttccgtctgctggattattccggtgagtgttaatctcccgcctttgtcttagcctctctgtggtcttcggttgcttccttgttctctgtagatctcctgagttggccattagctgtcaacagtcagcacttgctgcctctcaagtctcttcccctcctggctctgccctggttttgctctctgacggggatctaaattgggattctttccagtgtggaatcctgggtgtccaccatgtcactctgacttccagatgataatgagtgtgaccatgggct

SEQ ID NO: 81517 - DNA, 1014 bp, Homo sapiens
gactccttctccagctgggcagtcccaggtttgagtcctggctccactggaggttgtctgacttggaggttaataataacctgccttagtcccagagtccttagagggaaaataggttataatacctgagtccatgtgtatcaagccattgctggttccaggcccctggagcactcagaaatggatgacccccagctgggtcaggccaagtcctccctgctgtagcaagcgggaccattgcctcgttccccccacctccacatggaaggtgccttttgtgtcctgccccatctctgttttaacagtcacaagactgtaggcagatctaaacttgtttgcacattattatcacctggggagctttgacgattccaaagccaggctgccacccccacctctagaccaactgaatcaccatttccaggggtgggactgggcatccgtgttttcgaggcttctgggtgagtaccttgtgcaaacaagttcagggaccgttgccctagacactgttcttcccctcatgtctcaacctgggcctcctaccactgccaccaccacagctatgccacctgggatgtgtcccaagcccccacttgtcggggaagcagctggggaggggtctttggccacctctgcagctataaggatcagagcaacacctggcttctgtgcctgtggcccctgctggtgctgggtccctggtccgcactgaaggatccaggcagagtacagtgggtctcccaggtcagaatcccctgggttgcttgttaaagctcacagggctgggccccaccccagggtttccgattcagcaggtctcgggctggttggatgatgagaatttgcatttctgtcaagttcccatgtgatcctttttggggtctgggaccacactttgagaaccactggtctattaaacaaatctttgcaaattagggaggtgtgttgtgggaggaagagactgatagttgaaagaatatttgcctaaatacagtgcctagtatttgccaagta

SEQ ID NO: 81518 - DNA, 1029 bp, Homo sapiens
cccaggctggagtgcagtggtgtgatctcaggtcactgcaacctccgcctcccgggttccagcaattctcctgcctcggccttctgagtaacagggtctatgggcatgtgccaccatgccgggctaattttttgtattggtagtggagatggggttttgccatgttggccagactggtcttgaactcctgacctcagatgatccacgcgccttggcctcccaaagtgctgggattacaggtgtgagccactgcgcccagccagattttatttctttaaaaaagaaacttactagttatcaggacacttgtgttcttggtacttgattttgtcagcattatttttaagagcctcttccctccttccccctacctccctgttgagcccaggctctgaaataacataggtgcatgtgaagttcccctacctgccattaccagacattggtgctgggcggccctcacctccacctcctctcacctgaggccacagcggtgtgcaaggatgtggtctgtcttgagtgtgttttcaaagcagctgtttggtctgtgccttggatgtttttccacagataagcccaaaagagaaccacatcttaaaacgcccgtgaccttgaatggtctttccggaggggcggctggatttgtgctctcatcgtctcaggtatgtgtcaagccactgttgtttcagagctggacacaggtgcttaggaaaattcctcactgaagggttttcaggatttacaagttcttgctgtttttgtgaccttgtgtggtttctggtttcacagaaggctttgtttcttggttcttgttgctgctttcagccttggcctgtaatcactgggcgccagggagggctgcggtctgtttcccggggtgtgctcagataccgtgtcagttcacatgtgttgctgcagcggcagggggccaggcaggaggggcgggtgtcctgaagcacgctcaatttgctgatcagggccttcacttggattttgcacttgccgcagtggagacattcctcgtagcta

SEQ ID NO: 81519 - DNA, 1031 bp, Homo sapiens
aagaccagcctgacaaacatggagaaacctcatctctactaaaaatacaaaattagccacagtggtggcgcatgcctgtaatcccagctactcaggaggctgaggcaggagaatcgcttgaacccgggaggtggaggttgtggagagccaagattgcatcattgcactccagcttgggcaaaaagaatgaaactctgtctcaaaaaaaaaaaaaaaaaaaaaaaaaagagagagagagtaaataaaattgtaaggtgaatatgttatctacttgatggaattttttaaactaccttgaaaagttttatagtttcctatttacagatgaaattaacatactaattataaatcatgcctcactattcactttaggcagtctatctccttaaggatctccttacggtttagatagataagtgaattgcttaatgtttttggaagtaataaaactgcatttctttttaattaaacaatccagataacaagaagtaattctaataggaaacttgtaggatgtatttacagaaaatctacacaatcttactgaacaatgtagaaaagaagatttaccagcctgggcaacatggcaagctttgtctcttaaaaaacaaaacaaaacaaaatttagccgggagtcgtggcatacaattgtcatgtccacttctcaggaggctgaggtgggaggactacttgagcccaggaggtcaagactacagtgagccacatttgtgccgctgtactccagcctggatgacagagcgagaccctgtttcaaaataaagaaaaagagatttaaatgaagcgaaatgccattttctctaggtgagaaactggaatattatcaatgtcacttcttcccaaattgatttataatttaaaaacaattttagtacttctgcagcttgtttggagcttgataaaatgattgtagagtttgtcttgaagctttaatagtgaggcaggtttaaaattgggggcaaaaaagaaatgggttttagggtgtagaagggacttgcctgatcacttttgct

SEQ ID NO: 81520 - DNA, 1083 bp, Homo sapiens
cacttttaaagaagaaacaaaactcagtaacacatttggataaaaacctgaatatgtccattttgggatgaaaggaagcagctttgtttaccatgttgaattaagtggaaaacatcttattttaatcatgattgatagaaatctaaatttgtaaattctgatttttatgttttttttacaatgaaaatacattttaaatgtcaccatccccttccccatgaagtcttcattacaactaattttgaaaatactctctcatttatttatattatatatgcatatgttctactgtataattttaaatacttaaatggggttatctttttgcattgttctgtatcttttttcagcttaataatttaccttgcttataattattgtcagtgcttgcggacctgctctttatgcatttttaaccattgcataaagctggaatgatggacatgatttctttaatcactccaaattagtcatttagttgtttccagttttttagtattacaaataactctgcaataaacgtgtcttgggtatgcattcttttagtttaaaatagtcttgttccttcagaaagttgctcaataatagacttagaaattcttttgtgctaattactgtaattgctcattttaagatctccttttattgttttcatagtatataatcctaaactgttacaactgaaatagtccttgagctaagaaagcaatgtggcttaaagataggatttctaaatagagacttaaaaattaacctttttggagctgtgacttcctgatgaagtggcagcacacaggctgaatatgttctacatctggatggcccaacatcatgatgctgtgatttgcgagaagctctctgcctgcctaggctgctggaggatggcaagttaatttatttgttgttgggagacctccccctgcccccattaaaaaaattattttgaaatacttgtagattcacatgcagtttcaagaaataataaagagtaattccatgcaccattttcctccaatagtaacattttgtgaaactagtacagtatcacagctaggatattgacgttaatatagtaaggatata

SEQ ID NO: 81521 - DNA, 2742 bp, Homo sapiens
tatgtgtttagaagggagcaagctgttaaacatgggaaatagttgctagtagtttgtaattttatgattacaattttaaaattcaattttgcaactggaatttgacttgattggttagtgccttacagtaattaacctccaaatcatcagaatgtcatcttgttatttaggtaattgaatctacttttcttgtatacagaatgctttttggaaacaatacactgtatatctagtttgtaccaagaactaattgtacacagtcagatacttgcagttcttttggacttgagtttctttatccttctatcagatgtcacaattccctcttccctttgtagcatatgaaagtagttgtgtgtgcactgtatttgagaatgtcaagtaatagaatctctagaaaacattcatgatttcagtcccaggtaatccagagttaaaaataatgttcataaggaagggtagcaaaatttagattttaatacttataggaggtgtgttaattggccccagggccgcaggctttagcgttcagaggactttagccccaaaggttttgtggaacttttccagagtcctcaccagtacattgggaataaatggaatgcctttggaagtactttgaagattgaattcgatagtgttggtaaagcagtctagcctgctgtgattgtgctattgatgcaaatattctctagcctgtattatttttccttggagctcaggaagtgatccccacccacctcaagcagtaaaggaaagagaggcaggagggtctgaccatgtgaggtgccccaataaagcatctgtattgtaaatcaggaatgtaggtattgggtttccttaaaacaaagcacacctacgtgaccactagctggagcacaatgtgggctcggtctgctgaaagagtcagttggttgcggctgtctaatccaattatggatggtcccagcgctcagcctttcagctgctgcccctcccctgcagactctgcctctctcaccctcccttttagggcttggtctgtggctaccccagaaatcacgtgcactcctaggcttcagcgagtacagccttgttaatctcagacatggaaagcaagttgcctaggtctacagatgagtattcagtttccccaccagttgacctcagtgcaggttttgttggttccagtcatttggggtcagcacctgtttgaagccaggacacttagaacaaggtggaggaaaacctgagggtacatacagtgtggtttccttggctcatctaatgcagagtcagaatgattagccacattgcaaattgtctttactcagtggtttaattgttaaccagggagttaattttttttttttattaaacaaagaagaaaacacctctagatttttctgggacagatggccccattgaaagaggccatgtgctgcagcgaatggccaggcctcgggtgtggcaagtgccttccagctcagtgcttgctttgtgctcctttgcctatttgaagacgtggatgaatcaaaatctataagcctatttcagtcaagtattctaaggaacctggaaacacaggggatttctctgttgcctctaatacagtgaaaaaccactgtctttttttgttgttgttgttgcattgggggaagaaagtccaggtttgcatgtacattttcactcataggatttttttttagaatagtttggggaggacattgtgctctggccaataactgggccagtgtctggtcacaagatgatcaggcaggtgcctgcatgactgtaggacagagaactgggcagctagagagcctgtgtggaacgtgaagcctttccccactttgttgccgtcctaaccttttctcaagtcatggagaattgatccttagacattccttacctctctcacccacttgaggattgctcagagcctgggtttcggattgaaatagcactatttctggttggtgacgacattctgtgagccagcaatgtagtttaaatatccacaagagcgccctggttccatcagcgccccttcgtaattggtcatgagacttggacctccttcggggctgggactcgggcaagggagttgagtagagcttctctttctgggctcctgggaaggattcatggcataaaagtgggacttcagcattctctgggcacacctgtctctgtttttgtcctctcctgaatctttctggcctgcagagcagaataaagtcactctgtgccaacctgacttttgttcatgactatattaggggcatggatagaaagtgcccccatagcactctcagataaaacaccttcaaacaaacccagaaacccatgctcacaaaaccacccaccttaaattatgaaactttcaggctgactaaatcctgaaggcgttggagcgtgagcaaagggaaaatggtgacacagagctttgcccttcctaatccaaatgaaaagctctgtaaccctccccccacctttgctatcaagaaatgttggacctttgggaagcagatgtagagtattgatccttaaaacagagacctctcaccctaggtctcttaaaacagagaccttaaaacagagtattgatccttaaaacagagacctctcaccctaggtctcttaaaacagagacctctcaccactttctaactgaagtgggttccacattggaagtactttgcagaaacttctattaccgcaattacttttgcaccaacaaatagtatcctcaactcagaa

SEQ ID NO: 81522 - DNA, 3956 bp, Homo sapiens
cataccttaaacttaactcagatcgtgattgccaactttgttctctgtgtgtaagtagttatattattcctaggttatggcatcttgatttatctttgaaagaagaaaaccctcactgagttgacagggacacattgttctaggcttctacaattgtgctgatgacgctttttcccattggaatgacagggatgataaggtcggctggctagcctttttttaaaatgtagaaaaccacaactttaatttatagcatcatcattttccttatgtatgtagtatgtttcaaaaataatccaatgtcagattcttgcttctgtgatcaaggtcttgtttttgccctttctttgctcaccacctccctgcccctgacgccgagtcctcgccttagaggaggtggtcagcttatattgcaacattgaaaatgttataccttacaaagaaggtgatatgccatttcttaattataatgatgtgcaacagtgacttctgatgtagacctttaacattgggccacgcagctttttctttggaggaggggcatttcaaattggatgatgctcttatagtttaataaagaaacaagcaaacaaaataggctatacagggcatgtgttcttaaactctgtgacagtggaggtgaacccagggccctttcatggccttgggagggtcctcagctttgggggcgagttatctgggtggaaaagcaccatgggaggaagaagtcagagaggcgggttgctggagctcagagaataaaagcaagtctctgccctgaaaatggccctgatttgcttcagatgtactctgtctgccaacatttagtgtctgtgacttagccaaaggaaatgtacattaactgttcagtttctatgtagtttgtgctctaggattttgcctccggaggatttctgtgaaggaagctctgttcaagtggctctgttccacttgggtttggaaagaggccgggacaggtgatttcgaaggaaggatgaggacaatggaggagatgggcttggtcattgcagtgtgtgaggtggcccagcttatctggcattttggggtactatatgtgccatatgaggtgggtatgggtgtttgaagggaaagggggtggcctgggcaacttgtgtccttgcctagaaagatcatcactctttttatttaaaagaaacatgtgaaagagccatcagggatagttttgtcctccctcttcttacaagtgatcattcccttggtagggcagtgccagaccctgcttgtgagcacagaaaacgccataagctcctcatgaaagcatgtctggggaagcttatctcaaatgcagtttgcacttgcaaaggtcctgtggtatagcgggggagcaggggagatggagtctgggagcggtgaaggctgggtcactagctggctttgtagcctctgggcgtgttgtttttatcctcagaggggccactgcacctgctccatggtctcttcccacagcagacccttctgtctctgtgcctcgaggggctatgtggaaagcagagaaagactcaaccagagtcttcccttaaggaaatcggaaggaaaacaaaattaacggcattagaactgagtatgtattaaaacttctactgtcttacaaaatttagttttctttcttatttttctttccatgttgactcagtaggtaaatggactaaacacacattcatttagggcaggaagaacttcatcatttgattacctttagttcatttaccttataatgcctaaaacaaagcagaaagtgacgttggttaatcaaaaagatcactttcttttttgtgttcttttgtgctattgtgagatgcctcttctccagcaagctgtagttgttcacaaagtaaagctgttcctaagccttcattagattgaagcttgtcccagactttctttaaagaagtttgcatagcttagttcatgctcagatgattcagtgatgatgatgggttgttggttagaaattacttaaaaatgcctaatacattattgactgataaatgttaagacatattctttaagggtctaaatcctattcttgtggagctgcaaagatcttgggggtgtggttgcccttgtctgttgcatcatctttcaaatgcaacagctgtaatgatattctgtatcttgaaaaacttaaaaaagcaacaactaacttatttgtatcttttcctctaatatttagtttttacttcacttgtaacttattacatgtattaaggagtttatttttatatgacattttactcataaaaggatgaaaccaagattggtgatctgttcacatagattaaaatcctgtttgtgaccacttaggtgtgtaatgtgtgacttgtggactgtgtcagaggaagattttccaaccaaaagtacccattggtatcacagatgaaaagtccttataccatctgaaaaaaagtagaaggtggggagaagcttgaaaacctaaggaggccattaggaaaggctgtatattttctgattccgtttaaaattttaagttggtgaaaatactatgtgatcgaaggatgaacatattttagtaaatagagttatagtgctacaatgagataaatttcacaggtaaatgtgacgtagctaatgcataatcattctttgtgttgcatggcaattctgtacaaatggaaggtagcatgtttaacgttcctgttatttcacataaatacagactgagagtttcagtggtctggtttgaaagggaagaaatagaagaaggaaggagagaagttggcagaggagcaatctgctctaatatcctccagtacacaatctagctataggtcctcacctggcagggtttgaggatcagaatggtggctcaggtttagacaattctccctgtttgtggggcccagcagctagttaagagaaaaatcttttttccttccctattaccctataaggtccccaaattcattgtatgtagaatacttgagtcagaataactttcctaacacttaggtttcaggtttgttaggtatgcctgacagctctcttatcaactcccatttatttgctaatctaaatgaaagtttgatggtagagtattgtaaatgtagggaaggtgaagtgttcaccttcagatggtagctatttatctcagcaagaagagcagatgactaacacccaaatacataaccattattatataacttagcatttataaggcatttctatgcatcctgagagactagagcactctcaaatgaggtttcagagtaagattaatctttgcaaatgaagacaaattagcaaaatcttcctatttttaaagtgtgccttttgatttgatacctatttatttgtttggaaagaagcttttaaaatcaaaaccatgaatctgtggttatcttcaaaggataaattatggtaggtggttgttacccaggttaccattttaagatgattatggctggcccaaattaggggatcttttcatatatgtattatatattttaacttcagtcttttaaaaatgaatattcctaggtggcatgggagggtgggaaggtcaaaagcccaaacttctcttacttattggctgcttccttgaacttagcgtttttcttttggaaaagtgagcttttgtttttggatattttgtactgatactctgtgcctacacagattttgttttggttcaataagagttgatattttgccaggggttgcctcccatgagattccaaatacagatgtaagtttaacaggcttctgaactggatgtttctatgcgctgaaactctgtaaacgcgtgtagctttgtctaccattgtatattgctgtattgatttgttgggttgttttttttcttcctcctgaaaagctctggtctgtcctctgctgatacaaagactggtccattccccagggtcactgcaagagaacctccagggcctggccac

SEQ ID NO: 81523 - DNA, 1567 bp, Homo sapiens
gcagccgtaacaagtgtcctgggtattcctccctagaaaggaaatgttggtcacaaatggcagtgtcctctgcattcagttcagctatgtgactgaaagacactgttcttcagcagctgtgagtttacaagatgtcgcacattgagtatttttctctagcttatttagaaacgccagtctagacttccgcagttttggattcgtggccatagttttggcctttattagatggccctcaaaggtacttttcaggtggacattgatttcatgccagctgtcagagatgattttccctagaaatggctgggtatatggagacattctgtattagaatggaggtatacacccatctcttctgtattagagagcaggtgttgccccccgtggtgctcagattgcttagtgtgagaaggaaaagaccagtgataagaggaggaaaactgcgccttccatgtagctcagttaacagcatcatgattctccaggatggccccatttctgtttttatttacaaaatggacttgagaattaattagtaagcaaactgtctccattaggtaagtggcattctgatttgtctgtgtaaagttccatttcccaagtaatgtgttccaaagcatttttatgtacaactactggaaactgctgtacaaatgtttgctgctatttggttgtaacaaaatcagtaatgagtttcaaaatggaataatttcagagcccttcatctacagtagtttgggaaacacttgaaataccaagtgatctgaattcactacaagctctccaactggaaaatgtgcctggtgtcgtcttcaagcaagaatcccccgccccttaaccactgctgctgtggacttgagtcttcaaccttgttttgtagactttagcatttgtattgtgtcatccttgacacctccccaaccccagccttcccagctttgattgcttaccttagcaatgctctcagcttggaccagaaggcacggatgtttccctgaccttaacctcactgtgtatcagctcaaggaagaagccagatttgctgatgttgtaagcactaaattatgttcataacatttaaccctcacatccataagcaaactaagtgggaaaatattgactattgtagcagtcatagattgtttaggaagcagcaaaaaggcaaatttttctttaaagttcaaaatggggcgaaagagggtaggaaaggaaaagtttattaagaaaattgtatactacattaatttgactttgccgtctagacttaaattaaattcatgtatttttttggtcttaacacattgacatgtatcagtaagttaaaaacttaaaaatacacaaatgattagattagcattattatgtgtttctttcttgttttttgttttgttttgttttgttttgttttgagatggagtctcactctgttgcccaggctggagtgcagtggcatgatctcggctcactgcaagctccgcctcctgggttcatgccattctcctgcctcagcctcccgagcagctgggactgcaggcacccgcaaccacccctggttaattttttttgt

SEQ ID NO: 81524 - DNA, 1071 bp, Homo sapiens
tttaccttctaatgagcatacttttgtcgatcaaacagggtgacctctctggtgtctctgcacactacctgtatggtctttgcgtagctgatggggtctcctgactagtgattggtgattttaatctggattttgccacagcacttattttctaacatatgacttaatttacttaataattgtgtctattgaatgtattcttatacatacacacaggcatgcacacacggacacgaatataagctttacaaggacagaaaccttatcttttatttatttcttccttgtgtatcctgagcactgagaacagcctggcacaaagcagggctcaggaaatgtttgctgaatgcatgttcacactggatgtgttcgaaggctctcactcgcgactcctgttggcttgtggagagtgcatctagctgtaaaagccatggtgcttggatgtcttggggtgctgagcctgttcccccctcatttgggggtgtggtgctatgctggcgtttgggtccatgccccgcatttctgatggctgccccatctgccctgtgtggggtggcagagttctgtgtacacagagttacatttcgttgttcctggcttctctatggatgacagcagcactgataaatgccacacctgctttctcagcagtcttgcggggtgatttttcctcttaaggaagtcacctgatgtccatgctgagtaggaaatgcatccaaagctttgggagctcagtgttggcccctgggctgcagcccgagccccgttttagagctgtgtctcccaggcagctgtgatgactgctcgaaagcccactcagggggaaggtaaacctgatgcccgggtgtttggacagtgagcatggcgagtggaccgttacctgtgcatagagttgttcatatgtggtgacagatgttgggctgttatttagtaacttcaaattgtttttctttgcgtcggagccatgtctaggttctgagtgcttctcccaggtcagatggagagctcttcatttggggttgggggagcggggtggtgttttcaggtgcccaaggcattccatgcacatgc

SEQ ID NO: 81525 - DNA, 1028 bp, Homo sapiens
gtatttcagttttctttagggaaggtaccacaactttgggtaactatgcccctaccccaggatttaagatgttttgatggttgaagggcgatgtttaagagtgggaccagagaatattgaggtattaaaatctcactaaatctgtattcattatatctgtattcatggtataattcatgtgcctccccctttcgtgagcccctcaaacatgatcatggatatgttttctccacccgtaaagtacgttcatattcatagaaaacccacagagaactgcagacctgaaggtttctttgtaagagctttcattggatagctagaagggctgcagtaagtttaaaaaaaaaaaaacccaaaccaccctggattccaggctgcacagcctctaggaggtgtgggtaatccctttataaagcttggcataatttctgttaagacttgcttattttgctctcagcttgctatcttgatatgtttgcctttgaggaggttagagttattgtgatttaatcacagaccatgtatttcgcaagattcatttggtatctccagcttgttttcttgtttcctcggctgtcagtccacaggcagaggtgggaggcggccggcatgggggaccgagtgtggtagaaaggagtgtttacttagcggaggggagtgctgagggctgctgttaccttcccagaatggctgatccccagcagtgatgagcaggctgggatcgtggtgttaaatttggtattttctagaaatatatagcaggctttcccctccacctgccccccttcaaggtttcgaagccttgtgttttgcaagagttgagaggggaacagttaatagcttggattatcttgtctctggagagaatttatgtatcaattcaccggaagactgctctggtattagggcaacaagaatggttttatttctcccttcctttcctgcactctgttcttatgtaattcttgtattaaaaccattcctggtaaattagaacatgctcttgtatttgggccctgctttgaaga

SEQ ID NO: 81526 - DNA, 1227 bp, Homo sapiens
tgtacttttatacagctggcagcacgggtttgtttgcaccagcatccccacaaacatatgaggaacatgtacatcttaccacggttgcaatgtcactaggcaataggaattttctagctatattctatccttacaggaccactatcgtatatgcacttcatctttgaaacgctgttagctgcctcatgactgtatttctattcctcagtcatgggctcaccatgcagtacacatgtgtggtcactggagggaatggaagaacactgaggaaatgcatagcctgtttcatatatttattacactattatttatttagaggaatgttaagaaatcttgcttttatgtagttttagaatgccatgaaatatctagttggggcattatctgccattttgcaaggtaatcttccacttctgaataacgttacaagtaacccgcgtttggaggactgatttgggactaaggcaaggaatttaggaggcacaagtagaggggaagaaataaacacatgacttttgtttttgtttttgtttttgttttttgaaagaaggacagtggtttgcttgttgattctgctttgagaggatggggatgcactccagagaaagtgaaacggggctatgggaggaagagagcagcgcacacacagcacctgcatttgattgtgaatgcgattgtgactccttaggcaggaaggagagtgctaagaccgtcatcatggacactcagaaaatacctgctaatccgtttactggaagatacagggagctgcagataattattgttttttaagatggagtttcgctggagtgcaattgtgcaatctcggctcactgcaacctccacatccccagttcaagcaattctgcctcagcctcccgagtagctggaactgcaggcgtgcaccaccacgcctggctaattttttgaatttttagtagagacagggtttcaccatgttggccaggctggtcttgaactcctgacctcaggtgatcctcctgccttggcctcccaaagtgctgggattacaggcatgagccgccactcccggccgctgcagagaatttttaaaataaatgatagattctcacagataagaagtacaggataattatttgccaaagtttgaaactgccattatattcaaaggcattctcttttgggagtggttttatatttaaggtttgaatttagatgacctcaatcttgaggtgttatcggagc

SEQ ID NO: 81527 - DNA, 1057 bp, Homo sapiens
ccaaaaatggggagaagaaattgtatctgatataagcgtggctctacctgggagaatggccattccgaattactggaaacaggaagaagacttgctatgatgcttccttatatctgtgggggaaaatcaaacttacattctgaaaggaaacttaatacttcatgtttttaaacacaaaaggatattttttcagagtagcagttataaagttgttagtttaatcttttagttcagctttttttcttaccagaaaaataattagtagtacaaaaatttatgcgtttgttttagctctattctgatactgttaagaagatacatgacataaaaacaggaatattttcagtcagtgattacaatttaaaatcatattcgaaatttaataaaaagtttaaaagaaatcaccagcataagatgttgtcatttggctcttggggcaaaccagctctcttctggtgaaagaactttctggatgaggtcgaaaggcaacagaaaacctggggaacaatggctgtctttttaatgggagttgctcctattcctggtggtaacaacctcttcctgttgctcctttccgaatggaattgcctcagtgaagttgttgaagaagtgaggagggcgaaatatgcccatccttctacagtggggagaggcctggcgcatgaaagcaggcctttgtgtatgccgggctgggcccatgcaaacagggcacaatcaggctattgtttgtttgggaaaagctatggcatcctattgcaattatttatggaagaaaatatttgatgtttttggaagaggttaggtgtggggggtgatgagggagggaggaaagagactgggcttacctcttgtcccattcactccaaatctctcagtgcgtaggatagggtccatctggtccaaaggagagttttgtgtgactctgtgtgttggagtgttttcgaaatgcagagaaattcagagcttctctagctttggctagagaaggaacaatggaagtgagtcttattctacctaagtttgatgtggggcagcctgttctgtagttgccttccaa

SEQ ID NO: 81528 - DNA, 2032 bp, Homo sapiens
ctacaacagtcagtctagctgctgggtggagaaggggagaaggaggaatagtggaaaaagcagggagaccgcttaggaagctgctgggaccgtgcatatgagagatgttggtggcttgaaccagtgctgggtttctcagcattggcagtattgacattttgggtgaaataattagttggggagtggcagggcggggggtaggggtgcagtcctgaaccagtgccaggtttctcagcattggcactgttggcattttgggtgagataattagttgtggggggctgtcctgtgtattgcaaaatgttcagcagcttcactagtctctacctgctagatgccagaagcccacccaccccgccccctagtcatgacaatcaaaaatgtatctagacattgacagatgttaacctgggattagggggtggggagaccaaaattgtaccctgttgagaaccactggaccagagtcatagcaatttgtagtggatagatttaggaatatttgaagacttgtaaaatatagcctgaagggaatggagactgggagagtgaaagatacctctgagacattttggcttggacagaacagggggtggaggcttccattcctgagctgcaaaggagtggggagggaggagcagtgtagtttgggaagtgtgtggtggagaaggcagatggggcaggagctctgtcttgcatctctcaggtcagaaatgcctcagacatccagggggggcaagctaagatggagttgaacacagcagtgtagggctcaggggacaggccaggaatggagagaaacatttggcactcatctacttgtagcttccctgtcgagaaaaatgaaatcatccaggggttttcaaattcagtggtctctggaccccttcacactgttaaaaatggaaaaccctgccactgtctacatgtttatgttgccccagtaatctatgcattgaaacctaatcaccatgtgatgatattaggagctggggcctttaggaagggattaaatcgtgagggtgggggacctttatgaatgagattgtgcctttataaaagagagctgctttgcctcttctgctagaaggtgccctccgtgaaccagaaagtggagccctcacaagacactgaatctgccagtgccttgatcttggacttcccagactctagaactgtaaggaataagtttctgttgtttaaaagctacctagtttaaggtgttttgttataggtgcccagacaggctaggacaaacgccaataagctttcgtttatgtgggttgtatccattgatacttgctgtatgaagaattaaaattaataactttaaaaagatttattgattcagaaacagtaacaaaacttaatatgcgttaacgtacttttatgttggataaaaactatatcccaccccagtatatgaatagagtggcattgttttatgtgtttaatctctggcttaacagaaggcaattggatgatcatacctgcttctatgtttattctgctgccaatatcacacagcttctggaaacttccacggcacacattcatgagacaataagagttaaaaaggtaaacagtgtcttagtagtgtatgaaaatagtttaatctcatagaccccctgaaaaagctgcagaatccttacgcgttcacaaaccacactttgagaactaaagatcaaggagtacagttttctcatttttatgctgttcagagtgtggttgaagttcagccatcactagtccttcacggatagttcataccccaagttgatggccttgtggaattgctgatgctattttcatatatatatatatatataattctagcctttttctctggtcttataagagtcacatacgtaggtaatttcatatcctacaaatatgttctaaacagcagaatattccaggaaaccttaagtgataactgagttgaaagagtcatattttttaagcaatacaatttaaataatttttaaaggaaacatttctaaaggacgttttacattgcttgcattaaaaa

SEQ ID NO: 81529 - DNA, 1653 bp, Homo sapiens
ttgtgaatgatgtggttcaaacaaaactgaaacaaaaatagtttttctcattaaaaatatgtttgtcgcatagccagcactcggaactagggagggtaacatggaagtattgtcattctcggggctgactggttgacagcagcctatacaggagtggagaatattgacagggctgcccgttctccccaggtcgaagagagcaaatgcacatccctgtgtgcacggccacctggttcctctcctcacttgctggtgagtattgaacggctcacataattaggcagaactcaggaactttcctccctatctctttcactcttctgaaatgccctttatgttttcctctgctctttcagtcccagtgccttttctctggtgcagcctcatggttcggtctcaccttcagcttttccttccctccaatacatcctgtaaattattgtcagacttcttcttatctaaataactcgtttaggtaaggtactcatatgttcaaaataccatggtggctccctgttctctgtgatgtgaagtcctaaccattagactcagctttcccccaggacaccttggcttatcttcttgctgctttccagaggcatgggccattaggctggttttctgaaggttctgccaaaaggctgggcccttgtctcccaccccactgctgttactcatgtgttctcccacttgctcggcattctttcccatgctttttccttgatcatcacttactagctaacatctattttttcctaaacactctgttgcagttgtagtctgcagtcactctcctaagacttgatcatctattacgctgtttcgttctttattttttaacttttcttcttcttttttttttttgaaacggattctcgctctgtcacccatgctggagtgtactggcacaatctcggctcactgcaacctctgccttccgggttcaagcgattctcctgcctcagcctccctagtagctgggattacaggcacgcgccatcacacctggctaatttttgtatttttagtagaatcggagtttcaccatgttggccaggaggtcaggtcgaactcctgacctcaagtgatccacctgccttgacctcccaaagtgctgggattacaggcatgagccaccatgcccggttgttttgttctttaattttacaaacttggcatagcttagaagaccatatacagtggcaccatatacagtggcaccatattagtggcaccatatacagttttccctgagaaaactggtacctcccaacagataccaaaatctgggaccaccccaacagataccaaaatccacagatgctcaagtcccttttataaaatggtgtgatatttgtgtatagcccatgctcatctttccgtatactttaaaccagggatccccaacccctgggccacagaccagtcccggtccatggcctgttaggaaccaggctgcacagcaggaggtgagtggcaggccaactagcattaactgcatgagctccgcctcctgtcagatcagcagaggtcctagattctcataggagtgagaaccctattgtgaactgaacatgcagggaatctcagtaatgcctgatgatctgaggtggaacagtttcatcccaaaaccatccctctcccccacccatc

SEQ ID NO: 81530 - DNA, 3008 bp, Homo sapiens
actgcaatgaaaaatgcaacgactgtaatttatcgttgaagggcattttcaaagtgtatagaatgactaaagcttaagtgtattaaatattctagaggaagacatatttaggctataaatctagacttcctttggaatttgtttcctttttctcagccaggtgtatgaagattttaagttcttaggcctcagtgggaagaagatttaaggttccaagagtacatttgtatctcttttaaattttctattgtttatcagtgacatatgtaaatgttttagggagctgtttactgtaacattacctactttagctctgtgcagttgtctggcaaccaatgtgataaagacagagggaagtgctgtattttgttgctgacaagtatatcttaaaagtgcaggtgcacctgaataggcaataaagtattaagagctgctcctggagcagtttgctctctgtgacgtgtgaaaagtctacggggtttataattggtctggccatacggctgcctaggattagactcttttcatatcccactaaacactctccttagaagcaagcacaaggagatagtttattttaaaatgtaattgctatgttactaagatttgaatttgagtaccgagaataaaccatatttctgtttagaggctggttggcttaaaattgtgtctaatccttcccctgccccccaactccgaatcagagaatgaataacaaataaacatgacaatgaagtctcatgctgttgttttcatatttgtatttaggagtttcagagcaaatgacttggaaaacaggcaaatccactgacataggcatttttagccaccttggaatccgaggagggattctgcactatgccctgtaacctcgttcacatgccgtttgaatgtataccatgaagaccccttagctcagggagctttgctctatttaagtaatgtttatattcttaatgaaccaaagaggaagtggtcatgggaaaagagccaggactagatttcattctaatgcttataaggagagttctaggaaaccctcagacttggtaaaccaaggcatttggagatactatgaattggtttaaaaggccatttaccacttcttttgtaattggccttttaaaccaactctcacttagctgattaaatgtggtcatttaaactgctagttaacaatcggaagtgcagtggcgcaatctcagctcactgcaacctctgccttccgggttcaagcgattctcctgcctcagcctcctgagtagctgggattacatgcgcacgccaccacacccggctaatttttgtatttttagtagagatggggtttcaccatgttggttaggctggtctcaaactcctgacgtcatgatccacctgcctcggcctcccaaagtgctgggattacaggcatgagccaccgcgcccggcctaagatttcttattgtggtattctgcagtggagaatgggagttggaaagaaatgttttctcccacacctgtcccgctcctgtctactgaaagctgattaatcagtcagatagtgagttcctattggtagtacgcctccaaaatttggaagaggggaggtggcgtgatgtgaaaaagcaaggctttagggagagattcccgctgggggcattcaccctctggtccagcgtgcctgttacagtgatcactccatagtggttttgcatgaacaagactgcccagtttgcttaggaagaaaacaaaggacataaggtagttctcatgtcttcccagcaccctaaatactcgggctaaacttccacagtcagaccgtcagcttcaggaagggctgctgttgggaactttttttttagtttgcagttagttcagctccagccaaaaacctacaaaaagccactgcaagccctctgcctgctcgtataagacaccttggttgggcccctgtgactgtccatccataggatggttggccattgactgcacagagaggtagggcaagataaaacgactcatttgtggatctgactccttgtacttctgtttggattcaaacagaggaagatagagtagtggccttgggaaaccgtggagagagaaaaggcatagtcagaatgttttcagaggagcgcagacttttcaaaacccctctcatcacgttcccactgaccttcagttccagtgctgtggccacagggtgtctgcaccccaacttctttgccaagaaattaatgatctgtgaagacacacagacatgaggcggacttactatttaaaggaatcctgaaacgaatatttttctgatacatatttatcctaatatatttgctgagcatggtttttttttttttttttttcctattttggagtttttgggttttttaagcctagggaatgcctaatatgtactgtggagtgcatttgttcatttatatcccagtgcattgtaaaatcgagcaattcagtgccttagaatcctttctgtgaacttgatgctacgtgaactacttgagaacaactactttcaagccctccgaagcactcagttacaactgtcggtctaattgcacattattctaattcattaaaaaagtccccaagggcttcttaggatactgctctatgttattagaagtccttccaaatagaaaaactttattaatttaaaaataaccgccaattcagacttcgattcaaacaaggcattttaccaagtccggctgaaagagcttcttaccacatctggcatgtagaatggcagaagactatttttgctagattccttgttgctgcagccgtttctgatgtccttttccccttcacacctttcgtgttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagat

SEQ ID NO: 81531 - DNA, 1521 bp, Homo sapiens
gggtttatttaaagggaatgggaatagggagaaggtataacctttccaaaacaatctttaaggcaattataagctgttaggaaatgtcatgtaataataacacagatacccaagcttatatcacataaatcattcattttgcatgtttttgacagggagatttattttccaggttaaaaacaaaaaagaaaaatcttaaaagcttaagcttttattgtttgctttttttattaaaaagtaatttggagccagtaacttaacctgtttttcataaacatgctatctagaggcagccaaaaaaatattcatgcttgcatagtcagggtcctcaaatgaacttatgtgttggatcatgataactctggtaattactcgaattacccttgttgagtaatagtatggaccctgaatacaagggtttgatttatgtggccagctctgtgctgctgggtttatgaggacttgccagatgtcatctcctaattaaaatccttctttacccttaatatcctctcctctgtccccaagaaattaatccattctattgctggagcatgtaacagctgatgttgaagttacaagtttacagcttgaactttgcctagactgtaccttttttgggaaagagtttgcaaagcttttaagcctgactcttgtctttagatcaccagcatcaccatggtgcctggcatcagtggagcctcagcaagtgtttatggtggaaacctcagaagctgtcactttctctggctgtaacagttgtcatctttgtttacagggaaaatgctcttgagaaaatggaggtcattaaacactccagcttcagcaatatcatcagagctttccgtcacgtgagttatctcaccaaagggtcagattctggtaaaaactcttgccttcacacttacttctgttttattttgccttatttgacatttcaccagaattgatccataggttcaataaggctccattctgttgggacaaatcaagctagaaagacactgaactctgggggttaccagaaatatctgaaagcaaagcagtgactgtgaggtgggaatctctctgagaatcctttgcagaaccatgtaacagctctgcatcactagacgagccaagcgaagtggtcctggatggttcagtaggctcaagcattgagggtccagagcatcctttgcccctggacatggaagggttttcattgggagatggcatttagggcatccttataaacgagcaggagtaaacctagcaataaaaaccaaacctctgccttcagaggtatatgctattacttctgcttaaaccgttgtcagagctaacagttttggttagggatttttgtgggtccagggcacgcccagacacccagatgcttctctatgtttgtaagatggcgagtgttgagatgtcttataggcttatattgagtgaaaaggaataggatcctttgtcagtagtaacttaggctttttaggtggccagggcaagagaacaccccccctacacacacacaca

SEQ ID NO: 81532 - DNA, 1049 bp, Homo sapiens
gtaattgtttctctcgacagagtggataggcttccatagttgtcttaataccttttgtccaccccaaggattgacccaggcaaggaggatgaaccctcctcaatttgggaaagttaaattttaggcacagcaggtcaaagagtagggaagagctgcagttgttggaaccaagtgacattgatttagtctggaaaggagtcacagaggaatcaaaagccagaccctcctggcagctttagatgtggttggggtctgggaataatgctggtcccaaaatcacctctggaactaactcctgtaaaatgaagcctctgcatccttcagtaacttacttaaaattttgttagggctgcattttcttcaaagccaagttctgaataagaagtatttgttttgggctctagccagattactgaagtattgttgagggagatttgctgtggaaggtgttgggggtacagggattgtgaagataatgtaaaatatttaacattttaaaaattttcagtaagttctctttccccaatgtcagcatgacttcttcattcatgttcttccatcactctccattcagttagaatctcaattgtgtaatatcagtggtagcgacaattatgaaattcgtccagtgaggaaaatccgcagagctagagcccaaaccagcaactttgtagtgaggatgaccccactggccggggagaaactgaactgatttttttttttctctctctctcagctttttattttgaaataattttagacttacaaaaaagttgaaaaagcatccaggcatggtggcttatacctataatcccagtgctctgggaaaccaagacaaatctcttaaagccaggagtttgagaccaagctgtgagactatctctacaaaaaaaaagaaattaagtagccagcagtggtggcacgtggctgtagtctcagctacttgggaggctgaggtgggaggatcgcatgagccaggagttccaggctgcagtgaactatgatcatgccactgcacaacagtcttggagacagattaagaccctgtc

SEQ ID NO: 81533 - DNA, 2061 bp, Homo sapiens
ctgtttatccttgcctgccccagggaggagtttgagttggtacatcctgactgggtactctgcctgtggttagcaaatactctgcatgttgagtgctttcaaaatacagaaacaaacaacttgtggaggcattggaaaagtgtgtttgagaaacaagcagcctcaccatgaatgggagtttgtttccctttctcgtctttctggtcatctgctgcacgggcaggaggagctgtgggttgcttttcttccttggaacatggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatctttctagataaactccttgctatgatgccattagaagcagtgttcttttgtgttttgcttttgtttttccctgtagacaggaataacattttgactagaaacttccctgatgtaataacgaagatggcctccttagaaagttccagaacagaccccttcacctctgtccccagaagcagaagtaggtgatgcactttcttggcaagccacataactaccatttctctacaatcgaagctcaaaaatctgtgcttgtatacgttcattttttgtttttacttctttacttcctttgataagacagaaacttctgtattaaaactgatttaactctgaggggctaagtgaacaacaatctgttgtcctatagaggtcaaggcagtgctcacaacaggatcattgtgctgctgtagttcagtttaggggacggggaatgtttataaaaacaaagttttgaaatgaggacagggaaaggctttgtttacctggggctctagacttaaggtactcattttgcctgcagaataatgaaatgcagagttgtaattagaaaaggttgatgtaattgatgtgttaacaatttttgaggtttttctctttccactttaggacagtcatgcaattatttttctgaaccaaaatcagaaccatcagtcgaaggctaaaacaggcctggggaaacactgtcttttggcaaagaaagacaaagatccttgttctctaggccagtgtgcatatgtgtgtaatgctttaaagaacaattttgacaagaactcttaggatgcaacttgtagagtgatttttaaggagatgcagtaggatttgtgcaagtattctgctatgagcctaagattttcaacatggaaatctagccatgcagtgactcgttcactttggcagtgtctatcttagtctgggggtgagcgtttgtagaaaatatttagagactcaagtacactcatttgaatttttgctgttagcaaataaatggcaatatgtgtaacgtggtgaatgggatgtaaagctgtctttatattaccacggttagaatttaattttgaaagttgcaagtcaaactgcttcctcttgcgtcattaagttgtgcctcttgtttgctcaccggcatgtgtgtccttgtgtcattttggttgctgtgaaattgctcttaccattctttcatccttcaacctgctgtgctacaatcctaacatgctgtttttgttgaaaatgcattcactctttttggcatcttttttccccagaaagttagaatattgggaattcattggtattagtgaaattcccacctaatgcagcagtttttttctcttacctgcataatagacgcagaacaaattaactctaaacggattagagctgtcaactgacagatactgtgcgagatactgaggaagcctcagagatgataccaataaacaggacagggccttctggtcgtgtttctacttctcttattggtttgtcttagcaattttgaattgcactgaaaacgaaatttcataggtacacgatacagtagttagttttaaaagtttttaaaatattaaaaaattgaaagtatttaaaatatttttaaaatattttaaaatctgctgtgtgagatagataggagacctagcttttcttcct

SEQ ID NO: 81534 - DNA, 1008 bp, Homo sapiens
agtgattagtgttccaattcttgtttgcccataagtgtttcaaagtagtatttttaaaaactcttctaagacattctctcttctcatagtagatgcagtgaatcttaaaggtgccctaactaaaatttttgtgctataaaattggcagctttacaaaataaaaggttcgagatatgagcctgatcaaggctctgcatttgcaacaatatccttggtttgcctggccctgttatattttgctgttgtgatatgactcctgccagtgctatttccatttaacctttgtttttctaaaagacagtaataatttttcatttctagggagtctctgacatcagctaaaggaaagacacttttctttgactgtatatacatttctccccatttcattaatatcaaagttgctctttcaaatggcttataaaattttaaaattacaccagttgcataagcctgcataaaaagcagactcctacataagctgacaatgcatttgtaccgtggtgttgagcagttttaacatcctccgtgcctctgtgcttctgctagctactgctctgataaagttatcaaggtatcattggatgcattgaccaggatgaagacacaacagtatggccttattaaatttggaaataatgaacagacgagtagagaatttaggagcaatataggcaagcttaataggtctttactttggggcctgtaactccaactacatatggaagaatttaagtacaggaaaagttaagctcttttcccagtagttctgctgacaagttgggtgacttcgggatggttacctcttcatgataccacacggtgatggtaacagaggcactgtccagtctctggttcatgcacactggtcttctcaggggtccctgtataggtgacacagtggagaacagggcagtactgccagactcagggacccagttcatcgagaggggcagtgtttctcttatgctgccttaaaggcattggatgccttttggaaagccagtg

SEQ ID NO: 81535 - DNA, 1021 bp, Homo sapiens
gatttgggatgaagtattgaacagatagctcacagaagaagaaacacaaatagctaagcatagaaaaaaagtttgatttcactcatacgagaaatgcaaattaaaactacaccaagataccattttttcacttctcatattggaaaaaatccaaaatatttgataacacactctttggaaaacaaccccacatggctgggaggacggcagaatagcacatctatagaggagaatttggcaatatctctcaggttataaacacgtattctttgacccaccaatcttagagggggcatttaccccatagacttgcacacatgtgaaatgacagttgtgcagttgttcattgtagtgtttcaaatggcaaaagatgaaaatgtcccccaaattccatcactgagggaataagtaagttagggtgatagctcccaagcttattttctcttcagaatcacctcatgaagaaaatgaaggtctgtgtgatagtagctggcaggtgggcatggtggtgagggtggtgtttgagcggagacctgaatgaaggttgagaaggagccagccactcacagacacagaggaggccttcaggctgagagagcagagaaggaccctgtggcagagacaagctggaaacagcactgcttccatggtctggagactggaatatgtgggttctgcagacacctggggggggcaccacctggtaaatctgcctttcagctcttggttcttccagcaaaccatgccagctgtggctctgtagccatgtcctcggaagatggcagaggttgcaacgaggcctctctgaggtgctctgggagcacagaggagtcaggtggaacttgtggcatgttgccaagggaagaagtgatttttagacagaataggaatttgccaagaagagaagtcagaaaagcataactggcagaggaagcagcatacgttacaagtaactgcatgtgtacagggaatcactgagtgatggacaagggcttggcacttggtgggggggggtaccatg

SEQ ID NO: 81536 - DNA, 1043 bp, Homo sapiens
gctttcttctcttccatctcctggtgagcacagcatactgttctcaggcttgttttccttttattgctctccatgtgggacaggtcatgctttatcaacatgtaccattttctacaaatgccgcccttcctctttaaattgcttggatgggcagatcgattttgattagcaacactgcagcagaaacaaggtgcatctctggaaggactgggtggttttctcgttattgttgctggtttgggtcacatcggatgctattttaaattctgtgttttattccacgatgggtcttgaatcctttccctattcctaggtttgaaatatgtttcctccctttaaaaaaaagaaggggggcagtattgtgttgaaccaaatgtttttctaccttctcctgtgatctgaatcaggtttcccatttccagcagtacaatgtggttgtattcagtgtgataggggcgtagtggacatgaattatttgcgacagggctgcctggaagatgcggagcggagtttgcgtggcccggagcagctccagtgtctgaggcttctctgtgtcacaggctccaagcaggaagcgcaggcaaaatggcaaaatacagcatgtggcattcagttcaaaaatgcccttttttagaagtcggtattctaaatgacatccagtcttgcttagttttttaagagaaaggaaaaataatctatgaagatggtttggaatattttgtgaaaagccttttcagcataaaaaagatgatcttgagggtctggtttgcggagtggaggataagcctccctcctgcgattctgaattgctttttggtttgtaggaatttcaggaacatgttgcaaagccgtggccgcttgaaagggtcggtgccctgcgccccgtctcagcccctgcggcccctgaactttttcagtgatggggcacttggggagaagtgcggggagtggaggaggaggggaaggtgcattgcaaatagaaatgtaaggcgtggcctgggtggccaggatgtgccagagcagcctccagacctacttaaatc

SEQ ID NO: 81537 - DNA, 1040 bp, Homo sapiens
aatctcccatcactactttaatccctgccccagtgttctggttccccctttcctgcatgaggcagtacgagtaccctggcctggctttgggttctacacggtctgactttagcctgccttggtctttgttcccctctcactccctccacccctgccccccccaacacatgtggagtaccttaccctgccttcctagttctggaatggctgcccctgtgccaggccaccccattttctagaaccaccttcatacagcccctgcgcatcccactgtactatttccttgtttgtttttcctgtcaatcttgccttccgcgctaatgggacactgatgctgtatggtgatgtgttctcccacagtcatcttttcctcctgtggttggggtggggagctttctctgtgtccccccatgagagtgaggacagtctcatttaatggcaccatggtctgtggagccaggcaggcctgtgtgtctgactccacttcagcgctctcagccagcgtgggcacctcggacccagacagacgccccgagcctgtctttctggagaaggaagtagtaataccttttccttgagggagttatgaggattaactgtgcctggccctgaattcgtgccttgcaggtacttaggaagtgagttattacaagcagtgctttttatcatccatagatggagatgttatctatgctataggactgcagaaagaattacagagaattatgtagaatcactagggacttgattaatatttgtttacctttcccccacatggattgatgtcctttattatacttttgtacccccgcttggcaagcccttgacaaatattgatccaacaaaaaattagctctttaatgtatacgtttagaacctgttgctttgtcagtagtggtttttatgaaaatgaatgcttataggtcagacttctggaaaccctaatctgagggaattgggccaaataggaaagtgagccccttaaaggcagttgtctgaccagtacttggagcacaacaggttcttgctaaagcactgtg

SEQ ID NO: 81538 - DNA, 1523 bp, Homo sapiens
gaagctgctgtatagtggcaaggtcacagtgatttccccacagcctcggtttagagggagacggggtgtgctgagctgtgcctgcttctgtagaaggggccttctccaagtctgagtagccttaagccattaggactgctgagtctttctccacaaaaatatgtgggaggcctgcagggcaggtgctcaactaagctctggggctgcaaagatccagagccatgcccctccttggaggcaggtccttgtagacgaggacaatcgtagccttcctgattaaagcaggaattgtccaatcaggctatatgacgggcatcgtccatagtcttcaccaggggagcttttctgactatacatctctagccctgtggcttgagccagtcacttaatttcccctgagctttggtttcctcctcctggtagcagagagactatcagagtgaggggcagatgcaatagcatatgtaaaacacttagcgttgggcctggtgtttaactgcaataaatgttagctcatattttactgtgacatagatgctgtatgccttttgctgagtattaaagatactgagctgtagcatgcatacttgcatgaatcagtctgctaagttattttaagtttgcatttgaaaataaagggtggattgctatccaaatataaagaattggaaccaggctctaaaaggatgtttgctgttctttagcaaaataccattcttcttaagtttcattcaatcattccacaaaaatttaagcatctgttttgtcccaggcaggcactgtgcttgtaatggatgtgcaatagcaaacagaacacttgctttcagctcacacagagctgactcctgggcagagaatttcgacagtaaagaaatacaagtgtgatgaaggagaaaccctttggtactacctgctacatgttttaatatttaaatgttgacttagggaggtctttccatctaaaaataatgatttgccctttctcctgtaaatgacccctttctcttaagttttgggtgagagattttttttttttaaggaagaaagatattctacaatcgaatgtacaactgagataatgcttaggagagaatgtatactgggtttgtgccttggaagttgcttaggggaaacagttgtgtgcagttggaaagctgatgctttaaagaagcttctataaagtgaccccacaattaaactgttttgtgtacatctttatttatttatttatttattttttaattgagacagagtctcaccctttcgcccaagctggagtgcagtggtgcgatctcggctcattgcaacctccacctcccaggttcgagcaattcttctgcctcagcttcctgagtatctgagattacaggcatgtgccaccacacccggctaatttttgtattttcagtagagacggggttttgccatgttggccgggctggtcttgaactcctgacctcaagtgatccacccacctcggctttccaaagtgctgggattacaggcgtgagccaccacgccca

SEQ ID NO: 81539 - DNA, 1053 bp, Homo sapiens
caagtcgtcttctgtaactgagtatcagcggattcaagcgttaaggaaaatgattaagagaaaacaaccaaaaaagtcttaatggttctgtcaatcaagtggctatcaattcatggctattcaaaagcttttgtggctatgaaaataaactagattgaaaaaattctaaaacaaaattgaaacactcatttgagtttaaaattttagttgagttgatttttatttcttgttttggttcatttgtagtttccccccgcttcgttgtttcctcagatatggagaataaagcctggctggtcagtttcagtttttatttaaattcattttgtcttcattccttttaatctagcacagtcctgtgatgtattgggatcacagtgctctggggaaacattgaaatataaaaacattttcctgaaaacatttccagttatatttaattttcctccttgaatagaaaaatatttccaacttaatcctccctctcccctcttgaaatgaattgcatgctttggaaataacatcaatccacccaagtacacaaggacaatctcagccatttaatcgagatataaaggcttagagaactctgggcttcggaggcacagactccacctttcaggatgctaataaacgtggacgaggtctcgcctgggcttcctcctccattgttcagcgcagcaaaccagcacagcactccgtggccagggtttgcggggagaaatctctcactctgttttagtagcatcatcatccttatcagcaccctgcttttatttttgaacagccaaacttcctctttccaaacttcgtgtgacatctgggaccagctatgtttgaaggagtctgaacatgccacatagtggctcacgcttttaagggaggaaggccagtaagcctcctcaatggcagaattctactttcagtctaccctttggttctgttgtggttgttccttagaactttattctgctcattaggaagcccagcctccggggagggtttagcttctcatctaagcaagaagtaaaatgtcataatggaggaaaaaaa

SEQ ID NO: 81540 - DNA, 1051 bp, Homo sapiens
ttgtaattttattatggccctcacacaagagcgtgcaagctatactaagcttcctgtggccctcgtttttcctcactgatatttgtaactcattccaaattaaattttaggagtctgaaatgtagctgttatatttgggagatgtgaagaaaagaatcgtaggcatctcagtaggctaggtatcagatcacacatgcttgctggaccaaagaggactccttacagtaggatacatgattctgagttagtttgtgtactaagtatatactatatagcttttgaaggggagacgggcacagaattcacaatatcatgcactaagggttattttgtgtttgcagtttccagatgaatgttttaaagttggctgcagaatacagcgagataggtaaaatctatttgagtattacttacagaccccaaaggatatcccaaaggatatgttggactaattcctaaaatatcctgtaagtcattgcaggtacaggcgtggatctgggtttggaaacgccgcctggatcgctggctgggctcctgcagccgccaaggaggggctggctggaggtggggctcggcgtgcatagcggccacgtgactgcgccccggccacgcccaccgtccctcacgtggtcccaggccacgctgggcttcggcatgtgctaaagtggatagaaaagggagtggggcccgggcgtggctttgtggtttgggaagatatgaactccttggggtttttttctcttttaattctttaattttgatatttggaaatgcgtaaaaggtttttcatttgtccttgaccacgtggtccaaacctcaatttccctagcagaacgcggtttcgatcactggtggatccgtctcacagcaccagtcatgctgcctcgctgggaagtggagggctcaggattcccgtggttcacgatccattttatgttggaaggaaatcattttgaactatctcagtacacaccctagtgtatctttaaacctaattgagtgttgatggaaaatctgcggtccgagaaccgtaagaaaagggggctcccac

SEQ ID NO: 81541 - DNA, 1092 bp, Homo sapiens
tatggacaagaaaccccacataaaggaagcaagatcgctggctgctttctctaggtagcttgagttgtatactaatttgtagattatttctcttcatcgaaaaaacaaaacattctgcagagggcagtcatgtgtccgctgtgcctctgctcctgtgtgcaccataaaacttgaaagtgagccagaatttgaaaatatcggattgggatgtgatttctttaagcctctggctaatttaatataaagtgtttacacttcatttttctggcagtggattttctatgtaggtggtggaagatttcctgtaagttttgcaagttccagggcaaagagagttgcaatatgcaatatctttctgtggtcacaccaacagaaagggcgatttcttaacctgctgcagttaccatgtgtgtaggtggatgctggctattacagatggtatcctttcaaccctcaaaattgttgcaagttcacaggtatgttaatgaaaatgaataagtggcatttttaggaattccaaatactgagtcttggaagtagataatcttttccctaaatgtatgctccggtcagaactgctgcctaccacacctcgtgggtgaaacagatatttcgagcatgactgagcttattaagagccctgcggcgcttcctctgccgggggtttagaaatttcaaaggatgggggttgagggagggaggagttatgggcatgtgatgtggacagggcgggcaggaggatggaagtaacaggtccaaaatgtatctttggtggcccggcagagctcttgcatggggtgagaatggtaatttaggaagagcaagtcttcccatctgtgaagcagaagaaaaaagtggacttaaggagaagttcgggtgctgtttatttagataggagtaaggagagtgcagttggggaaaagcacttcagaggctttacttagactagcagaagtctgtttggcagggtgggaagcaagtgcagttgggagaaaaacgttttcaataggcagtttcagaattggaaattggaggagggcagtccatttcaacatttccaacagtattaaagaaaatttgcgggttgtttgt

SEQ ID NO: 81542 - DNA, 1033 bp, Homo sapiens
ctcaacccctttcaaagactgcaagatctccttgtacacactggacttgggagaaaatgagagctttcaggcctgctatcttaacaggttcagaaaggtgtggtccagccccctgactaaccagccctgctgtgcacactgagaattctgctcaggtgtacctttctgtgtgctcctgggtgcacccccaaagtgctggttctcttgaaaacctttttatttaggttcagacagacaaactgtggtatcttccattctgaccataaagtgtttcttctgggtctaactactatagtgggatattttctctagaacaagaggttgtttctttttggcattgagaaatgttgccgatgtgattttcttttgtgaacgtttaagacacagcgcttgccacttgaactttcttttgccgtgcgtagctgattccacataatggctgcagctccaggcagaaacctgtttggaagttgttttaaactcttcctggaatctctaggcagtggctcagtggggtttttttccaaccattccttaggatgaccagaagcttgacagaatcctcttgtcttcattttgagaaaatatgtctttactgtgtgtatgtgcagcatttggttttacctcgtgggtctaagcattttcaactaagcttccttttccaacctagcagacttgtttaaagaacttcaaactaatagccaagctgtaatacggtggctctctcagcctgagaagcctgtgctcaccgtcactctcttcttccctggggtgatagggatggggagtagtgtgtgtgagaggacagaagcgaggattgattgaagattattttacgaggcgagagcatggtggcacacctgtcagctgagtggactcagcgcctgccccggctaggctgtcctcctcctgtgccagccgtgggttccctgagtccctctgcagtcattcatgggtgctgaaaataaagataccctttctgtcgaaagtgttcgccgggctgcctctgcctccctggaaaagcagcagggca

SEQ ID NO: 81543 - DNA, 1059 bp, Homo sapiens
aaccccttgcttttattgtgtatgcagcaaaagcaacatttggatcaatttacaagtttctgcaaaacaccgtcaagaaataatttcggttgtgctttagcaagaaaataatggatctgtgctataccacatgccttttggtatccctcactgggctttgccaaaacactgactgcaggagctagactactgttaggcagagacactgcactccctttgctgtccctgccttctctcctagcgactcctccaggtacacaggccagggtcacagtatcagaaagcagctctgttttcctccagaaccccccaagcttcctttctgcagcactgtctctcccacatggaaccagctggctcaccagtcaacagcctatgacacacaaatgccttgaggatgcagcatgtattttgtctggaagcaagcaacacgctcttcctttgtaggctgtttctccttttgcttgcaatgtgagtggcttatcttgggtgggcttgggggtgagataccatgtgaccacatgaacacttcaaaacagttgctttttctaatgcatgctgtaataacaatgaaaagcatatccttatggtttttttaatgcaagaagacagactcaattatgtgtgtttttgattttttttttcttcttcaacagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggagtaagtattccatccccctggaaaaacggctagatctcatggttttcttttgttgatgcttttcatgctcccgtccctgagtcaccactaaaatatgggcttagataaacaacatggtgtgtaagcctcacgcatgacgtctcttctttgagtttccctgaaagataaagaacagattgaaaggcaatctgtcttttagccattggcacgtcatttattcctgtaaagagggtcatcgctcatctttttgttag

SEQ ID NO: 81544 - DNA, 1049 bp, Homo sapiens
tgtctcatgctgtctcctatcccatcatgctgctgattgggcaggatttacttccatggataatgggagactttagagcaaagtgtacgctgttccgattgggtagcagagcatgtctgttctctcatggactgctttcaagcacgttgtacatacttggctgagaaaaataaccaaaggcatttcttgggaatgattctagtaacatcctctggtacaagaagcattatttgatggtaatagtggtcatagaattaattagcatcttaccgattttgatatgttatccttgaatcatgttgctgccattgttaacagcaactgtctgttctcctatagtgttaataactaaatctcttattggcaaaggaaatgtattgtggagcaggtggcaaagaggacctgtgttacgtggccagcaggctagaggggactgtggccaagggcaggtgcgctaacatcgatttctgtgcttctaggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgagtgacagcatccaaaacaccgtgggcccaaccatcatgataacagcagaccctcctcccatgtgtgatggcagctttcctctgcggcccctcctggtttcacatgggggaccactagaccatcttaactagcactttgctcctacttatatgtcatcacaatcagtagtgggcagatacgtgatgtattcgtatttataaattctgtacatctctgtgagtgtgtgaaacacttataagtaggttctcaaactttaaagtgctgcttacagaatgcacagttaaatgtccttttatacacaggtgcacagttagatatttctctttcttttttcttttcttttttttcttt

SEQ ID NO: 81545 - DNA, 1020 bp, Homo sapiens
tgactatgcttgtttttttcttgatgaaaaaatgctgcaatcagaagagagaaaaatagtttttgcatatgttcttaaggaatagtaactattgaatcccagtaactgttgaagtggctcttcctgaggcagaccattcaattctgtaatgcccgactggggaagcccagagtccagtcacttcatttcttcttctataaaagtctaattgattatttgtttatttagacctcccattatagaaagtgtgacatgctgggcctctggggaagatttttgagggttttgatgtcagagccccgaactttctctgaacttaattgtctttcagaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcaggtatccatgcctagacaagcccccagcatccacacttcttcgcaagctcactggccttgcttgtaccaggtgtcattgtagggttagcagtgagctatgcctgttgtctttcttgtcaataggtaatactgtgtcatattcatttccccactgctaacacattaggctcttctgtgccattttctggcctcggtactatcttccatcatctcctgctttgtgcctgtgagcccaggtcctccagggtgctgggctggtttcattggaaggcccagcctggaaacagccgtcttcagctgcccttgtttcttgtttgttttgatgttcaatcctccaggaactgaaaccatgctgatctgtgttccacttaattcatgtagctcactggttttccatcttcattctggagcttatagagttccaaagaggtcaacaaaagttgaaagcctg

SEQ ID NO: 81546 - DNA, 2452 bp, Homo sapiens
gtacgatttggaaatgtagttgtttaccaaaaaaaatgatgtatgggccattgtgcttcccctgttcctgccttccagataatgttctgtgtcacctccctccccttgtcactgccttgatgtcatcagcattgagagctgtgcagtccctaaaagtgtgatgttgataaacaagtaaactactgagtatacttcatgaagtaatcccagttaaatgggggtgggctgagccgggagaggggttttgacagaattattttgcggtacatcaaacctaagcaacttctgacagacacaagtgtatgttgtgttggttttgaaggtaggcaggaaatttgttgatgatgtgttgacaaagatttccctgacagtaaatgtggtttcttgtgtttttcccttccgggaagcttggttagctagttggttggtttgcagagtgtgaggattgtggatgatcagcctcatgtccttacccttcctcccccagtattgtgaaagcaaatgtacacgccctgaccttgtggttttctgcttgttggaacgagcatatctgtgttgggcagttcatgccttcggtaggacccccgtgtgccactacacaaagaaggaccgtgttttcctcaggggaatccatgggctgagaagactggggagcctcagaggccctttcccaaagccctctgctctccccttccaggttctgacctaaggaccagccagaagcctgccgagcgtcagccgaacctgcaagtggcttctgggctgttccgttccctgcgtgagctttccctctctgctgctgctgccgcgctctcccctccatggcactgatgagcttcccacattctggactttctcatttccctgggcagatagaattcatcccatttgccccctgccttttgcctattcctaagaccggtgaccccagccgaaggcctcagccctgttttctcaccattcgtccatggctgacctgagggttgccctttctccatctgggtgctcctctcgtattctgtttgtttttgttggttcctgtaaacattagaattctgttttaaggtttctagggggagccacaaagcccatttcttcatatttgaccaaagcagcaattagagggtcgcaccctcatgcctcatctgccctttttggtgagaatgtcctttttgtgatgactttatgcactcccttttgcttttcggttgttccaagccccattcaaatccatgacgaggactctgctctctgatgggcaggaccttgatgaggccacaggtgctcactgctgagtgggaggaagcctgggtgggctccagggacctgcagagtgtagcaagcacagacgcttggggttgggggtgggctcgcagcaggagcccccaagaagagagagccctggggtccgtggaactgcttgctgctagactccaggcatctttatttccacagtcagagcaaatccaaggagccaccaccacaggctttcatatccctctgccccaggtctctggggcctctgccacacacctcacctctcccctcctgccctaataaatcttaaccacagctgataggtttgccacctttaaggcttaaccataaggtctgtgaccagatggcctgagtgttctgatgacacagccaggactgcctggccaagagtggcagagacactatttgcctctaggtaaaatcgaagaaccactctgagagccggggggtgggggtgagagtttgtgtgcccattctgacacttgcagagtagagaaagcaagataatgaggaaggacatccctgtgttattcatgagttcttacctaagggggctcaatagctccttctattccacggttaagattcttctgttactcttactcaagtcatagaaaagacaaaagaggtaaaagtacttaaaagccacatttctctcctccttgcagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcaggtatggtatgatccagctggccccattgccaccttcctcacaacctagtggagaagatgtgttttatggacacagggtctgacacccagggccatgacccttagacccaggcctgcctgctaaataacgtgcagtcattggcaggtggcgtgtagaccagctgcccagggaacagagcccacgctctcctagtgacaccactcccagcttggtctctccata

SEQ ID NO: 81547 - DNA, 1015 bp, Homo sapiens
ctgcatgtacttccatccattgacagcatatgctacctgactgcacaggttacctcctggttagcataggacttaaaacaataaaatccatgccaagttggtgaggatttgggtctttctacccactctgtactctccaaggagtactgcatagtgtgcaaagagctaggctgctttttgccctcaagaaacgatttcattgtgtaagataaccttgtggcataggccaggtcagttctaataacttttaatccttctggagttcttggttacaaaaatgtttggttaaagcttttgggtgtgcttaaagctacttgaagacgaccttttaagatttgatttctttgtctttactgacactcaggatcattgttaggtgggaggtcagatcaggcagctggagtccccagtgtggtgagtttagttggcaggccccagatttctcctgcattcatgggaaattgacatgtatgttttatttccccaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaagtaaggcttgtggagggagaagaaacgtggtaaaactgaaagcagggtggtccaggatcaggacagcccgagtgttcatggctgtcttattttctgttaaaatggagttggccagcttccagaagggtcatgctaaggtgccggcacataccggcactgtgtgtgaaaggttgggcagggcagatgccgagctttgggctcctacctcatgtggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacc

SEQ ID NO: 81548 - DNA, 2002 bp, Homo sapiens
ctgtcctcagcacagccatttccctggaacgcgaatctgatcagttcactgctgggcctgaaagctttcgctgactccttttaatctgcagaatgagggtgaaactgcttagcttgggctgggtcccttgtgagctggccctgacttctctccagtatcatcattttctaggaaagccatttccccacaacccccaaggaaagcatatcataaacaagttttcccttggggaggttccctcgactcccttctctcctctcccttcctctctgaattgttgccatatgtgaagtccacttttctagttgtcatgctacctgttgacactaatttcccatgtcccacagaatgttccagggtatgggtccatgtgcctggtgcccagcctagcatctgccatacaagtgctggttctgatgatcagtggcttctgtggtcttagacttgtagcaggactcaaatgtctgcagcggcattggaaaggggtgccgtccagtgtgtgcatgtgtgtgtgtgtttattttaaattgtctgtggaactatctcaaagattgaggccagcaggacttgacctatacatagatgtagactgtacatagatgtaagaatttctattcattttatgaaaatgaatagaaattttcattctatttattagaaatagaatgcttgctgctgcaagcatttgagtccttttacaggtgtgagatcacaaagaccgcttaccaacagaaccaacacttgtatggcagatgctaggctgggtaccggggacatggaccaaaccctggaacattctgtggaatgtgggaaattagtgtcaaatgtatgcattttcactaacagtcattaaactgcgtacaaagattatttttcttcagtctatcattgaaactattgcaccagaatatactgtactttaaaaaatgagtatatgcctcagtctgcacatatttactcttttttcaaataattgtttgtttgccgtgttctatttctgacaccatttaccttcaggaattcttactgtatgatggggagtaaacgaatatacaggtatttttttcatacttccaactgaatgtgaagaaatgaaatgagcaaattgttcacctggtgatattttatcatttcctcctctttgctgcagcaggatatgaaaacttcatccatctgatcatcgctctgcccgtcgctgtcctgttgatcgtgggagggttggtgattatgctgtacgtcttccatagaaagaggtcagtgatgtgcaaagttatgacactttctgtggctgagtggtttgatgatttgaatgtgagtgaaggtgatatttttgaagatttcaaggaaatattttatggactggaaaacctgattttcccatcaaatgttcttccaggaaaagagaaccttttctaatgattttaacaacagccaaaataatttttcgatggtacagaccttcccctggctggcttttctggtatacagatactgctgctggtgcatacttttccaaacgcgatgcgctagccttcccaatcaaataagcctttttatttccaatgaagtaaagaaacagatgtttcttaaaaagcgctaatctcaggctactgaggaagccagaagatgtgttagcaaatgtctgctggctcacccaggcctgaattgggagtgtagacaagagctgctgtagacagtaagctctccccattctgttctgataccgtgtgagagaggataaatgaaactgttgtagcgaagatgaaagtatatacaggaatgtatggaggtggggttttgttaacgtgaatttaatctttttgacagaaataacagcaggctggggaatggagtgctgtatgcctctgtgaacccggagtacttcagcgctgctgatggtaagagtccgggccaccagcactgccagcgtgcagggcaggtagatcgggagctttcaggagggttgctaatttgggaaaggaaggaggtttgcattattttg

SEQ ID NO: 81549 - DNA, 1118 bp, Homo sapiens
ctccctactactctcctcctttttacatttgcgttttaatctgttggtgaagatgggtaaaatcctgcttgaccatttcattcagtttctcaatcccctgtggttaatttgtttttttcaaaaatgtgtttttatgtgatgaaaagaaatttttaaaaaccaactgctttctttcctatactagacttccttgctttgttctggtccttctatctgttagtatcctcaaattatcttgaaatcctcagagatctgaaatactagtactgactgtacagttttcttactcaaatctatagcatgtggaaagttgacatcaagccatgccatcgcctcctggtattctctgtgggtttaaggaagcagcatcttatattctttggcttagagttcccccaaagcacgttctgtctaagggcttgtttctgtacctgctttaattacggtttcttctccagtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtaagagaaagttcctgaaaagccaaaatgcagcacagggagagggtatcacacaagcctcccagtatgttcttggctgcatgtacccgtgggtttggtgtcttgcctttgccttctggatagttaccccattacctcactgctaccttcagacccctgtgctcagaccaggccgcagcaccacagagacagttccagacaacacaggcatcagcaagggccacctgaccctctgagtctttctctttttgattcctcccaggtgcgattgctgggtgtggtgtcccaaggccagccaacactggtcatcatggaactgatgacacggggcgatctcaaaagttatctccggtctctgaggccagaaatggaggtcagttttcatttccaccggtattgcatgttgcctggcctgctctcttttccttta

SEQ ID NO: 81550 - DNA, 1036 bp, Homo sapiens
tgtgcacttaccctgcagtttcattatattcaacctgctcccccgaccaagtttcacttacgtatctcactacgagtaggtgtatatgtatacttgtcttaaatagctctaaccaaattaaaggaaagaatggcagtgtaacaccatgaactgacaaaatttcagccctctgtctttctccatgcttaaagttgagtgcttttgttgattctgttgctcacggcaattataaatgaccacttcataacacatataggtcatactgtaatatttaagaattgtgagcataaactttacatttcatgtgcatatttcctcatgcatcacacgtatctaaagccctgaaaagtagtgatttggacttacccccagtgacttaatgttgcttccccagataaccacgtgataagtgttttaagtcaccaagagacagctttgacagcctgttcagaattcaaaggtttgtgtcaccaagtgtagagaaccaacccagaagtaccgaggagttgttataatgattccaaatactagctttcagtagaaactagcacctcacagggcagcagccagcatccactgggcattgactatgtgccacgcaccactgggcactttctgtgcgtggccccaggtcatcttctcgtcagtgaaaccactgtgataccccatgtggaaaagcctgggcatgctcagctggtggccggcctgcaagtgtgggacctgtcagagccctatggctttgcagtgctgtgtgagatgctttgtggtcaagaaaaccaaggtgtagagtctgttgcacttgtatatgcaaaagtaaaaggtaacattaaaattagggactagtgattgttttaggatggagagacttgggcatgtgttttatataaaacttttttctaaatggatgtattatttaagggtaattctttttaattccaaagccagcacgttgctgtcctctgcaaagaggaatgcttatccctgttacttattcctggtttcctccaagactagtttcagctggacttcagttgcc

SEQ ID NO: 81551 - DNA, 1011 bp, Homo sapiens
gattacaggcgtgagccaccacacccagctgagaatggtttctaaagtaggggtgagtgtctttctttttactctgtaggagctagaggtattgaaatggaaccatatcccagagcccacatccctccgtcatcagagttcctcattcaggatccaccagtgtgtccctaggtttggcacgttgagacgtcctcacgtttggtgctctgtgaagctgggcagccctcagagaggcaaagaagtcccaagaggccgtcctgcctcagggctctcaggaaagagccgcccgcgtccctggctgggcttccttggtgcacccagctcatttctccttccctctctgtagaactcacattgtccccgtggaaatgccagccagctcccctttcccagtgcaggggggagccaggtgggcctgaggtgggccagttctgccgctaatgggtgagagacttgggccaggtgccttacatccgggagcctcagtttcctcacctcggaaatagggtgataatgtaacagaccccatggggttatgagaaggacttggtgcaggaaagcagcagcacgtgcctggcacagggcagggcctctccagatggcagttcctgtctgtgtcttattcccaccctccgggcacatggggggaactcagtttctccccactgcgcgtcaccctgggagaggtgttttttgtgccaattgccattttaaatccaaatcagcagggatcatgtttgctgttcaaccatgtggcatatttatagtgattttttttgtaatcatggtttttctttctggaatttcaagtttttcatttgtgctgaggaaggtcgtttgtgttttttaataggattccttcttttccaccttgtgcaagtaaaggcaaatcccctatttgcatgtcactgtattaattcacagataacactttcacacttcatttttattcttctcaagggctcaagatgttttcccaatgcccagcgtctcatggatgacaaatatgac

SEQ ID NO: 81552 - DNA, 1080 bp, Homo sapiens
cttagcctcccaagtacctaggaacacaggcgcacaccaccactcacaactgactaatttttaaaattttttatacagacagggtcttgctgtgttgcccaggctgatcttgaattcctgggcacaggcgatcttcctgtcgtggcctcccaaagtgctgggattacaggcgttgagtcactgcgctcagcctgcctctcatttaaatgcaataagggcattaacttcctaagggaatcaaattgtaaatatattaaaagtggagattgcttggtatttgctcatcatgtgattaatcatcccttactgtctccaccttataaaattgcaaaccctaatatttggccaccttaaagtgggacgtgtctgtgtcttgccttgcgtctctccacacataatgagtgtagggtcctctgctgtgacagcagtggtgcctgctccagcgtgtgactctgcgccctctcttcccttacagattttggtatgacgcgagatatctatgagacagactattaccggaaaggagggaaagggctgctgcccgtgcgctggatgtctcctgagtccctcaaggatggagtcttcaccacttactcggacgtctggtatgagaacctttactgcattgccagcctggagcccccagcctctgcactttccaccagctcagtctctagggctttatctttctctgttcattgttacccgttgccagctttagctcagtgttgtgtgagccacacttcttcatcattgaggtgttcctgttgtcagtgggctagctaagggcagaagggcattcgtgggattttaaagaatttatgggaccaacattctttccgccttcagcagataccgattatgtttccaggaggtgggatgtgccagaagccgtcacctctttttgtttctcccctgcctgccttctttctcttttcctctttctcaataaacagatactgtctgtgtgtctgcctcacctaatctaaccctcagattgcagacagtgctttatttagacccaaagcttatgagtcctgattgtgttttcctgctggtcccatctgctgtctgtctttc

SEQ ID NO: 81553 - DNA, 1052 bp, Homo sapiens
tcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgct

SEQ ID NO: 81554 - DNA, 1050 bp, Homo sapiens
cagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgt

SEQ ID NO: 81555 - DNA, 1070 bp, Homo sapiens
agcgagccgtctgtcctgtgagcagcaggaccagggagacggaggtacagccctggcggggggggcgtgacgccacgagcctcggcgccggccactgggctttccagccggaaggtttggtacatctctgtctacccctagggaaggaggtgagggagaagttgagagggcagcctggagggggaggggactctgctcctgcgtgtgttctatcagggactggctgtgaggtcaggagcctctgcattctggcgcacaggctgggtgactcttgctctccagctgctgctgcagctgcacctttgtgctcaatgaatgcagcagccatggccgcacggtcctgcctcagcgcgagcctcctgcagggatggagcagcagcaaggggagcaaacccaatgccccacgcctttaccctggggattcgcacagagatggtgctgcctggacaccttcctctcctcagaacctgaggaaccactgctctcttaaggacgaaatgtgttggtcattccatctgcacagaagcagtttgttccaaagacaaccagccagggacagcctggtggctcccccaggtgtgctctggtgccctcgttggcctcacagggccacctggctaggaggaggagaaatctaacaccttggtggaaaccaagatagaaaacaaaacaaaaaaagcaacacaaaacaggacatctcagaaaaaggcaagctgtctgaaatgagcagagaggtgagttagtgttgctttgaccccggaatacagcctggcttccccctgcatcacctgggtgtggcgcctgtggcgtggatgaggttaccagtatcaacggcctattgtcaggtgctgagaaaggtgagatgtattcttttgtctatatacacatataaaaaataagagtgaggtagataaatgtttgggggaaaaaaaacccaaaaaatcaagaactgtcccatcactctcacacacacacaccccacacatacacacacacacaccctttccttgaaatttaaattcataatggggcttttctacagtgattgaaactggtaatttatcacaaaa

SEQ ID NO: 81556 - DNA, 2509 bp, Homo sapiens
cagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgca

SEQ ID NO: 81557 - DNA, 1026 bp, Homo sapiens
tggatctctggtccacatctcccaatgctgcttagcccaggaaatgaagacagctgacaacacagaggaacattaacgaaaagaacaaaccccaaacttgaaatgcataactgggactgctggaatgggccaaggcataccacggcgggtcactgtcaccaggagggcgcctgtgttttagaagggagtggccaacaccgtctggccaccctggaaggagccaacgtgacagctaagaacactagacaagcatcctagccttctcacccatcgatctcagtgtgatcttgccacagagccactggcaagccattcggctgccagcctgcagaggtggactgctgtgggaaaagcttcagtggaacaaactggcctagaatctggtgccagagaatagttggctcataaatcttttatcccaaagcaccccaatgtgcaccgagcatctcgccatttggtagttccacagtgactgctcttctattttacgaagccacttttcgtaccattgaaatgtgactccgcatcttaagaaacaggccaggagaggccaggtcggccacgaacacggtcttccatcttccaaggaggaggctcgttccaaaggtatgtcaaacgtcatgacatcccacgaaggagacctggggtggtctgggtcttgatcaagttcaacagtgtctccagtacacaccagctcctgctgcctcagggaagggctgtgtgggagaacgtcttaatgctcacatcaattccatgatgtgcctcagtggttcatatgacttcaagcagtgtgagctgctggcagaaggaggttgcatggaaaatgccacaactcagcttaagattatttggaacacacagagaaaaatcaagaggcagagaaatcagcatgaagttaggctagaactgtggatagatgatgccttggtatagtcaaggtgggtgggttggtccagtaaagtgactgcaccatcacacaagccaagttttctcttttattgaggtgtttctgaagcatttgctatg

SEQ ID NO: 81558 - DNA, 1263 bp, Homo sapiens
taaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgcatttctgtctctggtttggttttgtccctcctggaagcatcactacactttggtggcagggaagctgagctatgtggggcacgtgtgttcacgcatgttgcctggaagcgttctccagaaaagcattgcctcttctctgacagctgagctttctcagcatgcagattgccagtaaagacgacagggaagctatctgtttctccctccattaaatcatctggaaagaaatttgaatacataaattacgaaactctgtactgcagttccgactgatttgtagacttttttcctataccttccactaacaacagtcaggccaaggcaagtctgatctgcatgaccccaaggcagaggacttcagttcttcacatttcccatgtgctttttgg

SEQ ID NO: 81559 - DNA, 1147 bp, Homo sapiens
ttgctgtgtgcaggccagcacagttgctcacaccttgcctgaggtctcgtttgtgagacctgcctgtggaaacacggtctttggtgtgttgatctaggagaagagatgggaaggcagacttcaagagccactaacatttcgtgaatgttttctgattttgatttttggggtgaccgaagttgtgagttaactgtgttgatgtagccccagataaagattgatttacctttgtttctccaaactccgatccccagtaggtggtttttcccctttccccagtgaatgaatgagtaagtgactcaacgaagacatgaatgagagggattcactgggatgcaggtgctgtggaatatctgacccctttctgccttggccacttgccggtcatgaggccatgaggccaagagccagctctccccagctcatcctggcaccatgttctttctgaggtgaaacaacacaagtctcccttgggtggcagtgctccctcctcaggctttgtgggtgttgcattgccacttctgcgtatgtttcactgaggttagaggctggtccgagaattaatgtggcatttcctgtggttgcagatacgtctgtgattatacctattacctgtctctgcatcatggaaagggctgcgcggcactcatccatgtccctccactatcgcgcgggctcccggccagcctgctgggaagagccttgagagtcatcatccaggaaatgctggaagaggtgggaaagcccaagcacagagcccagttcgaagaaaactcaaccatggtccttccagccaaagggaactgaccgggggattgctcctctagagaaaattgaatgtttcaatcctgtatgtagcactcaactgtgcattgagaaactttttcaaaaattgcttgtaagacaaagagggtggaaaactctgaattagcccaacaaaatcacaaagggttattttattgtcaggagaaagaacactctgaaaggtggacatttcacaggggatgaactagcttcagttatggttttcatgacaataaaatgaaatccgagtcatctgttttcttccaaaaatctacacagtgggtctgtgtgatcctgcgcagactgtggggaccacagacctgttttggagatgcttacagaa

SEQ ID NO: 81560 - DNA, 1059 bp, Homo sapiens
tcagcctcccaagtagctgggattacagacaggtgctgctgtgtgcatttgcctctctggtaggaactgtggctctcttcttggccccttgccactttgtgagctccttgagggcaaagtccaggctgcggaagacccctggaagtagaccccaaggattgggttttcagggactcttggtgcccaccccccccccccccccatcaactgaggcaagtccacctgccgctttcctcaggagctctccaagctgggcctggggaatgaaacagtggtgcagctgcggactctggagctgcctgtagattacagggaggctaagcggagggtcaccggaatctgggaagatcatcagccgcaagtaagtgatggccagaggcagtggggcatgggactggcgatgtggagctggagcctctgaacccccgggtcctggttctagggttgatggttgaggggcaccccgtccccaggccccaccagtcatgcaaggtcccagctgattgtgtaaggttctgggtctgtttgtaaaagtttaagccaaaatatggattagatcttaatagaaaatctggagagaaaggaggaggaaaagaaatggaagtattattcccagccaggactcaaaaatagtttccacctaagggagaggcccttgggttgggccccacacatacccatgaggggcaggtaggtttgaaggtggacgtgaggcaaggacctctgtgcccagggagcgactgggagggtggccagcctaggggaggcccatcttcatagcacgagcccattttatctggacataattactgtataaaaaacagatacaaccccacccccccaaaaaaaaccccaaacaaggaccagatgtgatgaggttaataaaacatacactatcaagccattcagacaatgccccagatgttttgataacatacttgggcagctatttttcaaaaaggaaaaataatcagcttgaataaattctaagaagatttcactggatggccactaacttcctttattaaagtttcatttaaaaaaagatgcaggaggcgg

SEQ ID NO: 81561 - DNA, 1700 bp, Homo sapiens
cctttgtcttgtcagcctgtggtttgctggcaaactggaaattgtttgatgaaatacctgataatcagccatgatttgggaatgcccgctggattccagagcgtggccttcctgtgttagaaatgcttagagctgccaggggcagtctcttcatttaattggatttgcttcgtgtgtaaatctcctcaagacaattggcatgtagacagatggtgggagaacgagggctccgacaaattgcttcgagatcaaagtgttcagactggcaccaacgataaccacaagagtgagaaaacgtgcatccctcccacgggcctctcagaattctaagatttctccagctccgtttgcaagttgcactgggggctgaccaagtttaaagtgaggtttgaacttgaaacacaagagcttcaaaccttcacttgcagagttgatttttctaatttaaaacagataagagatgtcatatttgctgatacaaatatgattctaaagcagaatgtgatttttgtgtgtgttgctgcatttttattgtatttttattatcccaggaggtacctggcttctcagtgcttttttttttttttaatctcactattttctataactgcccttttttttttctggctgtttccaagggcagctaaagtcttatttattctgaaggatttggttgaatcagaggacaccatgggctttttgggacgttctgtccaaaactgtttcattccctcagaaagtttttacttcctcatgagccaaccctgtttgtgggtctagacccagatgttcaggaattgcaaaggtataattcaagtttctctccagaactggttcctagtctaaaggcctgaggtccagggagctgggttctcagagactgacatttagtcacagccctttcctcatcaaagaatatgaatgacttgagaaatatgtcacaggaatcagaggtggaaatgtcacaggaatcagaggtggaactgaaaacctcagctgtactccgggataaagctgagttagagaattccacttgtatctgcagcccacttaattgagcacctgactccatcacaggcatatctggcactggctagtctcccacacaggaggccacacactttttaaaactttttattttgaaataaatataggaatttgccaagaagtgtacagaggttccctgtaccctttacccagcctctcctgatattgacatattaacattttcaatataaaagccaggatattgacattggtataattcaaaatttgtgcttgcagtatgtgtgcgtgtgtgtgtgtaatttcagctagtgtagcttcctatcaccaccaccacaatcaagatacctagcagtaccatcaccacaaagctcactcgtgctagctctttacagccacacccacccgcttcctcccatctcaaacacctggcaaccattagtctgttctccatctgtataatcattttattttacaaatattttatgtaggctgggtacaatgactcacacctgtaatcccagcactttgggaggttgagatgggcagatcacctgagaccaggagttcgagggcagcctgggaaacctggcaaaaatacaaaaaattaatcagacatggtggcatgcacctgtggtcccagctactcgggaggctgacgtggaaggatcacttgagcccaggagatggaagct

SEQ ID NO: 81562 - DNA, 1052 bp, Homo sapiens
acagagtgagaccccatctcaaaaaataacaaaaaaactctcccaaaccaaatagtcttcagccattttggatcttctctagtccatggtgtgtaagtgtctgtaggggaacgtggacccagcacgtctgggatttcagttcttggggagcagggtctcgctggggaccatgggcagggactgggctggatatttggactcataacactgccacagactattcccattccttcatcagtgtgaaaggaaaggatgaggtggcctctgaaagtctacctggccatggaggttgtcagttacttctcacccaagcagatagtatagtctatctgctgtaggaaagtttgctaggagggatttttttgtgattgggtgtatcgacgagctggcttgccaccacctggccagggctctgggcagcccatcccctagaatgtctttccaggggtcctgttcttcctgggagggccgggtccacagtgagttcccctgatggccaaggcgtctgtatttccatcttctgttgtgattccttgccatgtagtggcatctacactagagatggctcttatcaccccctttctacacatcaggggctgtaggatatctgtatgaaatgggatctccacagcataagatggctggtgtcctgtccctctccacatgggtcctgccatggcctggcaggacagagtgaatgaccagacttggatagggtggtggcagggcagtggatgctgagtgttgtcgttttgaactttgaagccctagtctggcggccagctgaccggcctttgctgggctcctgacattggctggctgctggttcctctggtattcagatttacagctcagccctgggaaattcagaggactgtagaaaatggctgttttgtggtatagaaagaaactttagggaaaaatgtaaatgcttggtcagatgccccgggggtcacatgacttttaaagtcagggttgctggaaggctggggagcagttgcaggtcagtgacacctgctggacctgaaggtctgggactttggcacacaaca

SEQ ID NO: 81563 - DNA, 1051 bp, Homo sapiens
tttggaattttgagctcttttcttccctacttcgtcctgccccctgttctccatcctgaaaagccagtgtaaacatgggcatcctgcctcagagtccggggcctgcctttttggtagggtattcacaagccacggggcctgcctttttggtagggtattcacaagccacgggcccagcttttcagggcatcgatcgcgagccgtttctgctcactgtcagcagtctgtcagccaggacagagtttattttgtctgtctatggctggcgtttccctaacccgattatggattgatgtggccatctcctaggaatttaggagctactcgtgctttcaggggagcaagcgatggatttcactgtacctctttctgctgtccaagtttgcatggggaaaatgaggaccctgccaggagcttgcctgacaggccctgccccgctgcagactcccagccctgctgggtaggatcgctgcaggcctcccgcctctgtgctccggtatagtctcggagatgcccgttgacgaagaagacatacagatggttgaatagaacccattcttttgtataagccaaaaacttaccatttttgaaaatcaccagtgcatgtctggaagacaaaccctcgtcatcctcgatgtgagtcttgctcagtagtctgcactgctccgattcggaggacaggtgtgaagttcctgtttgtgttcgtggacttgcgctcttctgacccttattctttaactaaagtgctcatttgatctctgcaaaccttgacccacctgtggtggccgttgccccagaattgctgagttgactgtcatcatcctgtggcttattggttctcattcacatgcaagggaagggactgtggctctttaatgcttaaagcacgttttgctgggatttgtccattgtcccaaggactctcaaatgtactgaacacctcccaacccagatctttggcccttctaggtgactgtcacagggaaggagcaacattaaagtaatcataaaataatataattgtatacttgtaatttccagagagacttgc

SEQ ID NO: 81564 - DNA, 1054 bp, Homo sapiens
cttctgtctctggagactgagtgaactgcttcaggatactggtaacgatgttttctgctacggtttctgtcatggaatcgccttgcagagaaccagtggcatcactggtgcccaacctgaaccgtagctctcttgcttctgcctctctaccggtcccaccaccagcatccttcacaggcgtctgcaaacctttcggggacacctctgctcttctgtcctgggatacttctagactaatcggcacctctctctctcgcacgctcttctccttcggtgagtccttctccttagccttctccttcatctgctggctttctctctgtctcgcttccttatctaactttgtcaattcttcccatcttaggtttctctcctcggaagccttctctttagaatcgaacattttctcttctggctttgttcggatggtttctggtctgtttctttcttgctccctcgtggctttcacttctgttttctttcccagaatgacggtcctctcatttgaccgtgtgctttccgaagcacctgctgccaccttgtctcggcgatcccggtacgactcgcgggcaattgtggaatcttcacctatgtaaacggggacctcccttgtatctccggcttttggtctgtcagggaatgttttcacttgagcctcagtatttcttaaaaggccataggttggagagaaagttctgacgttggtttgactgctgacggcttttccgtatgagttttcctgctgggtagtggccgaggaagaatatcccgagcccaagaagcctcttctggcatcacctccaatagatgtgcccgtctgagatccacggtgccctgacaggttagaatacagtgccgagctgtgattgaaacttgccaaaggtgctttctgccttgaaaatagattcctttcattttccctctgtagtagtgagtcggtatagtgataggatttgtttctgaattctgtagaaattgaacaaagcattcattaaaatgacagtcatcattacccttttccatctacaagcattgttgcaggccaaatcccatt

SEQ ID NO: 81565 - DNA, 1034 bp, Homo sapiens
aggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcaccgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaat

SEQ ID NO: 81566 - DNA, 1512 bp, Homo sapiens
gggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcagaggacacatcaggggcagaaatgacatcgggtgttagcagatcctttaggca

SEQ ID NO: 81567 - DNA, 1037 bp, Homo sapiens
aggacaagttcctttgaaacccgagttgtaaaagatcttccttgcccaggtatttaaaaataattcatcctttaagtcagaaatatatgctggatgttgtcttcctgcagaccagcccctgcaggctaaggcacctgctgcagggggagggccccgggaatccctgtggcctcctgcagccctgcttccggcttccctctgccctcggatgcccgtcaggactggagccggaaggttcactgactgaccttaaaggctggcccctacgtcctttctcagcccgagcagaggcccagcgctctgccgtggagggcctacctcacagagcctggtccgcagagagcagccccagggctgcctgagtctgctcagggaaacagggccacagcccggagcagacacaacctggccagcagggcgccatcccctttgagggcagggaaggcgagccagggaggcctccagtgcaaccctgaccatcctcctcacccatgtcctgctcaccaagccagctaagggttgagggcctcagctcagtgaggatggtcacaggtgattttaaaagatgggaggggccaggcgaggtgactcatgcctataatcccagcaccttgggaggccgaggcggtggatcacttgaggccaggagtttgagaccagactggccaacatggcaaaacttcgtctctactaaaaatacaaaaattagctgggcgtggtggcatgtgcctgtaatcctggctactcgggagactgaggcatgagagttgcttgaacctgggaggcggaagttgcagggagccgagatggggccactgcactccagcctgggtgacagagtgagactctgtctgaaaaaaaaaaaattaaaaaaataaaagatgggaggaaaacatctcatgttttatgctctgtgctacaattctcctctcatttatagcccctaccaagtcttctcataaatgggtctgggcacctgctgggcagcaaaggctggatgggaacggtgtggggggctgaggggcaccacactcacc

SEQ ID NO: 81568 - DNA, 1084 bp, Homo sapiens
aaagtcaagggcttgttggacagagggacagggatccttgcctttgtagaatttgaattatgcattaaataaaagaacaagaagagtttactacttcttgatattgtatatttcttagtcaaatgactaagaaatagtgaatattttctgttatttaaaaaatcctgtcatattctcatctgatagttacttttttcaaaggacaaccacattctcaattcctcagactgaaacattcagtttttatagtttccacagcttataaagacaaaggcatttggctgcttgcattttaattttcttgaagacctaaaaatggttggcagatcagaatgaataaacaggcttcagtagtaagtccccaaaccctcacacttttttttactcaagctatttatgtagcacaattcatccgatttttaaaaaatatattatgaaacatttgttatgcagaaaagtatggataacataacaaagacctttgaactcaccattcagtataagaaataaaacatgacccatccagttgaagtcccctctatacctaccccatccccagataactacttttttaaatttgatatcattcccatgctcttcttattttactatggttttgttttgcatgttttaaaacttcatattaaattataatacatattatatgcattcatctgtcgttttctttttccccttgactttgtaatcatgagattcatctatgtggttatatatacacatacatatatcaaacatttatatatcacatacatatataatatatacatatcacagtttacatattcattactaaatattgctaaattgttttacaaaggggctataccagtttgaatacccactatcaatatataaaagaattcttgttgctttgtatctttaacaaaacttggtagtttttgcagtctggtgggtgaaatggtacctacctcattgaggttttagtttgtatttctggttgttaatgagattaagcatgtttatttcatcagatttcaactctttgaataatctgtttatatcttttgagtgttattctattgagaggttttggtttggtttg

SEQ ID NO: 81569 - DNA, 1026 bp, Homo sapiens
catagtttcttcttttgcagtaacttttctttatgtatcaccgggaaagctagatgtatgaaaattaaagaaagtaaattacggtatccttcaagacctaaatcctttctaatgaaacaggcagattaatgggcaaaggacagtcttaactgttttttcttgtcccaatacctctttccaaatagctcaacactgctaacagtatatttattctgtttccatttcaaatctgtgagcagttttcaaagttatgataaatgcttttcttcagatgtagctgagcagtattttcaagagagcatggctcatcttaaggattctgaagggatgggaagaaccaaatttctttcaattcaagatgaattttgccattttctacaaatgactggacaaaaagaggtaagtgagtttggatcacaattgtctagttattcacagttgatatccaaagggcaactcctttactctgcaagcatccattaagcatctactgtgtgcaaagcatgtgccagtctctagagggacacataaataaggctagggctcctttggggcagcttccagagatacttgctcttagaagctgggagactttatgagaatatagattgtcatgcccacctacaaaagatcctaaagaaatagtggacaggccctgcttattgaagtcctgcagatctggctggaatagtgtggcagttagtgtgtctaatccctctctcctcagtttgggtaatgaatggagtttgcatgtctaaggaaaactatacggtgcagaagttacagctcagttgtttagtattgattcgtacaagcgtgatttacgtggcttatgaaaatagagcaagacccagaccttatattcattgggaattaaacccttgggaatgcattccctgcaaagcctaacataccattgctttatgtttttatatatgtgtgtgtgtgtacatattaatacatatatatatatacaatcgcccacagataggaacaattatatatatgtgtgtgcatatatatgta

SEQ ID NO: 81570 - DNA, 3445 bp, Homo sapiens
aaatttttccatgaaagaaaaggttcctaatagtcttaacaaatatgctggagaagattatttttaaatatgtgctgtgtttgctgaaaaatatgtaaggatacattttttatatgagagattcttattctaagaaggtatagaaatattttcgcactgccacctttacttataatttctaaattagcatttttatgatataaaagtaacacattttcatagaagtttgggaaatttagaaaagcacaaacatgaaatgtaaaattacagtctaacagcttagagataagtattgctaacatagcaatggcttttgccatctttctgtgcatatgtgtacatgcaaattagatatacagttttcacatgcctgagatgatatacagaatattttgtagcctgccttttcactgaagtatatagaatgggtaaacttctgtgtcaataaatatggatcagcactaattttcatggctacgtggcattccacagtatagatgtacttactgtaacctgcttgcacagtctcctgttggtgcattttaagtgctttggacttttccaccattatagagaatgctaaggtaaatgttctatatatatatcttcttgccctgccagagtatcacttcaagataaattcctagaattggaattcgcaaaattgtatgtgtgtatgtgcgtgtgtgtgtacatatatgtgtatgatttgatatagaaaagtttatgcccaaactatattctcctcaacagttgatgagagtgcttcacatccttcccaatactgggaaatttctaaaatttctcaacagatcagttattagcatctcagcatcctttccttgatggttgctgtcattgttttgtaaagtatttaacagtttttaaaccaatacctacccatatagcacttactgtgtattagaggttattctaggtgttttatgaatatcaattaatttaatcttcttaataacccaatgaagtgtgggcactgttatccttaactcacaaatgaggaaactgagtgactggaagatcgtacatctagtcagtggtgaagccaggacttgaaccttcctggtgattccagaacccatcttcttaaccaccatgccctgctggctcttggaggaaatgcttagttagcaaggaaacgaacctgaacaccagggatcaaagagtcacatcccaactaccagctcacctatattttcagtattttctattttaattattaaataaaataattcctttgatttttttagggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggtaagctacaaggtcctggctaccaaagctgttctaggcccaatgcttttcatagacacaagtggcacagcagctctgaaaatgcctggctttgtcatttgctctagataaggacaacagttggcctagagtagatgctcaacaaaggtgttcttatcaggtggtcacgtgggcaagtgctggtacttgtcccctgttagtagttgcacaaaccacaaacagcctgagatgctctaaagggggttgctttatcctttaatatctatttagagcgtatgttacccaactgataaggactctttttttctacattctaaagtcttcacctgaagccacctagagttatgtctgttagctgctagtctactttataagattcctcagtgagtgtgttgtgtccatcagagttctccagagaaacagaaccaataggatacgtacacacacacacacacacacaaacacacacactttggtttttttgttttagatttttttttttttttttttttttggagagacagggtttcatcatgttgcccaggctggtttcaaactcctgggttcacgtgatcctcctgcctcagcctcccaaactgctgggattacaggcatgagccaccaggtccggcctctcttaaggaactgacccatgcaattaaggggctgttaagtctggaatccacaggggaaactcagacaggatttctatgttgcagtcttgaagcagagtttcttctagaagcctcagtttttcactctaggtcttcaactgatttgatgagggccaccgatattatccagggtcatctcctttaaaatcagttgattgtgaatattaatcacatctacaaaacaccgtgtattcactgcaacacctagactagcgtttgaccagacaacctggccccatagcctagccgagttcacatgtaaaattaaccataatagtgagttttatgtctttatattgtatcatgccaaaggcacttttaagaaagtttttctgataattttttcctgtaaaagttgtaagatacagaccaatccattcttgttatttgaagtgagatacagtgacaaggtcctgagagtacttcattaatatttcttattttaatttgtctgacaatttatactcctactcacagtttgttagagtgcccctttttctcactttatctggattgtctcttttaatcattattaccaccctgtgacacatgattatttcccatttgtagataaggaagccaagaattagagaggttgagtgatatgcccaggagtacatacccaataaatggcatgctcacattcaaaaccaatacttaagaaagattgttctggatgatttgtagagaatggattggggaggttgtgccaaccatagaactagaccacttaggaagctattgaggtagccaaagctgagaatgatggtagcttgaactaggatgaagatagtggagatgaagagaagtagatggatataggaaagatttaggaggcagaattgataggacatggagattgattggatgtgggggaaagaaggaagggaagagttatagatgactcccaggtttctggcctggactgctgagtagatatttgtgccatttctaccagggaactggtgtgtgactgggtgatggagagatggcaagctgtgttttaggtgatgagcctgagatgcctgtgaggcgtacaagtggaaatgacaataggcagttagataattggggctggtgctcaaaatataggtcagaaagttatccacttacacacagtgattgccctgggagaggacgagatcacctagggagagttgatggagagagaaaagaactgatgacagattcttgaggaatttcagtattcatggctgaagtaaagaaggattacctagcaaatgaaacagagaaagactgccaggaaaacaagaggaaaagggaaaatgaaagtagtgtcctctgtccctttcttttttcttttt

SEQ ID NO: 81571 - DNA, 1044 bp, Homo sapiens
ccttctttctcaatttaaagtaaaagtagtatctaccatttattaaagtctcatttggtgccaggcatgttgttttccatgcataaccttattcagtcctcaccacagtcctcaaaggtgggtatttttaatatccctgtttacagctgagaaagctgaggccaacgttttataataagtggtggagcaggggatccatcctgggcagtctgacttcagagccaatgttcttgaacttcaccctatgctgcctccagtaaattgagttcaggttccttcagggactcgacacagttgaaaatacagtccaacatgctttgtgtaacatcacaagcacaggtggcactaatacatgtctgtgctttttaaaaatatgtaataagacaatcttgtgtaagaattcccacatgaaacacatacccttgattttctccattagaaaatatattcttcctgttttatagacataggaacagaattaacttcatattttgacagatttttttagagatctaagatacaattttgtgtaactaagaacataagatgggggctgtgtgtatgtgagtggaagtggttgtcggtgtaggggaggaggatgggaatacagggacgtgcaaagccctgaagccgtgctagcgatctcagtcctcccttcccacagattaacaagcccgtggaggaacactggaacacactggggaattctttcttagtagtgatttttttttgctccactttgtttcatattagtctcttaccacataggaagatgaaattgtcacacattaatctgttacctcactggaattgtgtttgtaagtttttgtagatatcagatatgtattatgttaaaaaaataactctctgacattatgattataggtgggtgagctgaagattcagaatttttagtatttcattaagattgcagttacacagccaggattaaaattcatgaatattttatttcctgctcagaatgctatagttcttgtattcagtttgtttcttataattatatgtaacatattttgcttctgc

SEQ ID NO: 81572 - DNA, 1052 bp, Homo sapiens
gtagtcactcagtatttatcaaagggatataaaagcgcattgattttgtgttttgtgactcttaagttgtataactggtaagcctgttttctcttcctaacagtacaaacaggccgtccatgagcttgtgcgttgcgtagcactgacaagaatttgctatggagactcacattggaaactagcagaggcacatgttaatctggctcaaggctacctccagctgaaaggtaagctcgccttagactgagggggatcagttggtcgatttctgctgttctccccaaaatttgattcacacttaattagaaggatcaggttttttaatattctcctttctaaataccaagaagccatttctttttagaaagagttgataaggtatataacctgtaaacattcaaaggggaaaaatggaaaaaatattttaacttttctggtttttttgtttttgtttttgtttttatgatttcaaaagtaaggttcttaggagaaaattaatctgttgggccagaagactttgtaggaaaaaacccaaggtatggaataggggcccagaatgggatccattcacacttttattggagaatctcttgactgtaaataaccaaaaaatttaaaaagactaacccaaattggcataaacaaaagtttttggctcatacaacttaaaaattcaagggaaaaaatttttagacttagccatatccagtgttcaaacaatgtgaccaggattcaatttttctctctcccactgcttggctctgtttttcttggtatttgctccattctttgccaggttttgcccacatggtggcaacaagactgcctgcaactttagacttcccttataagcattcccaggaggaaaagaatgtccctccaccaaaatcccgggatttgggaagggttctaattggaacaacttgggttgtataccaaaggcaaggaatagtctgattggctaaacctttcttttggcttcattggatcctgaaggagaagcaggccttcgccacatctcatggattggatgtgcaggagccaggcatccc

SEQ ID NO: 81573 - DNA, 1054 bp, Homo sapiens
taacaaatactgcagggcctcttacttatttcatctttaaactttcttttctgcctcccactaaatggaagataagaaaatatagttaaatctattgaagatgttgcattcctgtttataaaaatgtatgatcactttttaaaatgcaggcttaggtttccaaagcaacagcatttgcttcccactgctgtagactgtggtcagtgaaaggcaggatgatgtcatgggaaacccccaaattatgagaagaccagggtgctaattctggctgtgtgatgtgcaactgatttaggttcatttcatcgtctttatttataaaatggggatgataatagctaccctctgtaccttacatggttgtaagggccacatgagataaaacatgtgaaagtataaagtgttatgtatatattagttggtattgcccaaatcacatgggtagttgggacagcacaggttcttgaatctcagattctccatctctggctactgctctttccctagactgcagcacctgttgaaatggtcatcttatcagccagtggggttgaacagatgaggaagcataaggcaagaagttattagaaaaaagttagccaacatcttaggatctcaaatagcactgtgtctctgtacaacagggtgtaggcaaagctttcctgttaaatctgaagtattgacctttaacgtttttatttatttatttttatttgtttattttttatttatttttattttttttgagacagagtctcactctatcacccaggctggagtgcaatggtgtggtctcggctcactgcaacctccacctccctggttcaagtgattctcctgcctcagcctccagagtagctgggactacaggcacatgccaccacactgggctaatttttgtatttttagtagagatgggttttcactgtgttggccagggtggtcttgaactcctgaccttgtgatctgcatgcctcgacctcccacagtgctgctgggattacgggcgtgagccaccatgcccagccgacctttaacatttttaggaggtacccag

SEQ ID NO: 81574 - DNA, 1051 bp, Homo sapiens
cttttttaagattgttttatttattcttagtctcgtatttccatcttaattcatccataataaggatcaacttgttaatttctgcaaaaaaacagctgagttttgatggatattacattaaatcgatacatcaatttgaggagtattctatcttaatattgaggcttttaatctatgaacatggaatgtccatgtatttagatctttaatttctttcgataatgtatgattttcattgtacaagtcttgtatttcttttgttaaatttattcctacatatttattctctttatcctattttgaatcagtgttttcttaattttattttcagattatttattgctgacatataaaaatacaattttatttatttattatgtatcctatggccttgccgaacttatttagtcgttctaattggggggggcgatttatttgtttatttattgtggaatccttaggattttctacatagagggttatgtcagctgataataatgttttatttctccctttctaatcttcatgccttaatttattgttcttgcctgttgctctgactgtaatatccacaactttgactacaggtggtgagagaaatcattcttgccttgtttccaatcttggaaaacattcaaacatgctccattaagtatgatattagctttaggtttttgtaaatcaggattttttggttttgttttttaatttttaatttttgtgagtacatagtagtaggtgtatatatttatgagatacatgtgatgctttgacacaggcatacaatgtatagtaatcacatcagagtaagtgggtatctgtgtcctcaagcacttatcatttctttgtgttagaattattccaattctactcttttagttattttaaaatatacaataacttattgttgactgtagtcaccctgttgtgatatcaagtactagatcttattcattctatctaactacgttttgtacccattaactatccccacttttccctccctgcccaatacccttcccagcttctggtaatcatcattctactctct

SEQ ID NO: 81575 - DNA, 1052 bp, Homo sapiens
tcaatctgtacaaagaatcaccaaactgataaagcaggaaccagagggcaaatcacgctgccaagacaactgtgtaattcgctcgaaaaagaaacggtgagcctctccagcagactgggtaaactggcaagggattttacgacatagttggagattggagagttacagaaacttttccggttttttacaagttttaaaggagtgattgagtgtcaaaggaaaagcagagaaaatacaggcacaatttaaagacagcaggaagaagagtgttcagagagcatttttctctttagggtgaagtttgaaagcatcatgcccagattatcagtggatttttgaaaggtaaaggaggcaagataataagattaactatagatcattttctactttaagaaactgtgcttcgttattgttgcttaagtgtggatttagaaggacatttagtaatattgtaatttttatatggatatttttgtttatatattgtcatacctggcataatagataatatatctattaaaagatataggagaaaatagagttgcttgaacccaaattttgtgtatatttgtggattagggattccagggacagatctgctaatggctgaacaaaacatactacagatacctgaagcagaatcagcatgtaagggtaaattctcaaaaaaatccagcaatcatatttcaaaaatgacatttttaattaaaacaaatacaaaagaatttatcaaggaaacgttgatgaacatgactatttcttaagttgcctgtgttaatccatataggggaatataaagtaataaaatccagcccctcaagagcagggacaaatgaggctcagaacatttaaactaaaacttctgaacagttcttaatgcccggatgactgttgtagagcacaggtgcttcaggagctcagctcaatgtgagatgaattattcagagaaggcttcacagtatgggtaagactcaatttgggcctgagcaatgggcagaatttcagagagaaaaataagggaagtggcatccctactagtgagtgagttgtta

SEQ ID NO: 81576 - DNA, 1052 bp, Homo sapiens
tttgacagttctctgagaaggaagctttgaaggcactctaacgtggtcctacccccttgctactgcttttctctttgattgtgaactgttggtttttcaggcttctgcagagcaggagagtggggttaggactagagcaagcgaaaataccatgaagcctacaacccacggttcttactgacgctcagtcatttttttcttggataaattctccctgtattatggtaagccttaggttcatttccagagttctcaacatgtagcatttggacatttctgacagtttctcattgtttttatggaagagaatttttggaggttcttactctaccactgttgctcaaaatttttagttttgtaaaaaactgccggtttaccagattagctgttccattttacatttcccctggcaatgtatgattgttccagcgtccgcacatcttaccagcatttggtgttgtctttgttattttagtcatttggatagatatgtggtttttatgacattggaatttccatttgtatttctagaatgactaatgatattgaacatccttttgtatactaatttgtcattggcatctttttttggtgaaatgcctgtccatgtctattgctcatcttctgattgtattttttttaatttctgagttttaagagttctttgtaaactagttttctgttctatatgttgtttacaaatattctctcccagtgtatagcttgtgttttcatcctgtttatgttcttttgcagagcaaaagttttacattttgatgaggtccagtttatcattttttgctttgatgtgtcatgcttttgatggcaagtctaaaaactctgtgtctagccctaggtcccaaagactctctcctttccccgcccccaccccaaagtcttacagttttttattgtacatttatcacctatatttttaaaatttttttctgggattagaattcttagtgaccattttttttgttgttgttgttatcagcacgttcatgatattcattattccctggcgtgcatagtttctgaagaaacatcta

SEQ ID NO: 81577 - DNA, 1142 bp, Homo sapiens
aattttttgtttgtttgtttgtttttgtttttgagacggagtctcactctgttgcccaggctggagtgcagtggcacaatcgcggctcactgcaacctccgcctcccaggttcaagcagttctcctgcctcagtctcccaagtagctgggactacagatgcacgccaccacgcctggctaatttttttgtattttagtagagatggggtttcaccttgttgctcaggctggtcgcgaactcctgaggtcaggcaatccgccctccttgcctcccaaagtgctgggattacaggcgtgagccaccgcgcccggccataaagatttatttttaaagtacaataaataaaaccataggtttttactaaaatcttgttctcttgtctctaaatcaatgatataaatttattttcttaaattattgttgtgtgatctccagcattcacttgttttgctctgaatagttggttactgattgcaggaagtctccaccagagtgtgctaaagacactgtagtgggaaaattgttacttaggcttgtctagacttctcagcctctgtgaaaaagattttttaagagaagcatttgatttcttgttacaaaatttcttttgccatgaaataaattctgtacctcgacagttgagtatttctacagacactgtaaatgatatttaatctgttgttggttctccgtatgcatgctagctagaaatatctttattttgtgaagttattttttagaaacgaaaagttcatcttcctttacacaataggtgttgatttttcttcacacagtaagtatattttttaaagcctgaataaaatgaactggaaaaactagtaatttgtgttatgaagttaaaaagaccttatagtttatccattatgtatgcttttattttaaaataacaactaaatcagtaaatagatttaatatttgcaattctggtacaaaatatttttctcaaagtattattagttagctgtgataaccattattgtatgttgatgcattagagtagggtgcaaaagttgtggcctatttatatttgataaatttctaagtgagcattttataaactgattatctggcaaaagtacttaatgataatggctgttttttttctttttccttcctagat

SEQ ID NO: 81578 - DNA, 1268 bp, Homo sapiens
ataagttgtaaatttaataaatctagttaagaattctggtcagataaaaaaagccctgtgtatcatttcttgatttattttagtcttaatgtttttatttgtgctgtattttaagttatattttatcttgagctggaagtatttatcactttcatgaacttagtttgatctgtgtttttactattttgtgagcaactgagacaaggaaattaagtagtaaaatattttaacttggaatacttgctttaaagatttgatgtaatacttgagtcaaattcattttgccttctccttttctctttgaagccattgggtctcttgtaaaactccaatgtctggatcttagtgacaatgccttagaaattgtttgcccagaaattggtcgtctgagagctttacgtcatcttcgattagctaataaccaactgcaattcctacctccaggtaatcatagtctctagcacactatagtttcttgtctattataaatctgtattcatatttctcactctatgtctaggcaatgagctgtagatgtatttataagtatttgtccatttgtttgaagatgaaactaaagaatgggtgaaatattactaagagtcttttttgtgatgcaaatgtaagaaggtagaatttatattttagatatagctacaattactacaattgtgcattgcatccaatatccctttgaatcactgctctggcaaaatatttgtacaaagagttacttcagttctgaatttcacataagagaatttaggtgaactttgcgtgatataatcattttactatccaaaagtcaaatgcatacaatgttttctctcttactctctagtgaggtaactaatgtacattaactttttttttttttttttttttttttttttgagatagagtcttgccctgtcgtcaggctggagtgcagtggcacaatctcagctcactgtaatctctgcctcccaggttcaagcgattctcctgcctcagcctcctgagtagctgagattacaggcgcgtgccaccacacccagctaatttttgtatttttggtagagatagggtttcaccatgttgcccagggtggtttcaatctcctgaccttgtgatccacctgccttggcctcccaaagttctgggattacaggcatgagccaccgtgcctggttgactttttttttctgtttttaacagagtctcactctgttgcccaggctctagtgcagtggcgtgatctcggctcactgcagcctccgcctcccggg

SEQ ID NO: 81579 - DNA, 1063 bp, Homo sapiens
acttttttttacatacatttaaagaatatacaaaaaatacaattctgccaggcatggtggttcacatctgtaatcccaccactttgggaagctgaggcgagaggatcaggatcgcttgaagccaggagttcgagaccagccagggcaacatagtgaggctttgtctctactaaaatccaacaataaaaaaaaaaaattagccgtgcatggtgacacacaccttagtcctagctgcttgggaggctggggcgggagaatctcttgagcccaggatatcaagggctgcagtgaactctgattgcagtattgcactccagcctggacagcggagtgagactctgtccccaaacccccacaaaaaacaattctgtgataaaccattgttctgggtgttgtattattctgtgttttcctgtaatataaaaacatgatgtggtagaatatagtcattgccttccattatatattcttagaggttaaggatgtacttctaatgtcattgactgcttcttaataaccagtgaagggtatatgttttgtgactactttcacataatttatttatatctcacctgttacacaagaaattcgaggcatatacttgtgattttattttcctaggtttgtttctatttgtgtttggttttgcttgttttgagtaaaattatataccttaatagttatacattttggataggaacttttgattgagccatgtatataggctttattatttcttgccaccatgagtagcacttgactgggtcttatgaattatttgattcactttatgcatctcatgaggtgatttcagatgttatgatttaagtctgtaaggggctaagcacacgtcccctaaatgcttgattatgtttggagacatactatgggagggtattctaaaggtgggaaagaaatgtgagggcctgtgatgttatccccatttgaccacagtaggcaccagttgatatctgcttaacaaaccccttctccatagtccatgctgagacttgtcacatgttatattctcttaaaagacttaacattttaccatgtttctttg

SEQ ID NO: 81580 - DNA, 1094 bp, Homo sapiens
cctgacctcatgatccacccgcctcggcctcccaaagtgctgggattacaggcgtgagccaccgcgcccagcctcgtacagtctttctatacctacgaatcctctgggttctacacgggtatgtccacatatagctttcaaagttagactgatttttctttaacccttgtctgtggcagatttcttttcccacctctatttcagtcagggatgatagcagccgaggatctcttgtctttgaaaatgtgcttctcactctggagttgatttacatttccctatgtcctcagtctctgatgggtttttattcagcttgttttagttgttagggtgagagtgatgatctctttggagtttctattttcaaattggaattaagtcctccttcttcccaactgactttcaccatttgtttctggttcctctttgcttcctttctgtttctggattacttgagtatgttttagtgttctgctttatttcctccattggcttttctctagggttcacaatatcctcccttaacttactacatttagaatattgtgccatttcatacaaattacatgcatttttatattattgtgcatattttacaacagtatacttccttttaccctcctccttttgtactactgtgtcatatattttatttcaatgtatgctgtaaactccattagataatattatttttgcaagtcagttgtctgtaaaatactaaggttgggtgcggtggctcatgcctggaatcccaacactttgggaggccaaggtgggtggatcacctgaggttgggagttcaagactagcctgactaacatggagaaaccccatctctactaaaaatacaaaattagccaggcgtggtggcgcatgcctgtaatcccagctactcaggaggctgaggcaggagaatcgcttgaacacaggaggcagaggttgtggtgagccgagatcatgccgttgcattccggcctgggcaacaagaacgaaactctgtcacaaaaaaaaaaaaaaaaaaaaaaaaaaaaaaaaaaaaaaaacctaaacaatatttacctgaatattcaccatttcctgtgctttctattctt

SEQ ID NO: 81581 - DNA, 1046 bp, Homo sapiens
ttaaacatttacgtattgcttttccctacacctggcatcaaaactataacattatttgtcatagaacatatttaaactaattttctcccaatgacattttgtaatttgattgtataaaattatgtaatctattatgaagagaattactgtgtacctagaaataaaggattgttggggaaaggcttccatcagtacagggcccctttctgattaaacctcgctaaacatcacaaagtccaatggatgtttgaggagacagaaagaacagccaatctttaatactcgagaaatctgatacctttgtgagttgctgtaaacactgaattaccatgagagaaggttatagtaacaaagaaacaacaaaaagtaaccagcagtcagaaaagatgttgcttacatctggcatataaatcagcctatttttaaaaaatacttttatccttgaaaagttgttttgcataccaaaaaaggaaggatttttagcccaagttaatagcatgaatctgttgtgttttaatggctgaaagtatgcacagacagaaatgtgtaccacatataaccagcatgtgttgttcctaaaacccaggcttcaagtgtagtcaaatttattaccatttttttcttaaaatttactttttctccagttgaacctctgtaggtttattggaatgaaatttagtatcctttcttaggtctgtcccattgccacctgaattgttgtgaaacctctgtgtttattgatctcatgtggaggtgaagaggagtggatcagcctttttcctacagaggacataaaaacagccagagcctggtcctctagggcttctgctgttgcttactaccctgttgttgagagtgtattggcataggctgctgttctgcagcacaggctgcagtgatttttcagaggtgctgatcccaccttgtagttacaagcctgggcacagatgctccatatttgaattccctgtgttacagtttctaggagtgacaggtggcccaggaacactgggtcagccctggtttcctcatcacttccattgtgc

SEQ ID NO: 81582 - DNA, 1365 bp, Homo sapiens
aagagtagaattgctggatgtatttttaactttgaaagaaactgccaaactgttttccaaagtggctgtaccattttacattcccactagcagtgtatgagggttccagttcctcaaccttgccagcatttggtatcttcagtcttttttatggtagctattctagttgctgtatagtggcatctcattgtgtgttaaatttgcatttcactaataactaaagattaagcaccttttcatgtgtctatttgccatctctttggcaaatattaactatgcctatcttttggccatttttaaattgagttgtttattttcttattattgtattgtaagagttctttatgtatactggtgttaatggataattttcataaaaaagctaagatcgtgatgcccatacagatataaaaaatttaaaatgtggcaaagcttttatttaacttattaatgagtaaattgataaggtgttataacaagttcaaggagaatccctagaacacacacattcatagatcaagaatataaaaacggcctgggcacggtggctcatgcctacaatcctagcactttgggaggccgaggtgggaggatcacttgaggtcaggagtttgagatcagcctggccaacatggtgaaactccgtctctactaaaaatacaaaaattagctgggcgtggtggtgcatgcctgtaatcccagctactcaggaggctgaggcaggagaatcgcatgaatccgggaggtggaggttgcagtgagatgagatctcgctattgcactccagcctgggggacaagagtaaaactccattgcaaaaaaaaaaagaatataaatgaatattcaaatggaggcaaagctagttttctcaacaaagacagagcattgtcccccccactggatgtaatttatgtatgtgtttataaacaagaattgtttacattgttatcagttatctgtagtttacagaattgtaaaattgctgtcagagactcagtatcagataacctgtacggatatactagggaccgaggttagaaaactctgacctgtgggccaagtctagcacttcatctgatttagtaaataaagtttttttggaatacagccatgtccattcgtttacatattgtctctggctgcttttatgctgcagtggcagagttgagtagttgtgacaatgaccatatggtttgcaaaaacgatttacataaatagccctttacagcaaggttgtcaacttttgtcaacccctgtgattatctggatacaagtcatttatcagatatatgatttgcaaatattttttctcagtctgcggtttgtgtatttttttaattggggtgtcttttgaagagcaaaact

SEQ ID NO: 81583 - DNA, 1060 bp, Homo sapiens
cccccttcacctaacctgggttttaagttcctctataagatgtttgaacatcaatctctagtggagaaagtagcctttaacttgtcattttagcgaattattcttagtgcaagcatacatacagaaatctttctggtattagcatttttttgaagtgtggctcatgcaggacaatggaatttacttcattcttgcagattcatatagctaaagacaaatgtaaatctttggttgtagctttctctgaaagcaataagatgtatatacaactttaaatcttggattttatttacatagggtgttatttgacatcaatttttattctctttactccaaaggaataaaatagtaaaagctagaaaatgtttttcatagattttcagctcttcagaggatgaaaaaaaatttttaccattaaacaaggaatcatgcagttcttataaaaattaccagaggacacagtataatttcagtgttgattatttatttaaaatattatacataatttagtttttgaggacagcagcgatcaacagacagtaatatctaggtaacaggaaagtaaattcattttattgttttaggtgctgtttagatagtgtcattgtttaggttctgtttctgtattgtttctgtgatagaaagtttcttggtgttttgaatcattaaccaaatgaactttcttattctcttattataggcttaaaatgaacttccagtggaaagtcactactactatcctaaaatttttatggtgggaaacagaattctaggatctcatgccagtagtgctattgacagtccatatgcttgtttgttgattaaactcaattttgaaacaattagagactcatatgctgtccatatattttgaaccaatcatttttttctttttaattttttccagctattacctggttttgtacaaattagctaatgctattttatgggtaatgaaggaggccatatagaaaggtttgaagttgactgctactctgtggccccaattttgttaagcaccaactatgataatagtcatgattaaggtaaggtatcagaa

SEQ ID NO: 81584 - DNA, 1055 bp, Homo sapiens
aaaaaaaaaactctttgaacatccttcaggagaactacaagaataaaacagtatctgtaaagtattgaaaggaccctggcggatacaagcttggacaccagggaaggttttttgtttgttagttttttaaagatgaagtcttgctctgttgcccaggctggaggagtacagtggcatgatcatagctcactgcagcctcaaaatcttgggctccagcaatccttctccttggcctccaaaagtgctgggataacaggtgtgagccacctactgggccttttttttttttttggagaggtggggaaggttttttttaaagcacagcctaaagtgataatagtcagagcctcataaatgttgcgtgtacgcaagtatgccagtgaccatgagtattagactaggatttagcatcccattttcatttcgtttcccttgagcagggtccaaaataattcctttttatttttcctgtataaaaggaaaaaatattagagctactattaaaaatgtctatgcctttctgatggaatacctagggaaaatgttccttaaaatgttgataaccaaccttttccaaactttctttacatgttctatgaaaaagtgtgcggtggccaaatgtatgggaacctgctggtgaatcacaattaagtgggtttcctgacttgataatgctctgtgatatgctaatgtgtattacagtaaactgtataatgtattgtttttcctaaacttaatagaccatgagaacattgctctgaactggtgttcctgtgaacacagttggactaaccgctacttgagatgtgtgttgttccataaggtcagtagtaaaaattattacagacatttggttttacttaaagttaatttaaaaattagatgtcagctttcttttgttttttttaagttgctttttggggtgttgttttgaaataattcctatattttgctaatctgccagttcaaatattataggagagtagaacataaacttaatttggaaaatgttaatattcttggaaattttatttgcaactaaagcatttctgaaa

SEQ ID NO: 81585 - DNA, 1406 bp, Homo sapiens
aagtggcaaaaaccaggttccttgaaatgactgtaattgttcttttctcaccctggcaacaaacttgactcatcaagatgcagaagccatagtgacagacttctggttcagactcaccactttgtgtctctttttttctccatgctacccagcccttttctccatttaagaaatgttggcagggtaatttaaaaacactcacctagcttggattatttgcattttcaccaaaaatcctgcacttcagcattcatgtttatgggaatagtcgcagctactgatttcatttggttaaactgttataatattgattcattttgtttatttcagttcataaggatgcaatttatcctaattttgattttggttgtagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttggtaagtgattgtgtttaaagtaaagcagccaaagaataagatggaaagcctttgtttctttgactagaaccaattagttagtttccttccttctgtttatcttgacgattgcttctctaagtttgtttttgcagtgaacaaagcgtcattcctagctaacaaatggaatttatttcagtgagggattttatactttaaaaaagaaatctgtgctaaaactgtgtttagggataaaatatatgagatgatttcctcagagaaaggaattaaagagtgtgtgtgtgtgtgtgtgtgtgtgtgtgtgtgtgtgtaaggtattgaacaatatgaaaagatagctagctacgggtcttaagtattggcttagatgttgacttctccctagaaaaattggtattgggtatcctaataattaatattgccagataaccagattataaaactttaaagaccttaaaattggctgaacttcctgctgagctagaaatgtcagcctggctaaaaaataatatattatccactgtagagttctgtagctgacccattttgacatattatatgtcatagtacataggccttgaataaaacagtacatttattttatagatagctgaataattttgttaacttgtaagaaacaaaagtgccatttaaaaaaattaaaatatgaggccactttgaaccttaaactgtcacaataagcatcatatgattttactcataaaagcatttttataatttatctctgagggtagtaaagtgaataatttactagtccctaaaggaaatattttccaagataatacaatgcacatattattttcaa

SEQ ID NO: 81586 - DNA, 1014 bp, Homo sapiens
cagccaaggagcaaggtggtcattggatggaaaattgctcagaggcaacatcaggaataaggagacaatatgtagttctggcaagaaaagggatgactgaccaaatagaattcttgctgaagacaggccagggtgattagaccaaggagatgggggagaaaggaggaacccaatcagatatcccaagtgaggggttcttgctaaactgacttagcagagttctttgctaaaactggattttacagggtccacacgtggacctagaagaaggtttaggaacctgactaaagtttggccaagcaaagaatctgtatcaaggggcagaactaggcttgtttaggctgacccataacttactttatataacactttttatggttttcttccagagtagaaatcttcgaatatttctaatactatgtattaaattttatatttcacattataatggtgcctgtatataggaattacagcacttttctttctaatccagatttaggtcgatctcgagaactacagtatgtatacgtggataacaacattcacctgaaaggcttgccatcttatctgtacaataaagtcatcgggtgcagtgggtaaggccgatttcacattttgaactaaaaaatagattaactacttttggtacttctgttcaattttgtctttgcccttgatgatatgctaaaccaggtatccttagaaactaaggatattgggcaggcagtttggaatattgcacattgggttcagtcagtaagttattattttctagtctaaagaaaaatgaatccatgtatacctttttttattacagaaagaaacacctttatttccccccacacaccccagctttattgaggtagagttgacaaataaaattgtaattatttaaatggtacacgtgatggtttgatgtacctaccacacataccgttataaactcagtggtgctagtcacagaaagtagaggaatcagcattaatttagaaggttttctttcactgaagccca

SEQ ID NO: 81587 - DNA, 1011 bp, Homo sapiens
ctaaagataggctctcaaatgaaaaattccccacttgcacaaccttagtttatgggcttcctaaatttaggaaactaaatttaaactttttctaagtttgaattttttaagtaaaaaaaagtactatagtacctcatttatcaccatcaaatgtatttcatatgagtaaattttccacataactgaagccattacccctctttccatgccaaaaagcattttgcttgtagtcatgttaatagaaacctctccaagattttctttccctccttcgtttcttagtccatgcaagataggcaatatggggcagtgttcagagcatggactttgcacccgacaagtctggcccttctgttgtgagaacgtgggcaggctgtgggacttctcaaaatggggatacaacagcctgcgtggcagggccatgtgaggcttggcagatgagaaaggcacacacctggcatgtaagaggtattcaacaaatggtagttcccatttacatagctctactcacgccatcccaaaaccgtgtttatctttttcttcctctggataatcctgttttgctatatttcacttcctatttcaatcttctgtatttttaatgtttcctgcttacaggagccctcctccaaatctttctaatttgctacttctaaggtgatcagataaccagatttggtggaattgcatttaaattagaataaaaataattgaattgggttctgactgtattactacatgaataaaattaacaaataaaatagatacgtttatgagaatcttacagtggtgaagtgcacaggccctgattccaactccacaaggccacctcaggcaacttactgaccatccctgagcttagtcttttcatcaatagaatgggaataataataatatctatttaatagggtcattgtgagaattaaatgtgatcatccctgtgaagagcccaggatggtgtctggcaagtaataaaaagcaaatgttaactattattatctatttttgtag

SEQ ID NO: 81588 - DNA, 1730 bp, Homo sapiens
atagcttggttctttcaggaattcttggtcttctgggccggagtgattctatgagagtgccacatgtctgagtgattgttgtgccttgaggtaaagacctgtttgttagagggcctgcaaaactgacttggtcttacagtttccttttgtctttcaaaacaactaatactcccttctcccactcactagtagtttatttttaaaataagctcttttatataattcttatctggtttcctcacttatgaaatgtttcatatttccttacccttgctttttgtggctattgcttctttgaagccaagtaatatcagtcacaccaacattatttgcatactcattttggggattttgtttttccttttggcagaagcctattcgttggcaccctcttaaggtgacttatgaaatttcccacaagtgaaatagtcttcaaaaatttaagtaaattgttcttagctgtttcttcctccttacaacattcaaaaattatttgttgaccatctgtcatgggctgtgctctgcagtaggtactgaaaattctgctttgaccccaccacctaattcttttctcatacatatctcattcctaatgtctagggcaatgacacaatcaagaaagaagtctgcttgacatttctgtttctgtttctgcacacagaatcttcccatgagagacagtcactactaacataaatgcaacaagcagatacaatatgttattagatgattcttgagtaagttaatatgtacacaagctcaggattttaactttgtcttataaatactattttttcttttggcttgacttcctgtacgagtcaaatatatgctttgtgtttttaatcaggaaacatatttgcagaaaaaatcgcacatttcttatgatttttgtgggctccaatatgtgccaacagcattgtgattcgttcttttaaggaatagtggtatttctgtattttaaaaccaagctgaaatgctctttcttctgccttgcctgtaaatatgctcaaagattctaaagcaacaaatgtcatgtctgatgttctttgtagaatttatcagcatctttttcttaactgtagagcttattgcttagctcaaagtgtttccccagacctctgatgtctctggtgccacagttctggattttaaaggacttaaccaacatgaatccattcttaaggcagcagattggttggtgtacttgtaataactcagattattaatacaacaagcagatacaatatgttattagatgagtctcccaaaagcaaataagtacacagccttgggatttatttgttgcacaaatatgaaacctccaggttactccacccccgtgagcttcataagtagttaatgatgatccaaaggacattatcctttaatgagtgtaaatcccgtatcttcatggaattgaatgcttttgcttgggagctgttttagtccgttcttatgctgctgtgcagaaatacccaagactgggtaattcataaaggaaagaggtttaattgactcacagttccacatggctgaggaggcctcaggaaacttaacaatcatggctcgaggggaagcaaacatgtccttcacatggcagcaggagagagaactgctgagcaaagagggaaacgacccttataaaaccatcagatctcatgagaactcactcactatcacgcaaacaggagcatgggggtaaccacccccccatgatttaatcacct

SEQ ID NO: 81589 - DNA, 1031 bp, Homo sapiens
tccagtgctcagtttgaaaaggaaatttaaatttctattatgcagtttgttgaccatggctaatcctccattttaacaaagaaaaaagtttccagcagaaagaatcagagactttaatcttgaactcacagcgttcttctctccctttttccccttccaggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtagattgtaatgaaatacacttcctgttttttaaaagtgtttgcagaaaaatgatttttgaagtttttaaatttcctgataagattttttttatatgagaagaatttgaggaatatttgaagctttacaagatctgatttttt

SEQ ID NO: 81590 - DNA, 1019 bp, Homo sapiens
gctccatagaagtttttttttttttttttttcttcacacagcagcctgagaattattttaagagcctatattggatcatatcatttctctgcttaaaatcttctggtgacttcccattcctctcaaaatcaagtcctccattctgtggcctaaatggccctgaatgagctttctccttctcatcattcttcccctcattcatcacatgtcagccacgaaggcctctcagtgtttcttaaaccctctgcacccttttttcttctagggccttttgcactttctgtactccctccttgggatattcttcaaatgtctggcttggctaaacactttggagtttggcccaaatctcacttctcactcagaggcctaatctgaccatcctatttaatattgcagtctgtcattttactctcttacacagattatttccttcaagacaattgtaatttgtgtatacctggtttgtttagttattgcttatttatggtatttgtccattacctgaatgtaaactccataaaggcagaggccttgttcatcttactcttagctgtatccccaggcattagcatgccgcctggcatttggaagatagtaaatatttgatgcttctgtatctttgttcctgttttttgccaatgattggaatgctgtcttgcacacatagttatagttattgaactacttatcctttaagtcttagctcagatgtcatctgtgataccagttttaatctcctagacaaaagttttttgctcttgctcttgtgtgcttctaaagcccatgatacatgcactatttgtagagtaaatcccatgttaggtatttagaatattatttgattatttgaatataattgatgtcactgtcttctattaggctgaattgctatgtcaaggaccagctggctcttttgtgtgctcagtatctaccaaccaacctattatagtagatatagtgaattctcagtaaatgttgaattgagtagaagttgtcctaatcggccgggcgcggtg

SEQ ID NO: 81591 - DNA, 1055 bp, Homo sapiens
ttctcattaaggacttttccaccaacctaccacctatattatatattccttattcaccttgtactataggtctccccactagaatgtaagctctatgaagtcaggaatagggatagggattgattcctagcacctagaaaagtgcctggaatatgttggatgcttagtaaaaattttccaaatgaattatattgaatcctgggccagatattgagtagatattggggatataaaaagaacaaagtacaaagttccttcttttaaaaaagcatatggtataatagaggagactcatacttgtacaactaactacaataattttaccccctgggagtgatggtgatagttaaggtgtactgaagatggcgtcacagaacgcgtcattgaagtgtacgtttgatctatataagagacacaggggaaagttatttccaggtggaggtaaaaacaaagttaaagagcttaacagtctcagcaatggcttgttgtctaggttaacagtgtgtgtcaacgggtagtcgagggagatagggatagcaattagaggaccaggctgtctcccttttaggtgggtggaagcaacgggatttgaaggctcagtgtatgaaatttgatgataactgactcagcactaacattctagtttagtttttttttttaaagagcgtgtctcattacagattattgtaaaataactataaaaacttgattttttacagtattgtcttttagaaactacttgaaaactaggtacaacatacatcatcagtaacagtacatttatataattgaggaatgcattttgagatgagaatatgtactgtgatgtgtaactatcaaatttgtgtttaatcacttgtttgccatgggccaaatagctaaattttggctttactttgaatgattgtattttagaagttggtaatgcaactaaatttgaggaatttttttctgcattttagtaccattagattaaaagctgaaattggtgttttaaagtaagctccttttacctttgcaaaaaaaaaaaacttgtttatgtgtttttatgtctt

SEQ ID NO: 81592 - DNA, 1023 bp, Homo sapiens
tgagtatacttgctaaagacaagctttatgttttaaggcatgtgtgaaatttaaattgtgaaaggataggtatactggatctaggaagatctacattccaaagtatgagcaaataggaggtggcagcacttgaagcttgaaagattgtaacacctctggcatggctattgaggatggaagggggaaggagggaaagaaccaggctgtgagagcggtggtggatttctttatgtctctagggtttatagtcaacgctcctttggcagcagtgagatgaggatttctgtggtagggctgggcaagtagcagccagactccttaccttggggagagccctggatctacagtccctgggcaaggctgctgcattgcgcctcagactagctgctccgaaaaccaaggcagggctttagcttctcaccccctcatgaaggcagcagaatacagcggttggagtgctgttctggaataccacagacctgagttgtcttggctccagtatttagcatctgcgaccttggcggggtgatatttactgcctagtcttcagttatttttcagatttaaaatggggataataataatgcctgtcttataaagaggttgtaagaatttaaaaagttatgtgtgaagtgtattgctgttgttactatgcagcagggccctagaaaacctttctttctccattcagccaactgattactcattttgttttcagatcataaatattcacatcataaatgttaatgtgttctataccatgattgaaaatgtgtgtgttagtattgtagtaatactgtcttttggacccctttcttcaaaatatttgcaaatgtgtggtattttattctggcctcatgtggtacatataatgcatataattggattttcctgttataaaaagtcacttttacttagaaattgtcaggtgccaaaggttatacagctagtttagtgacaggtttggggctgggatgtaggttttctcacttggcttgcagtaaaccttctcagtcaggttgt

SEQ ID NO: 81593 - DNA, 1031 bp, Homo sapiens
tgaagaacagaagtgctggaaccagattccctgagtttataaccccaagctctgccccttactacgtgaccttgggcgtattgcttaatttttctgtgtctcagtgtctctatttataaaatggaggtaataattatagattgctattaggattgaatgagttaagacatgtccatgcttaggaaaatgtctagtacatagaagaatctcagtaaggcttggctcttgttgctattattgtatacattgagaaaacctcaaacattattgttgcattagtttaaccagaactagagacacaaagagattcaagaggtattttaggggtaaagttaacaagacttcaacttatttactaattttgtataaccagaaatttcaactaataatgctgtgtgcagtgtaaaagcaaatttgaaatttgtataacacttacatgatttgtaaacttacagattttaaatcttctaatttgtgttttcttttagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtaaatgaaaattttaatttatttaattgatatgaatattcttttaaaaaaagaacataggacagaatggttgggtttttcttaaacttaattttaagtctaaatatttttagttacagactaaatgaaaaattctaacaatcataaaattgtatcttttcatcatctgctttaaagagacttccttattatagatatatgtcaccaaaaatatagatactcaaaagtaaaatcaccacaatccccaccattaccaatccattgtatagatttctcataagatatttagtcttctatgtatttgattatatatttgactgttagtcttttttatattgattattttt

SEQ ID NO: 81594 - DNA, 1058 bp, Homo sapiens
catagaattttcagactacctcaatcttcatctctgttgtggacagcaaagtgtaagagagcagatcccaaacatttttttaagcagtctcctatattacagtctgtttcaatatgaaggaaaacttttgcggctcaattacatattgggattttgatgttttctttttaattgcatttcctcaaaataagttaaaatgaatcgtgttaatagttccttgtgaagttctaaattatataaatacagtagatagaagacacattagattattagggattaatttattgtggtaggataaattacaaggcttaattcacacttcttgtatattaatgtcttactgagtcaacttttattaagagagtggttgttaagcttgtgagataggccttttttcacatatgaagatgatgcagcctacatcttcactagtagtgcaattcacatacgagttctttttgccagtagtgtaatggcttacgctaatgcatctatacagtttgctatggttcaaattaaatttacaggataacagtaatgaagttacttacatagagcttcctatgggtcttagtttttacaaagtactttacagttgcctcattgaaggatatttttggaataccattttttccttttcacagtttcctttcaggcagttgtattgatgggaagcaggctttttgatgcccatttactcatttgacaaagatttgagggggttctatgtgctttgcaagttgatcttatttagagattcctaattcaggccagaagaatattcttcctacccatatttttataaaccattgaggtatacttttaccaactgaagattttatgtatatttataagaactttgaacaagttggtgataagcttctggactccttagccatctcatgtggttgaaaacatcaggataaaatagaggcatgaacagttataagtgatctactttagagtgatttctaaagtatatgaccaatatacttaagagtttgtgtcattatgtaagcaataatgacacaaactctgaaaacaacaacttccataag

SEQ ID NO: 81595 - DNA, 1045 bp, Homo sapiens
agaaccaggattaggacccaggtctgtgacattaacctttccccttgctccttagttcactgcatccaggggagctctggagcattttaccgtaagtagataagattttatacatacaccaatcatgtacgatctatagcagtcacgaataagttttcctcagtaatgaacagaaaactagtgaggataatagcagtaagaatgataggtattattaagcacttaacatggtctagtaaagacttcatttgaattatcttattgaatccttactgttgcccttatttcacattgaggcaatggagacacagtgataaattaagtcagatgttgataatttggattctgaagaaagagaaaatctgtttgagtcttaaaaatcccttcctattttcaaattacaaaagaatttggaagtaacatctgaaagaaaggaagatagggaatcagtataagatccatctatcaattagaaaataaaagcagatggtagtgaaagtgattatacttgagagtaccttatttaaaatcactggtcctcacaatgtgtagtgccctgaccagcagcagcagcagccccagaggcttcctagaaatgcaagttcttggtcccaccttagaccttctgaatctgcagcttttgagatgaagccaaagcagtcatgaattaatttgaattaacttgccttaagtgcagttatagactaaaagtttccagttaacagtttcttgggagtggttatccagctttttaaacatttttatccccaagaatatcccctgaaataatttcaaacaaagagcaagcacaaactgtaattttttaaaccctctaaaaagtaattcaaactatgcagtatttgtgtgaattgcacctaaggaatacatttctaatgggttacatttcagttcgattccacatggttataagagcttgtgtgagtgtggtttctttgaggggtgcttctttgagaggtgtggtggggatgagtcggaggtggaatctggctcttcagatgaacaaaaaagaaagttaaatgaccta

SEQ ID NO: 81596 - DNA, 1056 bp, Homo sapiens
gtgttacaatcaaaccatctactgctttggaagaaagggccaagaccaagtcaggctgccatggtaagcagtcttcatcgaatgaccagatgatctctacagtcttcatgtggacgatgatctatgtctaatttatcagtaaatatcagcatctagtagggtgctttcgataaattttgttgaatgaaagaaaaaaggcaaattaaggtatttattcagtaaacaaaaagggatagtgaagaaccaagctccaggacttttgaagatagactttcttgtctgtggtgcactgagaatcagctctatcttagtattcatttacgtgtggagatctagaacagagttacattctttctggtgacaagctgagactacctggctgctcaatatccagctcctgggagacaagggcctcaaaactgttgggattggggggtggggcaggtagggaatcttactaccatttgttaggatttttaccatcaaacctaggagtagcttggaactgggtaagatcttagaatttagagaagccatagcctgaacaccacacacttctcactgaggaagataggggtgataagatcatggaggaactggagaggaatatgaagacagtgcctacaaccaccacatacacagtaaacattctctcttctcagtggttgaagttgttcctgattacagctctcttatctgttctccctttgatttgctgactgatggatgcagtccatttaagaaatgagcatagcatattggaaagagcactagacttagattctagtcccagttctgtcacttaacagctatgtgttgaggtgaggtgagggaagagtacttggatctctggatctcttttaactttaatattctcctctataagggtagaagatgaactagaggatcacaacagtaccatttagttttccgttcagtggcaattttgacatacttttttgagcatacataatctcagaatcctatgcctcaaaactttgattcattggacagatttcaagaaaaatataatttaacaaatgtaataaagaaaaa

SEQ ID NO: 81597 - DNA, 1053 bp, Homo sapiens
tgcttcataaatacaaaaactggctcttccacagttgagagaggaagtcagttgaacttccaccaggcgggatttgtttgcacatctacaaacacaaattatttgcattactctcacttttctacacattatcttctgtttacagagttggaaaatagctcagaaaccaaggtacaaaccccctagaatcagataacttggcatgtgctctaaacaatacagagttttaagagatatttagttttttgggtttcatttaaaaatatttcagtatccttacataactagcgttgaaaggtaaatattagctaagtttattacttaaatcctgcgttttgtaccataaatgacaatgtgcagaaagtacctgaattggcccaagtcaaaaaaaaaactgttaaaataataatggaatttaactttgttgtgacataaatagaaaaatgattgtttctaacaagtgcttaactgaccctccaaaaataaaattactgtcttctatagacgtgtactgatgaaaaatataggtgtgttaattttaggattttatttaagtaatattgccaattgggacctttaaattagtttggaacatgtatagaacagggtgtatcatcggcttaaattgattaataattactcattaatattgatctttatagcagcctgtaatgtatgttgtagaagacatttctttaagaaaagcaactaggataagtcaacttaaatgggtacacaccattgaaatttgaaattattttggcacaattgagttttctccttaagtttgttggaatggcattgaaaaactcaatcacgttatttacaaggagtaaaatatctttgaagttttatttactttagaatggattataatgactagtaatagctatagagagtactcagtgctagcactcttgatgcatttttctactttttctttatgaggaataagcagatctctcatagtggtgacctttcacactgtgttttcctcattgagcaagtgtctttattgtggctaacttgtgtgtgagaaaactgaagctggcc

SEQ ID NO: 81598 - DNA, 1041 bp, Homo sapiens
gtacaagtatcattagtcttaagctttatatgtatttcagactttgcttgtcttcctttgcttatttttaagatatcccaaggtacttcattagttaccacaggttgagtatcccaaatacaaaatgctctaaaatctgaaacattttgagcactgacgtgattctcagaagtgtcaattggaggattttggattttcaggtttagggatgctcagccaataagtatacaagtattccaaaatcagaaacacttctggtcccaagcatttcggacaagggatactcaaacctgtagtgagttttgttataaaatttatttgcaactcagactggggaaaacttgatttgtttgtgccaaagtattttaataactcttctcactttattgaatgatatttttccccccagggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactagtaagttgaacctttcttcaacttcattctttaaaacacatattttatacatagtcaatctgtagcttcctttggaattttctgtgccaccgtagaatctacacctattcctaataaatatttccattcaaaattagtatttgaagagacaagtctatttcaaatacacaaaaatcagattatggaaatttgcttaacagttacttaaaattaaagctaaatacgaacgtggttggaactggaggttattgtgttaagtgaaataagccaggcatagaaagatagatactgcaaggtctcactcatgtgggacctaaaaaaattggtcttgtggagatagagaatagaatgatagcagaggctgggaagggtgtgtgggtgggagacgggatgaagagcggttgattcgtgggtaaaaacatacacttagatacaataaatata

SEQ ID NO: 81599 - DNA, 1015 bp, Homo sapiens
gttttggaaaaagggcaatagttgcttttaagaaaagagcgccttctgatagaaaagtaaacttatatacacattcaattacagacattccttttagtaaacagggaacccccttgtggttcaggctgtatcatgcaggatgaaataattccaacgctgaaaaaggtgacctcaccaaaaatgatgtaatctttttgaaagagaaacaacacaacatcgtgtgttacaatctgaggaacttcgagggtgaagtcattttctaaaaatatttcaataatttggagagctatataaggtattttgtatctttccttaaaaaaaaaattaacaagtatcctatgctcatggacagctactgtttttaaaggctctattccaatgttccctccaacaaataaaatgggtcaacacatacaattataaatagaaaaactagagtctgtagtaccagtagattgctttattcaaagtgtttgaatagtgtttaaaaaaatttgtgtaacaaagggaacattggttagataacaacacgtaagagaattagtactttctacatctttttcaacttccttcaagcagaaacccacactcaccaactccaattcctcttcctccgactgtactcagcacataagagggataagagagttactaagactgttggtactcacaaacaaaatatttctttagaaaaaacatatttggacactagcagctgtctggaactctaaagagacgattatatacacaacagatagaaatataaattacttgtctctacttgttgagttttcaaaagactagaaaaattattttaaattctctagggccagtattcaaagacaccctcctaccccaacttggtctgctctcatgctggcctcttatacatagtcatgctactgcaacagtatttaaaaggggttcctcatcatgctatcgatctgtatttggaactgtgagaatatcaactctgtacttgtaactctgtatcttaatcaccctactattaccc

SEQ ID NO: 81600 - DNA, 1163 bp, Homo sapiens
aaagaaataagaatacaagctgcacccaataagccatgacttcaaaccgtgttaacacgtaaataataccgcaaagaaaagtagttttgattcctatactcatagacgtacaatccctatatatacagatgacctttgccatcatcaggtatttaaaacctacacatacttcatttaggggagtctgacagtatttgtagtggcatcaagtcctcattttgtgcaacaaatagaagtgctaatgcctgtaacagaagttcctattttaacgtggggtgtctgacactaatcaactattttaaaagaattaatgtaaaaataggacccttcaaattaaatatttagttattctcactagtatttttgaagttttcacatcatcagtgcttcagaaaatgacattcatatgaaactgtgaaaaatgtcacttaaattgaaagtgatttttaagtcaacataaataccacatcagaacacattttctcttttttgatctcacagaatacccagaggatcagtagttctcaagccactcaacctcttgctaccccagtcgtgtctgtgacaaccccaagcttgcctccgcaaggacttgtgtactcagcaatgccgactgcctacaacactggtgagcctgctctggtgccttccgtaggttttaccgctctctgttttgtgatcaacgtgtgcttctgtgattttttttaagtatatttattgaaataaactatttccagttttttagatttaaattaggatgtatttttcaatgtgctagccttgaaaaaattacaaacaaaatggatagtgtggatagtgcgatgagtaagttattccggcttctccagtgtgaactttcacttaacccctgacacaaagccacgtggatgatagcaaaatggtgacatgcatcaagccaagaggggagcagcctgttgcttgagtattgctgatgtagtttctcttcatacagtatcacgcttttccaggcttttaaaataagatgtttgtctttatgctgtgttaacctgctttgggaaagacatgaatccctttggacctgagacttcaggaggtggccgacgtttggctgtgtcgaacaggctgttttcctccctgtaaccactagcttggtccatgtcatgtgcacctgaggggcaaaa

SEQ ID NO: 81601 - DNA, 1337 bp, Homo sapiens
ctgtgtggcaggcactgtgccaggcactggaaatgcaggagtgcagtcagcagtgaagcctggggggaaggcacaagacacacagctctagggataagctgctgcagttgtgtcaagggctgtgtctcagctcggacaggaaggaacatgcgtgactcagccaggcagaggaggcagagtgctcttgggagagggtgtgcctgtacaaaggctaggagtttgcgggcgggacggggctgaaggaatggggacagagcgtgggtggttagaattgagactagagaggtaagtaatgatttgtagactatgtcaaggattttggaaactgtccggagagcattggggagccataaaaaacttttgaagtagaggagtgccatgaccatatttgttattttaaaaagatgtctttgctgtatatagggttaaaaggcaatgccaggaagccacatcagaggctactgtagtggtccaagcaatgggtgctgatagcatagactagagaggtggcagtagagatggtgagacctgggcaggcttgagagagagcagatagaattgctcagacctggaaattgatgttgggagtgagagggaagggaagtagcaaggataacacccatgggcttctgcacgagctgctgggtgcatgttggtgccatgtactaagagtacttaaggaggaacaggtttgcaggaaaggatgggccatgtcagatgtgtggcgtttggagtggcgtccaaatggacatggcactaggtcgtttaaaagatctagaggtcgaaggagactgtgggccggagggagcactggggaaggcgtcagtgtgacgggtccttgccccagcccatgggagtgtatagaatgacaagggcagagtcaggacagccctgagcaccagctgtgtcgcttcaactccgttccttttttaaaatgttaattcactaggaagaccaatttctttaaacacctctcttgagacatgagaaagaagataaaagtagaagagttttgccacctctctttggaaccaagtgagaaagacaagtgttaatgatgagctgaaataactccccgtgtgagtgataactaacgtcctaaatcttggtcccagtgattacgactgaagcattcatatgatatgagctgggtatactctaggacaccgagttttttcatgaagttgaaactcttgcatgctgtcagggagtttgcgacagtctaggtactttaaacaaatgcgcttactaattgtgtaatgatgtcactgagcttggcaccccatgtagggattctgtctttcctgtcccctattccctgtcccccaaccccttgc

SEQ ID NO: 81602 - DNA, 2428 bp, Homo sapiens
ccagcccctcatttcctcatctggaaaatggggatggtgcgacttgcaccttagaggtgttgcgaggatgagcgatgttgtgccctgtcacagggccagagcagatggggagcagatgctgaggaagaagaggcggtgagcagatgaggctgctgttcctctgtctttctggtccctgcacagcattaagacactgacattgttttgtatactttagctgcaaaagtaccaacgttgtgggtaacagaaccaagtaacgtaagggctcaacggtactgttttctttcctcctaggaagatgggatttccttttgtgccaagcactgaaggaaacgacccaaaccagtcttggggaactctgataagatttcagactctgggcccttttccatcaggcagtgtctctactgtatcatcccagttttgcagaggtacttgcaagccatctgacctctctcttttttttccttcagtgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttgtaaggcattatttaaaacttgccttttgtgaggaaaaaatgtagtagaaaaagctgacctaatttaattaatattagagaaaatggcaaaatagtagatgagcac

SEQ ID NO: 81603 - DNA, 1878 bp, Homo sapiens
ctatgtacattttgttcccccccccccaccccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagaggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttttatcaaatggtgaagacaatgctaaaggttgttgtaaactgtttgtctcccgcactcactccagtaaagacggactggctcttcctgtgcgtcgagactctgtcatgtttgcctggggacacaaggcgctggctttgccaccaggcagccccttcccctaaagccctctcctttttcattcctttcacgaagacctttttcacctgcaggcttctttctctgggttgagacagggtcaaggaaaccgtcccaacgcccccac

SEQ ID NO: 81604 - DNA, 1007 bp, Homo sapiens
aagcggaaatctgggaagattccattctgactccataatcacaactgacccaacaagacataagatgggagacatactcaggactaggggttcaccctggtggctcagggtgaaccagatggaaagacccaagtgcactgaggcatgcagcaatgggagggaggaaacagtttggagccttagcaggcagctcgggccagacagcgagatgtccgcaaacagccttgctaagaaaggtttgacaaagataactttttgtggttgttttaagttagcccttgaaataaggaaaactgagaaggagatgcctgttaaggctaaaagtgacaaaaggcaaagtgcaggttcactgctgcttttcaaaaaggagaaggagggtaaaggtagaaggcaaaggtagaagaaagcaggcaaagagcatggcagctcaagaaaactaaggagggaaccctgagaagcagaagcagtagagtgaggactccagcagccaggttcccatctcagccccgctgctgccagcaggggacctgcagcaggccactcaacctgtctgtacgacaggggactgagagagttcctacctcagagggctgtcatgagaatgatgcgagctaagagaaataaatggctcaggacagttcctggcacacagtaagagctaaatttgtcatttttatgatcactgttatgattttctagaagtgtccaaaaccccattccaggacaaaatccaatccaagatgctacagaactttacagctgtcatctctgaggctctgctgactggttctgagaaatcacagcagacaagagcagagccagtggtctgagggctgggtctcaatttcccaaacagataaatggccgggtccgaagaatgccgtttcagagtgctgtcaacccctggcacaactagaggatgagggatgatttaggcagatggtttgcatgcatttttgaaaagaaggctgcatgagtgccccaaatgtgcgagggtttaatgagaa

SEQ ID NO: 81605 - DNA, 1038 bp, Homo sapiens
attggttgattggtatttggattgtttccacttttttggctgttaggaataatgctgatataaacttttgtgtacgagttaccatgtggacatgttttcatttcccttgtgtatatacctgggaatggaattggtgagtgagaattctgtgtttaacttttggagtagctgccaaactcttttccaaagtggcggcaccactttacgtttctggtagcagtgaatgaaggctactgtttctccatgttctctccaacttactgttttttgttagagtcatcctagtgggtacaatgtggtatgtccttgtggttttggtttgcacttccctaatgactaatatatcattagcatctttttatttgcttatggattgttcatatatcttttttgcggaagtgcctgttaaaatcctttgcccatttttaaattggattgtcattttcttgtcgagctgcaagctttctttatatattctggatgcagttcctttatcagacaaatgctttgcacagattttctcccagtgtatgagttggcttttcactctcttgatggtatcttttgaaacacaggttttcagttttgatgcaatccagttaaactattttttcttttgttgcgtgtgcttttgctgctgtgtctaagaaactattgcctaattcaaggtcatgaagatttacccctatgttttcttccaagaggtttctagttttagctctgatatttacatctgtgatccattttttagttaatttttttgtatggtctgaaataggtgtacaacttcatcctttcgcatatggatatccagttgtcccaacactgttggttgaagactgttctttccccgatgaatattcttggcacctttgtttaaaaaaaaattgttttctggactctatattccattgttagaaacgactgtccttatgccattaccttgctgtcttgattgctacagatagctagaaagttttggaatcaggaaatctgagttcttcaacttcttttgaagtattactttggctattctgg

SEQ ID NO: 81606 - DNA, 1072 bp, Homo sapiens
gcgagcagcagagggacaggtggagccctgcaaggccagagggcaggtggggctgccaccaggtgcaggtgaagctcagtcttctctaattttcattacattggatgcttccagccagatgtgatgctgtgccaaggtgagtttgggacagtggacgtcgggaaggatgccacattgactaggcacgtgcttgcctggcctgcagctcagaacgtgaaggaatctgatccctgcaaagtgtggcccatgggcagtgggtggacacatgtctgggggagtgatggggaggagggaaggttgggggagagccatgtgggggaaatgttcccataactggagttgacatggttcaaatgaaaagaaattgtctcagtcccagaacaggaaggaaagcaagccattatccagatgtgtgaagcatggaaatgcttgtctgtgatttgtattaagaacgagccagccggcacagtgctgtggggacacggaatggacccaggacagatctaggcaagcaggcaacccaccagcagacagtcatgggtggtggctgctcttgcctcaaatgtttggcctgagtgctccacctagtaggcacagcacagacatcagatgggccggcattgaaaggaaggtatgcagagagagaatttctgagaatgtcataactgtttagaaatcctggagggagagggagcattcttttgttctagctgggattagggcagttgtgttcacataggggttggccttcctggaggaacagaaaagggggtgcctccccccaggaagggatggagccttggacaggctccagacaggtttcccagcaggttcctgcctgggcctcatccccagttcctgcttagcaatcatggcctcaggcagtcttcccttctctactgaagggtaattggttggtggtgcttgaagcattgaagggttctcacgtttccctcagcggagcttggagtgattcctgaatacgtttcctctgcacttggcccctgcatcaaagtccgtgtgtgagcgtccactgggcacggcagtcttacccaaattccagagttgttca

SEQ ID NO: 81607 - DNA, 1484 bp, Homo sapiens
ccctcatctgcgtcccgaaggaagtcatccgcccgtccctcatctgcgtccggaaggaagtcatccgcccgtccctcatctgcgtccggaaggaagtcatccacccgtccctcatctgcgtccggaaggaagtcatccacccgtccctcatctgcgtccggaaggaagtcatccgcccgtccctcatctgcgtccggaaggaatcatccacccgtccctcatctgcgtcctgaaggaatcatccacccgtttctcatcaggctgtgctggacggggcatgactagcgcttcctctgcaggctcatggagtatgttccgggctgtgagctcttcagctacctgcgcaaccgggggctcttctactctgcagagatcatctgtgccatcctgcactctaaggagatcatctacagggacttgaagccggagaacatcctgctggatagggacggacacatcaagctcacggactttgggttcgccaagaagctggtagacaggacttggaccctctgcggaatacccgagtacctggcccccgaagtcattcagagcgagggtcacggaagggctgtggactggtgggccctcagcatcctgatattcgagatgctctcgggatttcctccatttgtgtgtgtgtgtgtgtgtgtgtgtgtgtgtgtgtgtgtgtgtgacaacatgtttggcatttatcagaaaattcttgcagacaagatagatttccccagacatttggatttccatgtgaaagatctcattaagaaactgctcgtggttgacagaacaaggtggttaggaaatatgaagaacggggcgaatgatgtgaaacgccatcggtggttccgctctgtggactgggaagctgttcctcagagaaaactgaagcctcccatcgtgcccaagatagcccgcgaaggcgacacctccaacttcggaacttaccccgagaatgactgggacacagccgcgaccgtgccgcagaagggtttagaaatcttcaagaatttctgaggacaggagctcacatctggaagaagcaggaaggctggaatctgcctgcaacaaagagctgctcctgagcagaccagtagcaatgtcttcttcacgtgataaggacatttccacttttctgtctttgtgcctgtatgtatagaaacagatcagagcacagttgaaattaatgtaactggcattatttaagcaactggaattccacactgtaggaaggttttgaaaattgtttgcttgtagattttatcttatcctttagtgttgtgttcctactgtgatgtcttggtttttctcatagacttaagtttataagtttgaactggacttgttcaattataaccacaaattgtgtgtgtgtgtgtgtgtgtgtgcatgcgcgcgcctgtgtgtatatatagaagtcattatggcagatccacagaaattgtgcaatgatgtaaatgttcatacttcacagagcctataatttt

SEQ ID NO: 81608 - DNA, 1048 bp, Homo sapiens
gcctcccgaagtgctgggattacagttgtgagccaccacacccagccataaaatgaattttaaccgtggttcttacccattaatctgtgtaacctcatttgttaatgttagaggtaaacattccaaatctgttttttcatcttaaaaagtgatatttataaaaagtgaattgtaaaattgtttgaagaagactgtttttcctgtttataattcctatttttataattgcagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttacatttcacttgccagaggattttatttttgaaaccatcttgcatgctagaagttattacctggcctattcaggcttttgttaaaaggaaggtcatcatattcctcaaaaagtgccttctctgtaaagtgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaagtgaaaggtaattctccaaactccttttgtatgcagtgtgtaattatttacttaagtacagtaattcataattatcaaatctcaggactagtttaaattccagtaatttaagctgtatgttatcctatttgtaacttattacattttcaaaaaaaaaaaaaagaactggatttacctttaagaaacatgtcagctttttgtgcctacaatgaatttgtaaagcataaggaatg

SEQ ID NO: 81609 - DNA, 1050 bp, Homo sapiens
caaatattaatagtgccaaagttaagaaaccctgatagccattgaaaactgttagaggaaagctcaagtttctgctgcgttaaaattaaacctaattttatgctctcaaatctgtgtggaaagcatacatttcattgttacggtcttgaaataatgttcctgttacaattttccattttagaaattaagcagtcagcatcccctttaacttgagagacttagtgattaagtggaaacagttgctttctcttgtaataagcatatagcagttagaatttttaaattatttttcctattttaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattagtaagccatttgtttttctaaagatgtagatatttaaaataattttaagaacattcagcaatagtggttaattatatttgttttcctgtagatctgcatgttccaaaattcagataaattgttatctcacatggctgcacagtgccttgcattgcttctatatttccaattgagagaaaaggtaagataagtaatcaaagtatgttattatttctctttcttaattttttttaaatttaaatgtttt

SEQ ID NO: 81610 - DNA, 1633 bp, Homo sapiens
tgatgcactagtacatgcagggagtacttttttggtttaaacctgtggttattgtttatagcacttggtattttcagaaaagagaaaaataatcttaaaatgtctgggattttaaaaaattcattttaagtatgcagaactctattggaataccacctggaggtgctacctgtggccaaaccctatcactgtgccacgttaagtgtcaagcattctgtagacatttgtttgtttgactgaaggagctcatatggaattagcacaagttgctaccacctgtgaatctttcttgttgggagaaatagtttggccacttcatcttttaccaccaggccttttcttgatattgttaataaattaacaccatttcctattctgctcagctctcatgccgtcttccctgacacttccagctgcctccatggaagtggcggtggatagttggaagccagcaacaaccacaaggattcttcaggcttgaagctatgttgggtcatgtttacttcttatgggaagtaaggggtgctgaggacacacttggaagtgagatgtccagtgatgttcactcttgaaatgtagatgtagctcgtgaaaagtggtggcatattcatttgtggcaatgtgtgaggctcatcactggggacactgatttgcattttaaaataaactttattgtaggaaagctttggatttacagaacaattactgaggctgtgcagagttcctacatgctcgatactcagtttctcctactaacatcttatattaacatgtttgtcaccaccttgaggagagactacctatacaaattatttggaattctgaacaacagatgtgtttctccccctttatttatcgaatcagttatttgtatcaatgtgaactcttgatatccactttgtactttgtcatctggtactgttttaagtattgctgcagttattccctctttggctattgagggatctttcagttggctcctgtgtccctttgacctcccccaccgtggtgtctttctttgagcacctccttgctttctggcaccgtgtgatgttccagtcttagaatcggccatttgtataaggatcgctttgcatgtttcacagcttgctttgtaggagttgttctgatctcgtcggcctcatttatttagaaataataatagaattttaaaacaaattttatttccaagggcaagttggcaaactctttaccttccttgaagaggtttgtcaaggaaaagtagatgagaatagaggaaaagagagaagtggactataccaatttggattggttgaaaattctggtgtgcagccagcaggacatacaactgctgcgggccaggttgctaagtggcccgaccttttcttgtctgaaggtttaagtgatgctcacccaccgtcaggggatgaggtagtagttctcccaatatgtaattcctagagttttatgtggaagtcactttgtgtccttaactttgttggaattaacagagctggaatttaattgacacgaagaaagatcccttttcttttagttgtggagagagtttattcagaattcacatggggaacctggcaaggctgttgttaatgttttatctagttcggtgtatgcataaaggaataacaat

SEQ ID NO: 81611 - DNA, 1154 bp, Homo sapiens
ttgagcacctaatagatgccaggcccagggttgggccccaagatgcagaaatgagcaaatatgggactctccttctggtacttcgtcatttgctgggggatggagttatagccaacatttattgagggtttagtctatgccaaattcctcacaactcttttaggataataagtattatcagtttttacattaaaaattctaagctacggaagagtaagtaattcacccaaggtcattacttcataagcagtggagctgggattcaaaccgtttcttacctgtaattctgtattgcccctaagaaaacaaggcagttccaaaagagtgaatttaagggccatgtgtaataaggtcctcactgtctgctggggtgggtggacgagtgcaaggaagacttcctagataaagcgtggttggagtggaaatctggaaaggtgaggcaaggatggaggctggaaggatgggggtgtggaattactccaactcagggggcactgcgtgtgacgggttgaaggaaagaaggagcacttttggttttaggagatgaagaatgttcagtaagattggaatatatccaataatttattgtagggacattggtgaggtgtcaaaacctttgacagaggaatgggagaacagattcgtgctttagtaaattagctagttatagtatgtgaacatatcagaagggcgtaagccctaaggcaagaagagtagctgggatatgaggtgagagtgaagtaaatcaagaataactgagcttttggcctgaggatcaggaagaaaagaattgccgttaattgaaatgaagattagtaaaggagcaggagggaagctagccagatgcagtttaataaatgggacataggtgtctaataccagtcactcacccacctagaaattactcaaatatattgatgggtcagattttactaatgttaaattcatatacccgcctggtaaaaccaccgatcagtgatcacacagagctagccaaaatcagagtaagaggttgcttgtgaccatagtttggggagagcgatgtgaccacaggcagcctggtggggagcggccacgtgaagccacacttgctgctgcttctggagaaatccgttgagaaaatgagcgagtctgagtcgagtaaatgatactac

SEQ ID NO: 81612 - DNA, 1002 bp, Homo sapiens
atgcaggtcattgttgtgtgtgttaatctctgtttttccttagctcagtgtagcttcaaaatgtacatagaacctgaaagagacctgaaatggaaaccaaagatgcaagtgcagtgttttgtaacataattttaattttactgtcaaatagaacgagtataggatacaaataaggatggtggctgaagggtgggagaagtgaaaagaaggtattcttaaatttcacttgcagattaagagggaatgtctgccagcagttgactggccaggtatagattagaaatgacctctggcaagatgttttgtttcatttgaatgggagggcatcttgtagatttcacgcctgactttgaacttctggtaagcgatgcacctggaaccggcttgagtgacttaagggctcagcagtatctgcccggtggaaacattagtgtcatgctcatgccttaccagcagatggcagcaaaatgctgtgttaaaatgttcttaccctacttaaatttaagtcctgtggtaaacagatactgtatatttttctttcagttaagaccaaggtagatataatgcccttatttcccctaaatagatacaactaatactaccattgtgtactgacactttacagtaaatgtttttagaaatctacatgatatggcttacctaaaaacatcttattttgtataggttttgttagcaactccttcactgaaatactttccacagtattgttattttacatatagttttctgcctcagatttttctaagagaaccatttgtcataatatgttctagacctaaataacgtttattaaacaatacgtgagttttcactcacctgtggaggctgtgtgtgtgtatgtatgtgtaggtgtgtgtgtaaaacattaatgatttttttcttttattaacaagccaaaaattaaggtgacttttacaagagagcattttcatcctgggtagttaggtctgatcaattgatcttttacatggaattgctgac

SEQ ID NO: 81613 - DNA, 1048 bp, Homo sapiens
atcccggactctgttttctctccatgggtctcctcctgattttcataataacactgagacatgatttgcctttctctcattccttttatcatgagtgtcagttttttccagagacgaggtggtgtgattgatgtgacttatctcaacagattgaattcagaagcatatatgaaaattcagctatcatctattaaaccatacattaaaagctttgcaaaaatgtgaaagaatgacgttcttgttaaatttttttttggttttggaaaatatagttacttttcataatgatgtgttatttatgttaacatgtaatggtttattagaatgaatttaaaagtatttctaaaatgtctgttttaacttataatatggcatttactatagagatagcccacataaaagtttctgggggttcgcaataattttttaaagtgtaaaggagttttgaaaacaaaaagtttgagaatgactgaaaaatggcattcaacttgactttaagcatgttacttaatctctctgagactctataaaatggggatgatgatcaaagtacttccctcgtaaaaggatgaaaggagttaatacatgtcatgagctcttaacaatacatggcgcagagtaagtattcaatatatattagctttattatcatgtttaatatgaaagcaaaacttccttgactccaaacactactgaagcacagttgaagaattcttccttgtttttggagccatctgtattgtttttgtaaaacaaaatattccaaagggaaagaaataggattttgtgatttttcttttgaattgagatataacgggtttttattggcaagtgatcagggtgtggaagcttgaagcgatgtagattcagaataccttgaggcgctttttcacacccccttctgctgcactcctcaactgtcagccttacaaccaaggttctgctgtgttcagaatcacggaaaacaggtgagcagatctggaaagcttgtttggaaagctccacagagaccgtggtgggtgtccgggctccagtgtcctagacccag

SEQ ID NO: 81614 - DNA, 1004 bp, Homo sapiens
tgaaaaggatcaaataaggcatcgcatgaaggtcctaggacactttgagttggtatctttccggtcctttgcatgtcaagtccatagagagaacttccagggaaatgaacagttcttttcaaaagtgccttaaatattgtgctttgtggctttgtaacattttcttttttctgtctttttaggacagcccagaaacttgcaggacctgtgccgaattaaaattcgacaatgtataggccttcaaaacctaaagctacttgatgaactaccaattgccaaggtcatgaaagactacttaaaacacaaatttgatgatatctgatatgccagaactgtgagcaagattaggagttctattctagatacttaaaaggctttttgccttgcacaaagtatatcctatgcaatttctgatttgctgtgaaatcagaaagcaggtatacacttttgggttttctgtttgtttggttggttttcattgtaggggagggattttttatatatatataaaaacacacaccacatgcttgaaggtcttaatttggtttcttggtccaagtttaagaggtccaagctttgtatacaatactgcatttagaaaaattgtcttttcttaaatgacacaagcaggtttagagtggagaatttaccctttccaaatttatggttccttggtaagcacggtattctaaaccagcagagcacttgttaacgtttggaggcacagtttcacccagggcgaccctgggttcttttggaaaatgccctaagaaatgtttgaagtaacgctgtcacctcattcatttttaatgagtacaaactggccgtttcaaactgttctttttcctaattaatgtagctttcggatgacataaatccagtatctctgcttatgacataaatccagtacctctgcttttcttttgctgtgctcttgtttttaacttattttttttttaacaactgtagtacactaccctgagacactgcatctcgatttctat

SEQ ID NO: 81615 - DNA, 1050 bp, Homo sapiens
tatgtttgcttatgtagagcacagtcctaaaagtgggctgctttggaaacactgccccccaacactctggtgattcacattttcaccagcaataggtgggattctctgtctccacccctcagccagcaagcagtaggcatcctggagcctattaattttcatcagtgtgaggcaaaaataatttctgcttattttaatttccatgttatattagtaataatactggatatcttttcatatgttcatgaactatttgcattccctttatgtgaactgcctgttaatgtttgttgattattttttctaaaggattgtttgtctttttttctcactttggagggtttttttttttttgaacattagagatttttaagactttatcataaatgttgccaatatttttcccaatccattatttttctttttttgttatcttttgtgatagcaaaggtaaaataatacataattcaatatgttcatcttctcctttctggtatgtggttatacaagaaggccactttccctctaattttatttcagtattctcctggagttccttgtaatgttttcattcatttagtttttacattttaagctttaacctttctggtatttatttgtgtgtattgtatgagggaagtggcagagggtggaggtggctagcttttatctcttccagatagccagctactctagcacagtttttaaaatgaagttttctttctcatctgaattgagatgtcaccattggcattttccccagtacctatatctgtatacattttgggattctcagtactggttcactggcctattaatctgtttctggcaaatgtcatattgtttcgattataggcactgcatttaagttttacaatctgttaatgcaagttttctgttcattagtttttttcaaagatatcttgactggactattatcggacatttgttcttctattttgctcatttcccacagtgactctatttgtgtagcttttatgttctttaatgagatttttttcttttcttcctaaaactcctggacctgtc

SEQ ID NO: 81616 - DNA, 1136 bp, Homo sapiens
acatgaccagaggcaccgggcctccgtttgggcagccaggagtgatttcctagtgggaaaagtatacatttgcaaacagatgggaatacatttggatatgcatagatggaattactaaccacctttacctatgttctaggcaagttttgaagattgatattatattttatataatgtcatatagaaaatatatattggttatgatttatcattatatggtttctgtgctacttggaaggcacggcatgttattagatctgaagataatgtttggctgtggggtggcctggagtccaggggcctggggacgctgtgaatgagcacttttgtaggagcatcaggtgatgaagggaagacgcggcacatctcgtggcagaaagggcagcagcagtgagctgggggtttctgagagagggtcgtgggctggaggagagcagttgttaacaatacatgccttcctggcttccccagggctagagcagcccaaaggtctgaggcagctccccacacagcccctgggtaatgagcagttaggataatgattcatgggccttctttaaaattagatttggggatgggcctttctaccaagaggatgtgccttccagcaggaactcagcagcccggcttctcgaaggcgggtgtcagcgcactcaccatctgggccgcatcctcaggaggaggtgacatacgtgttccatcagctcagcgggagaggatggccctgtgcagccccagctggtttcccagggtccaccagcagctgctgggcagccttgactgctctgcctgcccagaagtcgggtctctgctgccaggccttccctgaagcatgcttggtttccacgtcacacctgatctggggccctggcttaatgccctgtggtgtcatctcaccgccttccccctgagctgagggctggtgcagtggcctttccctctgagtcgctgctgttgcagccaaccaccctgagtggctttgggaggtgagtttgtcacagaatggctccgttttgccccggtgccctgtcccttttcacccacacaagggccctgtccgcacgcggctccgctcgcccgcctttcctggcctcatggatctgcctttcttctgcctccacagcagtcagtttcaa

SEQ ID NO: 81617 - DNA, 1111 bp, Homo sapiens
aatgattgtcatatttgcctccttgccatgcacttgaaggatcacctagaggtctgggtgttcctgcagccacctccattcactactcagtgtgttcaccgagtcaaatgtacacactagtgagttgccagcaccacactccatctcgtaaggacaacacttaggttatgggaaccagcggctttcagaggcattctccctgctgttagggtctcgtttctcaagacccatcctccaggaaggtgacacacctgcctactgcactgaggggcgcctgctctgccaggccccaggtggcaaggtttcctcttgtgccctcatcacggaggaagccaagggccagccctccctgtgcctgcacagacgcccgccctggggaattaggctgcattactgccgtataacttgctgtaatctctgctgcaaaggagcttatgtgcttcagctggaggcggggtggtctgtcagctcaagcggctgcacagggctgctacctgccgcggtgggccccgctgtgcttgctaaacccttgaaagatggccccttctgtcctgcttgaaatgaaaatgcttgcaccaaatcttcttagtctaacttgttataaatgcaacgataatgtaaaggttacaatgcaatggatcaaattacagtaactcatttcgaatggcttccagtagaaagcagatgcttcagagttcggtttggttttctgcaggggtgtaggggtgagggagggggtgtagattttcaccggaaacgatcgcgtcaaacagattaggggctggcttgtcatcagtgcagttaaaccacttaatgtcttttgtcagatatttcttcatatgtttaatttaccattcatgatgtttcagtgatgagggtcttcatttcttactaatacaggcaaaaatgaaatgtcctttaaagaacattctagctacatttcctttaaaactgtaagagtagtcggttatgcctgaccgctttttaatgagaaaatataataagaaattgatcaaatcacttaatagcaaagtggttgggcaagctctggaaaatgcttaaatgaagctggcttatctgtaatgaatttctctccatcacaattaagtcg

SEQ ID NO: 81618 - DNA, 3661 bp, Homo sapiens
aagcagggtactccttcgctcaggttgtttgcctggagttcttctggctctcaggaggaagtttattcccacagatagaagccgcaggatctgctattcaggtcttcagccagggacgcatgactctgtgggtccctttcacaggcgtagtgggacgggggtggctttatctttcaggcatgctcctgtggtgcactgtgatctcaattttatatgttttcattatgggacaactttttcataattctgtttgcctgtgaaagtatattggccaactttggttattaacccttacttccttaagcagtttctatctgtgaattcttctaaccacattggactgctgttgatcgggccttatctagggccttttgtgtgctgtggtccattcagaaacatttctaatatttgcattttctttagcatgtgctggcactcaatcatacaatactaaatttgtgatctcttttttttcctgtaacagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtgtttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacccagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgttttttttttttacaattgttttaaagccatttcatgttccagttgtaagataaggaaatgtgataatagctgtttcatcattgtcttcaggagagctttccagagttgatcatttcctctcatggtactctgctcagcatggccacgtaggttttttgtttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacatacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgtactttt

SEQ ID NO: 81619 - DNA, 1034 bp, Homo sapiens
gctcttcctccgaggactcaagtggtggagctgggctgcgggaacccttgctccccgcccacagcgccactgtgctgtccccactcaccaggcctccactgtcccagcgccgctggagtctttaggcggtggtgggggtggttgggttttttaagtaagacatttcttcattaaatgctatacgttaacacggcgttgaatgtctttatgtcgaataagattctacaaaaagtcaggtgtagatgaaaaatatcctagaaggaggtgaatctgtaggtcatatttgacccacagatatactttggcttgtatttcttttttctctcttttccttttctctgtccctttccctttctctctcacttgaactggttgccagcacttcagttagacttgacacagaacagctggatttctagcttccctttaaacccggctgcactgggcctgtgtggcacgtcctggtccccccgagctccatcccttctggcttacatccaccttgtccctgtaagtttgtttttaattttatttttgatttagtttgtgctttggcagtcccctagactagagcttatatcacgttctcgtagagacatgttgggtcacgtgtgacgctggtgtgtggtccgtgttgactggagtggagagggtgctgagagagcacgggcgtggaggccagagggccatacctggtgctgggtgggccgggtttagaaacaccttgggagagaagcctggtggccgcttcgtggcaggcccgggctgggactctttcgcccgccacgctcgccggctcgatcttgtgttcgcgcttgtttcttctctgtacgtgacatttgggctttcactgcctggtacggcgcctttcacgggagcgttcagtaaatattgagtgccgtgtgtgcacaggacctcatctgtttaaagatggttctgcatgtattcatcctgcatcatgctgccacgtctgccacttcattttttttttgttaaggcgatgcctggtgcattcaactgattgccccagatca

SEQ ID NO: 81620 - DNA, 1487 bp, Homo sapiens
gccttcacatcagcatgggacaccagaaagtgcctgaataagagccagcaaagaaaaatgttttcatttcttctagtgtaatttatacttatggatctcatgagaattacattgtttagttagggtatgcttattttacatatatgtttttttttttttttttgagactgcttctcgctctgtcacccacgctggagtacagtgctgtgatcttggctcactctgtctcccaggttcaagtcattcttccgcctcagctggaattacaggcgccctccactacacctggctaatttttgtatttttagtagagacagggtttcaccacgttagccaagctgatctcgaactcctgacctcaagtgattcacctgcctcagcctcccaaagtgttgggattacaggcatgagccactgctcctggtcttgtatgtccatttttaatatttatatataatttatattaactaactggggtgtcgacactatgtatctggaatttgaatctatttgatagtctctcctgcaattacctcctccctggagacagggttttttttttttttttttgagacggagtcttgctgtcacccaagctggagtgcagtggcactatctcggctcactgcaagctccgcctcccaggttcacaccattctctcgcctcagcctcctgagtagctaggactacaggcacccgccaccacgcccggttaattttgtttttgtatttttagtagaaacagggtttcaccgtgttagctagtatggtttcgatctcctgacctcatgatctgcccgtctcagcctcccaaggtgctgggattagaggcatgggccaccacacccggccagcttttaaataaaaaatgtaataaaaagtttgtagctttcggttgacacatgacttatacctttaccattagcctttaaactttctcacatctgtgaaatttttgttgttcttatagcttataattttcatgtctctttttctttggttgaaatcctgacacaaatagtaggatagcttggttttatttagcagttaatgttgttaactatttcaggaaaataagatgatccaaaatatgattattgctcaggtgtgatatatgagtatgtaagtactgtatagtttgcaaagtataattagttttgtaatcttatatgtgaatatgttgcattagaaggaatatttttcaaatgtcagagtaggattatgagtgattcctcccgtttccagaattttataataagtatatattgttttataataataaagaaggtttaaaaatagttcatcgtaagtgatgtaaatgtttctacttgacggcattttaagagtcgcgtgggttatgggcgagcttatgaaatgcggtttgtaagactacttttcattcatgaatccctctatttcattgtagtcagtctgttataagacatatgttgtggaatctgttcaaaacctggggaggaagtgcatg

SEQ ID NO: 81621 - DNA, 1459 bp, Homo sapiens
agagggaggaggggtggctggaatgtgaggagacctaaggggtatgcagagcagttggggtgggtcgaattattcccagcaagcaacatgaccagggttccatattgaaagaccaccccgacaggttcagagcaaggtgaggctggggcagaggagacctaagagatttctgcaacagccaggtaagaaatgaagagaatcatagctgagaggcttgcttgcgggctgcagaagagtgggtacatcggagagactcgggagctgcatctggaagagtctggtccctgacccatctgggggtgcaggggctggcaggtgttcttagtcagtgcatctttcatggtacttaagaacagttcttgaacaattctcctaaccttgtttgtactgttagtttgccctgaattgtaaccccagaaaagacttttgtgacttttctggtccaaaccaggcaggagacaaactgggaccaaattagtcaggagacttgctcgaggacacagcctgtgagaagcaggccaggctccagcccgtgtcttcttcgcgttgtgtttacccgtcatgtgaaatgcagtaggactgcaaacctgaataattttgtcgatagatggcatttttgcgtaaaggcgtctcttattttttacgtggatactctttaaaatgaaaatcaaaaaagttattctggaagtaaactggctcatgaaatgacaacatatggtgacagcatttcgtcttattcaacctagaatgtcatcttagttcccggatgataagggatatttggaatgaggtatttattttatgttgtagaatattggataactgccacagtaccgggcatatagtgagtattcacaaaacattggttgcgtgaaacgaattgtgtgagtcactttttcttgtatcttattcagaacgatgcttcagagggcttttgtgactcacttgtctccagttgctgatgcagctgtaatgctgttagacacagggatcaaatgaacatacgctgctgttcgtggttttgggggttctattttggggagtgctatgtctgtttttagtttcttgaaactgccttttatgcacaaaaccgaagtagactgaatctataactgcagagccacacagaatctggtgcgtcgtgtttcctgtccagcattgccacttccaggtttttcatctaacttgaataaaacatgtttattttttacagaatttccacaaaattttatttttgaagttgcttttcagaaaatctgtttttaactggtaaaatacatgtcacatctaaatacacagttcagtcatttaagtatgtaagttgcgcaaccagtctccagaactgtttcatctgaaatgatgtgttttttgtttgttcgtttgtttgtttttgagacggagtctcaccctgccgcccaggctggagtgcagtagcacaatctcggctcactgcaacttc

SEQ ID NO: 81622 - DNA, 1049 bp, Homo sapiens
tctgagatcccactgcccctcctgcagaaatgccctccatcctcccctgcagcctctgctgtgtctgagatcccactgccccccctgcagaaatgccctccatcctcccctgcagcctctgctgtgtctgagatcccactgcccctcctgcagaaatgccctccatcctcccctgcagcctctgctgtgtctgagatcccactgccccccctgcagaaatgccctccatccttccctgcagcctctgctgtgtctgacatcccactgcccctcctgctgcttccaccctggcaagcttgataggaccagagcttgtcatcagcagcttctgaaattgctaaagctcatggaatgcagtctgtcccataatttagccccgattgaaagctgaagtgtgttgagggctgagggttgtcctccttagctgctgtagtgggcccttccctggctggcttgctgctggcctgagattccttctaaccccctcctggacacctactgggagaacatgaaggcagcctccagttctctttgaacacagttcaggaaaggtggaaggtaacagccttcctttccatctggttaggctgatctctctaagaaacactggctggaatgaaagaagggcagcccctaccagcccagggccaccagagctgccagggaacgcctgtctgtgtttcttccctgctgctggtacttgcaacctctgtcatcctgccatccagtgactcacagctgcagccctagctaagatttaactcctcttggagtcttcctgcctcctctcctcccaccccactgcccaaccgcctgctggaaaggcagccctgccgctccaccaatcagatgggtcagaccagccccagaaggatgggaaggagttaggctgggcgggctcattggcttcctccttgttcttaggcatctttctcatgtgagcctttctcttctgctcactcgtccccaccttgttctataggacgtttggtggttcctcctgccaggatgccttaacgttgatattcacggaaggctgagggtcgggg

SEQ ID NO: 81623 - DNA, 1023 bp, Homo sapiens
tcttactgcccagtctagagtgcaatggcacgatctcgactcactgcaccctccatctcccgggttcaagtgattctcctgcctcaccctcccgagtagctgggattacaggtgcacgccaccacgcccagctaatttttgtatttttagtagagatggggtttcgccatattggccaggctagtctcgaactcctgacctcagctgatccacccacctcggcctcctaaaatgctgggatttacaggtgtgagccactgtgcccggcctacattagttttttctgaaccatttggaagttgcagatataatgctctttttgcccttaaatcagtatgtatttcctaagaacaaggtcattcattgacataaacacaacgcagtaatcaaaatcagggaaattaacgttgatacagcacagttatgtaatctacagagtttagtcatattctgtcagttgtcccagtaatgtccttcatagcaaaataaagaacttgaggtgttccagagtgtagtctagggtcacatgcagcatttatatggtatgtctctttaagtgccctttaaccttgaccttgtctttgctgttcatgaccttgacgttgttgaaaagtacagatgagttattttgtagttatttgtccttcagtctgggtttatctgatgtttccccaggctacgtgatgtgtcctcagtgcctcacatcaggagcacatgatttcggtgtatgatccatacaggcagtgttaactttgatctcttgccacgattctcctctgtaaaaatcactacttttgcctttgttatttaataaataccttatagggaaatattttgaggccatgagatatcctattcctcctgtaagcatcatccactaatttttacttgagttaatgatgagttaatcatccacatgatttttacttgaattaatgatgtttgtcaaatgatgatattgttgagcagccgtatatgggggcttttggtaattcttagaagaattctgtttctccattctta

SEQ ID NO: 81624 - DNA, 1734 bp, Homo sapiens
tagtcactttcagtctgaaacaggtctccatccttttcttgatttttatgaccttgacacttctggagcttacagaccagtggaatgtttatcagtttgcatttattttctcatgattaggttcaagtgtgcagatactacagaagcgttgctgtgttctctttgtatcctaacagtttgtgattttggtttgctctgttattggtagtattaactttggtcatttaactaaggtagagtgattaggaaaacctggccaggtttctccactgtaaagttactctctgtctttttatatttagtgagtgtcattgtggagagactgtaaatatcctgttcctcatcaaactcccacccccaatagttttagcattaattgatgtttcttggcagaataaatgaatagtgtgatggttgctaaatggtgattttctaatccagttattctttctacttttattagttgaaagtaaggaaaagcttgttccttttcccatttacttatgtgtgtgcttgtatgagtatacactcttgtattcctattttatttaatgagttataatctcttaccattattatacatttccatgtttacatcaccttagacgtgtccagtggctgctgtttgttgcaggcttctgtatctcttttttttttttttttgagatggagccttgctctgtcacccaggctggagtgcagtggcacgatctcggttcactgcaacctccgcctcctgggttcaagcaattctcatgcctctacctcccgagtagttggtattacaggcgtccgccaccatacctggctaatttttgtatttttagtagagacggggtttcaccatgttggtcaggctggtctcgaactcctgacctcaaatgatccacccgccttgggttcccaaagtgctgggattccaggcatgaggcaccatgactggccttctgtatctttttgatatgcccctataactgtttgagcaatttctttctggcatactaagatgtttcaggctgttattttttccctgccctagccttgcagtctgccatctctcgaagagtctctggttctttttagtggaaaacatttagaagccaagatctagactgtgggtgtgctcgttgctgtgggtgttggctggcccactcctgagcagtgggctgaccaggggaaaatgtgcatgtgtgtgtgtgtccttgggttccccctgatactccaaatcccatttcaaccccaaagggttcttcctcttctctccctttctgtatttgtaattgctttatttgacagttgagaaatctagctgctcattggcctcagccacatttacttactgcatcagtttccgctgtaagtgagcaatcctctgttgcaatgcctccttcccggtgccttccctatgtgactcaactcaagggttggcggcctacctgacgccccaaggctgggccactgcaccagcccaccctcaccccatctggggaccctatcttgcttgaccccactagtggctttttacttcaggacaacgggtggggcaggggcaagaagcctaactccatcttgaaataagcttttcaattttagttactagattccaggtactacctgtgtcacatggcaacgcagccctcattctcagaggattttaaaaacctgttggtaaatttagcaagactgaatatttgcttggatagtatattctggaagatctattttctttgagtg

SEQ ID NO: 81625 - DNA, 1037 bp, Homo sapiens
cagctctgcatagtcttccccaaatccacaaccccagtttaatcggagaaaacttcagacaaaaccaaggggtgggattttccgcaagatacttgacccgtgttcttcaaaagtgtcaggtcaggaaaagcaaggaaagaccgggaaactgtcaggctagaggtgaccaaggaggtgggattactaaatgtactgtggggccctagattggaagagaaaaaggacattagtgggaaaactggtgaaatctgaataaagtctgcactctaggtaatagtgtatacatgtatcagtttcttagttttgctctgtgtagcatagtcaagtgggatgttaacatcagaagaagcggggtgaagctgtgggaactgtctctgccatctttacaattcttctttaaatccaaaattgtcttgaagtacaaagtggctagaaccaagagataattggacacaaaaatgatgtcgctgtctctgcctctgtatcctgatggcttctccatgccaaggggaaactaggcaaagcaatagaagactagatcctctgtgactctaagtggatattgtgcaggatgtgatttttagcttattgacttctaagaactctgagacagaaaggtctttgtgtgtgagggctgtagacttctaacccttacaaagagcttatcagttgagcaagcttataatgtgctgtgttattactgtaaaaaatttgtaatggtaccattacagcaaaatgtttccctggctaaaaagatctttcagcgttcactcagcaatttaacgctcgggcttgctgacatcatcttggttaaccctgtagtgcttggcttctgtgttttctctcattgaactctggcagggattttaaaaaaaaaaagtacaaagctattttcttggatgtctagcaattacttccacagccttttcttaagaaacaaacaaaaaaactccctgtgacagaaaaatactataggtgctagtttttctttcacatagttaacatgtctgtgccgtctcctggaacaggtacactgg

SEQ ID NO: 81626 - DNA, 1050 bp, Homo sapiens
cagggcagacaggatttttggaggtcttcactctgccattttcactgatgtcacctaaaagcatctgttatggggacttagctccacagcttaaattttgctttttataattagatgaattacgctgagtgtcgccttatactctgtttaagaagtcagggtattgtgctctaaaaattagaaagacttccaaccaattagttacaatattcacatacattcatttcaaaaataaattttggacatctgtagcaagacactgtgctagctggggacacaacagtgcagaaagccaagaccatggtctcatatgctggtggagcgaggtggggtgcagtgagagacagtgcagaggagtatgtgtggtaagtttaggacatagcacagtggccagcatgagtggagtgacgaggcagagtggggcgaagggtaaggccagatggcatcagagttgaggggaggcagggaatgctgaggacattggtttgggcacaaataggcctgacttgaatcatggtgcttcattcagctttgttcttcactagctgtgtggtcttgggcagcgagttacctgactcccctgaaccttaatttccttaaagatggggtgagggtaaaaattgtctacgttatagggtggttccaaggataaattgagttgatgcatgttacctattaccatagctcatgtttgggacaggtgagtgcttgcttgtgaaatgtgagggctaccggaaactatcctcaagtatctgaaaagcaaagcccttcagaactcattccctgagaccaccacatagattttgatctatgtaaacaaatacttgaatatgctttgtagtaacattgtagtcttggaatctcatgtttttgtttttacaatttagggaagactattttgacagaaccaatcatagtttacctaaaatggatgtgttagttgctttggatctgtgattattttgttggcaaaacaaaccttctccaggtacatgaacatctctgaaatggttccaccattgggtatatcagagtcctgtgattgtgaga

SEQ ID NO: 81627 - DNA, 1043 bp, Homo sapiens
accatcatctccgagaagccaaccttcttgccggaatcatagaggacagaccttctttcgggagagaatttttaaaagtatgtcttagttaggtcgtgctgttatatactgctggacagacaccaacagagccagtctcttgagtttgatcaagaacttgggtttagcgttagtgccaagaggtagttagaaagtgtcatcctggggctgcagggtgggaggccattttggagatgattttcctctgacgggaggtaatcacaaaaggtttctgatggcctgcgaaggggtgcatggaatgatcctgtctggacacttggagccccctctgaggcttggtgcatcctgtcagtggcctcatcagctgaagggacctggttggtgaggaggcctcctccccgtgtggtcccgtctccctgccttgggaggtgggtcagggacagcagcagcaaggctctccttgggagtgtggttattgggcctgctgctgctctgcgtttctttaaatgccctgtggtgtcagagctttgactgactgctgcaggcttctcctgggcttgtgccacagggccctcccacctgcagtgcccagagctctctttttctcttctgtgagctgccttgcctgttcgtagtcttggcccgtatttctgctgaaatgttgtcttacagttttgttgaagtgctttattctggatagagtatcttttctcagactgtgacttaacttttcaccttaattgtgggatttttattgtacgcaaattgtgaatctaagtgcaatctaatgcatcattcttttccattacggtttgtgcttttgtgtttaagaaattcttcccttccttaggtcacgaatatgttttctcctgtatgttttcttacatgtttgaagtgttccctttcacgtgtagttcttcattataatgttaagaattcatctattggaacacttgccatcttattagacctttgatttctatttttttatttttctttttataaagctttaagtgcttctaacctaagttgttattaggttt

SEQ ID NO: 81628 - DNA, 1035 bp, Homo sapiens
aggctaatttctgtattcttagtagagacgaggtttcaccatgctggccaggctggtctcgaactcttgaccttgtgatctgcctgcctcagcctcccaaaatgctgggattacaggcgtgagccacggcgcccggctcttccatacttttgtcctaatacttagttaataaataatggcatttggggcctaaagaaaagataatgggttgctgatggtcatggtgatattttcttgattatccagaaaatcatcttgtctgacttctgctgattccacagatgtaattgcaagaatgtaggatatctccctatttgtttttgcaaaggcctggctcttctcttctggtcataatgacctacacagattagaaacttaacgtgttttgaatttataaaaggaatcatggtataaaaaagccaatagcatttgacttcgcatttgttgtgtaccttgactgttcagatagttactttaatctgtgagtttataatatagttgttgctttcagaatagttgtcgtgcaacttctgagttaccgtgacacataaatgaaatttgccgaaggaagtccgcttgtagatgttttctctgtagcagttgtagagaagatggactggctttggactttcctgtgttgttgctgcaccctttgcctgcagattgcacaatctgataccagttaatggtgaaaaaaattattgaggttgtattgtctttaggttgataaactcctggcagttgtgaggagcagaggtaattgctagatcttttgcccaagaaaaagaatacactttctaatatgaactgttagcttttttctgaactaatgttctaaagcacgtacttgagtgaaagagcagtattcttgcctgtacttgtccacccctagacttgcttttaaatgtctgctaatcactcttactttttttgttgtttgaactttagggaagtggacattttcaagcatacagggagtggccatgtaatttttaattacaaagtcacaaagatacattttaaatcctaaatgtg

SEQ ID NO: 81629 - DNA, 1049 bp, Homo sapiens
tctgacataaatgggttaagtcctaaccagcaaaggcattccttagctaagctaatactggtccagctgaattacttaactgtgatttgactcagtgtaggaatagcgtttagaaacctagagtgatggaggattcacttggcactctcaagtttcagctgtcttatctgggcttgagcaagggttggacatcagttcattgaaaatgagctttttctggcaaggcctctgcaaacgttttgtcatttcaattaagtgagagttctttgctcccggtaacaaatgtgttgatggcaaagctgacgtttgcttatgaaaatgaaggaactggacttgttgatattgcagaagaggggacagcttgcttctttgggagcattcccttcaattatttgaaattattaatgcatcccctcctcctcctcaggatggtggtgaatcacgatttatgttcctgaactcgttcactttgtggagctcttcaagttaaaggaccctaattgaaaagattataatttcttaagattggagggtttacaaagacttgacattgagagatttccctcaaaccaaccaccagtcatttagaacagaaaaggacaacatgaggtttttccctgagttacctaaaaaggaacagataataattgggtggagttaccataaaactgtagggttgaggttagactgtttttaaaattaattggtttctcttcttgggcaaattacaccatttcagtcatagttgagacattaattgcgtctgtgctggttgtactgctggggcctctttcactgtgttcttcctggtggggtacacgggaagcagggccaaactataatgaagcttcatcctcagtctagtagggaagtttctcgtgctctaccgcgaaatgctcgtgaaatttgcagttaggcctctttcctgtaacattgtctgaagttgatagtaaaagaggatttcagtacatagcttgaggctcaggttttaagaagcattttccacattacctttgctccgtgtgctcctgagactgactagtccacgt

SEQ ID NO: 81630 - DNA, 1076 bp, Homo sapiens
cttgagctaagtaaaccatgtttatcttgaaacagttcagagcagtcctcactttcttagatagaattcaacttggcaaacatttatacagaaggcttttccatgtaaaatccaaataatcaacctgtaagtgaacttttggagcaccaagtcatttcagatcgtgaatttcctgtaggagactagggaaccatgtggctctgaaaatgagtgtagttttttatgtcaggttcaagatcttgaagcgctcaaacaatattccagggatttccagggatggctgtggctgtcaatagcggattgattccagggatagatgtggctgtcaatagcggattgtgcgtgactgtttccattgcaccggcagcttcacgttcccctgtctgttaactaagctgctctttattaacagtagattccaaatacagggccctagtctctgcagagttcattgtctcagaaggaaacgagcgatggtattggttgatgagggctgtcagggtgcgtgaactaatcactgtgggggagcagaagaaagaggcttacacccagtgggtgatggatcaagaaatgtctcacccacactcccaccctttttttacccactagctgagtcttggaagatgaagaggtgtttttgaggcagagacaactacaggtttcctacaacatgaaatggcaggagttagtgaaggagcgatgggaaaggccagctctttggggctaggtgtaggctgtgggtggtagagtggtgggcagggacatggagggaaggtctgcgtgccaggctttgtgtggttgctgtccagagctattggtgacatttcggcaggacagtagcctgatgggatgtgtgttttggaagatcagcccagcggtgttgctgctgcagagggtggctagagttggtcaagtaccggtacctagctagagctggacaggaccggtacctgttgagggacgcttgggtagcatttatcaagaagtctaaaatgcagctctcttgaggtctggcaattgctctagaattttttccaaaggaattttaaaggtgtgcttaaatgtgtacatatgaa

SEQ ID NO: 81631 - DNA, 1337 bp, Homo sapiens
cgtgaacagcccttatttgaatgtatgagttttagtaagcactgtgataggaggattcatatacttaaatcaggccctcttgagagagttttttggtgacccttttgcatgtgtttcggaggttgggacaaagaagctgaatgacttttttccccaccagacaatcagttcaaatggcaatcacaatataaaggtttttttttttttcacatagctaaaaggtttttttaaatgtcccttaggatctgtatctttgcagtgctttgcgtgtcactctcataattttattgtggatatacaatgttcccagattttcagatttttatcaatactgttgtgctgcttttctgtcctcccaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacctctaactattacttatttctctatttattattactcacccaaaataagtctggcaagtggcagacagctgccgtgattttgaaagttgacagactccttggggttcatccacaaaattgggtgcttggagtcgagttgccgaattactgggataaagaaacatcgtgcctcaaggttcctcataggctgaccaggtttctacgtgacctctcagttattcccttacgccatgactcatcttttacgctcttgtccagaggcactatcagcagttttggataaagagccaaacagtaaatattttagactttaca

SEQ ID NO: 81632 - DNA, 1804 bp, Homo sapiens
aggagcaggaggctgctcacatttcgtgtcttcacttggggtggacgttggctgcaaccctcaaatgctgggagtcgtcaaccaactgagccctgttgtccaatgtgccccgggcaaggatgtgggtgcaaatcctgcttccgggcgaccactgacttccttggcttcagtgtccaattagaaaaaaaaaagaaagtagaaattcggtaagaaatccgtgaacgaggtccgtcctccacccccgactcaagccaagagatagcacagaacgttcccacacgcgctgtcccggccccggcgagcgtagccgggatttctcccccgccacgcccctcggccacgcccccctgcgtttggcccagcgacggggcggggtcggcctgcgattggccgggaccacgaccgcgtccgggcgcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacgggtgagtcgttgcggggcagccgggcgcgcgccgccacttttgcgacgcgcagccatgatgggtgggtcgtccgccgctgcaccgggcgccggagcctgggaggcctgggaacggtcgggcgttggcgcttacgcggaccttgggcagcaggcccggaccttgcgcggaggcttctcgggagccgcacttccctgggcggctcggctgtcccttgtttgcgcaagtcttttttgcgaaccaagcccttcctgtggtagttactggggtcactcggccgttggcgtttgcctctgggacccgtcccacacagccccatacacactcctgactccccgcgctgtcacccctttctatgtggctctgaaaggcctttgccttcctgattcagattagttgctcttcattcttcaaaacccagttgctgtgccctccacactctaactgcccccgactccccagatggttgggaagtctcacttctcagtgatccctgaattgtcgcacttcttgagttcgtgttttaacgatctacttaggaggctttttcctcagcctagaccatgaaggctttgagggcaggagttacactttgtgtttgttgagtcttatggaaaggtcaactagtagtgtcatttttagttttttgaaaactgtttttcttttcagtgggctccctgctggccacctatggctggtacatcgtcttcagctgcatccttctctacgtggtctttcagaagctttccgcccggctaagagccttgaggcagaggcagctggaccgagctgcggctgctgtgggttagtgcctgataaccgaaatgaaagcggtggttttgcacctcctttatattaagagttagtctcttagtaaaagtaagaggggccacacaggaagaccctgtctctatttaaaaaaaaaaaaaatagccgggagtggcggcacgcacctgtagtcccagctgctcaggaggctgaggcgggataatcacttgagtccagggagtcaaagctgcagtgggctatgctcgggccacactacactccagcctgggcaattgattgagaccttgtctttaaaaaaaaaaaaaaaaaaaaagtaggaagtatatggttctcggtggggcgcggtggctcacacctgtaatcccagcactttgggaagccgaggcaggaggatgacttgaggtcaggggttcgagaacagcctggccaacatggtgaaaccctg

SEQ ID NO: 81633 - DNA, 1288 bp, Homo sapiens
ctgccataaattgttgaacaaatgtaacattttttggtagttgttggcatatttccctaatttagagacaataaagtcattgaactgttgccagtatatggcatgtagtaggtgcccagatgtttttgagtatttccggtttctttgcctacggtagtgccatgaaaagcacatgagtataggctttaccttcaccaaaaatgaattattatcaactacaatgggaggcaacaattttgaaatctttgtgacccttttcctttgaaattgagcatcccttccagtacctgccaaagacagactagaccgtccctggacgataagctcctcaaaggcaggtgctgcttttgatctttttgtacctacttcagtgtgtaacaaacagtggccacagaacaaacacttgcatgctaagggaatggattctctaaaattgatactacttttgctttggtggttttctttagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctaccaagttgtgtgtcatcatggtgcatttgcagtgaggtctaaggacacgttgaaattggaaatgcaggagggcagcgttttctcggtaggcttcctgggctggattagcgtctggctcctgcagtgtcatgacacatgccaggaaggccgccttttccactcccacatagcccttctgttagtgcagacttacctgtcgctccggcttctgataggacaactgaaatgattccatttttgaaattgattggtgtgtcccaccaaacctggctatgttttttgtttttttctcccccgcccccaggctggtctccaactctggcttcaagtgatcctcccgccttggcctcccaagggagtacaggcctgagccaccatacccagcctttagttttatatatgtacatagttaacataaaggtcatatggagagtctacaagaacatttgttgaaaggggcgtaagttactcatatttgaagaacactactgtttcattgccatctctctgatcccccttagccacgacagtcttaatcccatcttgttgcat

SEQ ID NO: 81634 - DNA, 1057 bp, Homo sapiens
aagataagatactacactggttgaattactttcaaaagcttttgaaagtaaaagagaagcaacttctgttggtctaggtctaacagttatgttcttccccctcttaagttttaatccaggtgctggtttgccaactgacaaaaagaaaggtgggccatctccaggggatgtagaagcaatcaaggtaatcatgtgttaggattcttggactggaatgagctaagatgggttcagaacacaaagctggataataaacatgttccgaacattgcagatttcattttcccacagttattagcatacagcaatatttctgtttaaggaaaaactagcataaagttattatttgatcagacttgaaattacacaagctaattaatgtggaggcagctttgtctttctcattttccaaggtgcatttatcacttcgaacagttacttaccttggtatgctgtctcagtgtttgccttaatttttactttcgaagatttgctgtctggcaaatccttttgactgatcagtagggaccctcgttttataatattgcctccttaaattattcagtaacataattgcaaatagttacttcacttagctacgattttagaacatgtggagtgattatttataagaaggcctgcatctcttcaccaattttagaaatttgtggtttggcttctagttttatttttgtgggccaataacattcttccccctacaccaaagtatttaatgttcctgatggagaagttgctgtgaatttctgtaggtgattgacacttagttttctgggtagctgatacttggttgaagttaatcatccatctccattgccctctgtcctccagaatgccatagcaaatgcttcaactctggctgaagtggagaggctgaaggggttgctgcagtctggtcagatccctggcagagaacgcagatcaggtgaacaaatggtgttctttgtatgttcaaattaatgttacactcagagtgtaactcacaaccatttagatgccatgactctggaatgccagagtagtgcctccttacatcaaa

SEQ ID NO: 81635 - DNA, 1029 bp, Homo sapiens
atactattccttgtccctgcaaattttatttaaagagattttcaggggcagctaggataaatgtaccttctttcaaaagacagtatacctttgttgttcttagacgctgaagctggcgctagcaggaaagcccacttacaccaagattctggcttgcagttcccagtgtgaataggttgctccagagtcccatcagctttgccattgttttcttttccaaatcatggctcagcagccactttgagattcctgtaggaaagcaatttcttatctcctgctattgagacagaagctgttaatgccaagattttaagaagctcccatgtattcatcggtagaaattatttaaacatttgtgatgtgctagtattgggcttgttgctagagagtaaaaattcagtaaataatgaaaagacaacttgcttcaaaagcactctccatttcagaatctcaaaatagcgtgtggtattcgcgttcttacctgtggctattgcttgacagggtgatctggaccctctggcatctctcaaatcgctgacttacctaaggtatgggaattacatattgtgacaaaatgaagccctttaaaataacattacttttaccagccttgaccttaatgtaatcagataattaaaaaatgtggcacatatgcaccatggaatactatgcagccataaaaaaggatgagttcatgtcctctgtagggacatggatgaagctggaaaccatcattctcagcaaactatcgcaaggacaaaaaaccaaacaccccatgttctcactcgtaggtgagaattgaacaatgagaacacttggacacaggaaggggaacatcacacaccggggcctgttgtggggtggggaaaggggggagggaaagcattaggagatatacctaatgtaaatgacaagttaatgggtgcagcccaccaacatggcacatgtatacatatgtaacaaacctgcaagttgtgcacatgtaccctagaacttaaaagtataatttaaaaaaaaagtgccttttac

SEQ ID NO: 81636 - DNA, 1051 bp, Homo sapiens
ctttattggaaaaaaagcacttggtgtatagataatgtctttaaaggtactgggtggtgagtgggatttccttcagatagaaatatttctcataggttaaccattcccctatagtatagttgttgtgtcttgtacctgagctgggaatccagaattatttgtatttctgtgctgcctgcacaaaaaatcatgaagtgagttaagtagtttgtgccacccaggagttgcaccttttctcaggttccactagatggtatgacagtggaattagccccaggcagtgtctaaaatcccacttctgttgctgaccctgtggcctcagaaaagggttctttttgctttgtttcctctttatcagggtgttggaagaaggatctctaagtgtctctctgtgatcctctgagcaaggaggtagataaaattgttagcttatttaattttcacttttactaagactctatttttattttagccgtataggtgagggacttgatcaggctctgccctgtctgacagaactcattctcaccaataatagtctcgtggaactggtaagttgcacagaaggaaaatgtatttggtgggtggggttaaaggtactatgtgcttcctacagaaaatttacaaaatctagaaaatgatctcagtatcctctttcttgtctttttcttaattcaggatctgggccttttgggttctgcagccgtatgttgcaaatattttcctacttttacttgacttttgacttaggatgtcttgttagagaagttcctaatttaggtgcagtccaatgaatcaatcttcttctttattgtagcccttttgatgtttaaatttcccctattccagggttataaactcctatgttgttttctacaattgcagtgttcaatatagtaccagtaactacaggtggctacttataattgagatgtgctagaactataaaatacacactggatttcaaagacttaagtgcaaaaaaaaaaaaaagtaaactatctcagtaatttttttatatcgatgttgaaatgataacgttttggataat

SEQ ID NO: 81637 - DNA, 1028 bp, Homo sapiens
ggggaggggagggagaactgtcgtgatatgttgaggctgttctgatgggttctaagaatctggcctgtggagatgcaagagtggagaactgtcgtccacaatgtttgaacgccgtttgggcactgagactaagcagctccaagtgtaaactcctgttgtgccgattccgcttaactagcccaaacgacttaggacagtgtgaggcaccttgtaaatgttcttataaatgttagctgcctatatcagccattgttattgtccttgtccttgttgtcatcagattctaagcttcatggcactggggacttgagactcgttcagcgttttctctctagtatcttaaacagcggcaagtcatgcgtgacccgacataggtgctaggtaatacttcctgaataaatcaaagcctggagtcagatactatgaaatacagctaatgctttaaggggcaactgtttagttatattaatacctcttgtgtttttttcctccattttatagggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatggtacgtgtctgtaggggaaagtaattttttcccctagagtaaatgttgcagtgtttcctgaagaagttgtagcacgtgctactggttaaacctacatgtttctttttctttttctttttcttttttatttatattttgaaaaaatattttttccataatggaagccacattcaatacatgttttttcttaaaatgagaaatgaacttcacttttcctatagagatccagagattaacctggcattagtctagtcttacttgtatctgttcagaaatcatgtatttttattttcatggttaagtttctaaataaaaacatgttgctttgtatacattttggcttctaaaacaattatcaaaggggtcatagtaaaaggat

SEQ ID NO: 81638 - DNA, 1834 bp, Homo sapiens
tagcccggagccaaggcccaggcccggggcgggcacctgaactgctggacccttcactgaaccccacgggttcccgcgacggctggtggagggaggacagtcaccgcttcccctcccacctcgaggtgcgctaatgcatgagaaagttcccctcgggtgtttccacattcgccttaacttttaaacaccaacgtctggaatcaggggtcctccagactccgaaacacaccctaggaaacaacccagaacgagacacatcccctgtgcgcgcgccacgacttccggcaagaacgcccccggaggcgtggctcttcgattgcttcggcctggcggtcgagctgcgcgcgcactcggcggctgcgattggtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccggggtgagtccgggggcgtgggcggccagtccccaggcggcaccgagccgccttattttccgcgctttgccgcgtgcaccgaaggccggagcttggcccgcgggccggttgtctgggctccgaccgggctgcgcagggaacgccgggcctgattcttgccgttgttgccagatgagcatccggttaagctcctgggagccttctgttagcgccgtgcctcttgacaggcacgggtgacttcattacttcctggtgcgtcctcgtggggccctgttaggccttgcttggctgtttcgccgctggctgtttgagggcccggaagagcggctcattaatggttgtaacgcaagtgcagggcgcgggattggttcttaatacttgccgccagatgatattttgagcgtagataggatatgtgttcattattcctaatgtgagggaggaaactaagtccccgaacaaccgcgattgtttcctccagtattttctacttagtagctttaattgtctggcgtttcccctatatgaagacgttttaaaaattgaactgtgtcacccaggcttgcaccgccgggtgctgtgtgtaagttgtggaagcgctcgcaattattcagattcctgtactatttcaaccttagcaagacttggtaagatactgggagggcagctagctagttggcatttcaggagacggctttaaaagggacgtgatagagcaacttctctgaggataagaccatgctgtcgtagcctgagatttgttcccatggggacctatggcctcggagcagcatcgctgcgggatctgcttagatttcttgccgacctttgggaaatcccactgttttgtgttgtgttgtgttgagatggagtctcgctctttccgccccagctggagcgcagtggcgtgatctcggctcactgcaaccgccgcctccccggttcaggtgattcctgtgtctcaagcctcccgagtagctgggaatacaggcatgcgccaccacgcccggctaattttttgtatttttagtaaagacatggtttctccatgttggtcaggctggtctcgaactcccgacctcaggtgatccgcccgccttggtctcccgaagtgctgggattacaggcttgagccactgcgcccggcccaactcaccacttttgatgatctctgccatttctctttatggagcatgtgcagtgttgagaatacgtattttgatgcagtacgtgtagtacagctctgaattgtgtcctttaactttgggtaagttctttttttagtagaccttgc

SEQ ID NO: 81639 - DNA, 2229 bp, Homo sapiens
tcaggtggttctcctgctttagcctcccgagtagcttggattacaggtgcccaccaccatgcccagctaatttttatattattagtagagacggggtttcaccatgttggttagactggtctcaagctcctgacctcaggtgatccacccacctcggcctcccaaagtgctgggattacaggcatgaggcaccgcgcccggccttgaaacaatcttcacaggcaccgaagactgacctttccctcttttgcctttcctgatgcggggccccagctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcacaggagcctgtatttctttccacggcacacaaaatgaaacatgagtgctgaccaagtgttaagtggacgttactttaactgtggtttcagatctgtttgatgtcattacgtggaaggtcttcttttgagctttagcaaatgttgatgtaaggaagcaatggaggaaatcccagatcccaaccccagaatgtcactgggcaaagagaccccttcagaccacgttagcctcactgggaggaggttctagagcctctccagatgtaggggccccttccatctgtcacgggggagctccccagagcccagactgcctcttcaccggttgctgccaagtgtgattgaattaggttacagcttgtcttctatgcagtggctgaaatccctgaacccatggctgatgcactccttgggatgtttaccatggcctctctgtgaagtcagaagcttgtacttgctaggaatcctttggctgcaagtaaaggaaacgcaccaactagaaatgacttaggtgaaaacaagagtgggtga

SEQ ID NO: 81640 - DNA, 1007 bp, Homo sapiens
ctgtaatttctcctccaggaaagactatgccatcggcttctctgtaacacaggatgtgtgcgctgggcgtgggtcagggtacatgggattggtggtcagagctgggggagagccctcctcggcagagctgcggagatgaaattgggagtcagatgtgggcggaaggtttgcagacctccagacatgaaaaggagctgctgaccaacgtcagttgggctcggaagggatgggtttgtctttgccgggcatttcacaggtggcaaccgcacccctgaacactagacaggcagtgttttcctcgtcctacagatggggaatcaaagctgagcaggggcaaaggccacaactagtcatgatggaggtgggactcggactcagagccgcaaggccaggtgtcttgctgtcccaggagggtgggggctggacaggagttgtaggcccaagaccccatgccatgttttcgtaattcgcctcgccctgggagacacaaaagcagggcttgggttaaattgacaggggatagttctcaaacacattaaagaagctaccgtttggcactcgtggtcttccaggtagcaggcctccccacggccctcctctctgggcccttactgctcaggatgggtcattgatccggcctgtcatggcactgccgttacccctgtggacaagacccagcaaatcttaaaagacgtataaagccatcaaataacaagacaccccctttttttttttttttcgagatggagtctcactgtctcccaggctggagtgcagtggcatgatctcagctcactgcaccctctgccccttgggttcaaggaattctcctaccacagcctcccgagtagctgggcttacaggcatgcgccatcacgcccggctaatttttttgtatttttagtagagatggggtttcaccatgttggtcaggctggtctgaaactcctgacctcaaatgatccatctgccttggcctcccaaagtgctgggattacaggtgtgag

SEQ ID NO: 81641 - DNA, 1011 bp, Homo sapiens
atggaggggctaaggatacaactggaaagtcactgagtggtgagccacagggctgcgggacatgcattacctgctggtcttgacactccccaggctgaagtggacgcagttcaagcactggtctgcattggggccatcacagcctttgtcaccacactccggatggcacacaccttaaagaaacaagcattgcctttcatccagagagacgccttctccatctactgcagtcccgcggatccctgtgtcaggatatcgcagcttggcagggttgggagacgctcccaggccccgctggggctggacggccagacgacaaggcgggagcagccgtccctgcgggtaacaggcacagctgagcctcgctgggctccagtgtcagtctgagcactctagacagggatggcatgagaaggagtgaaacatccagggtgggtacgccacccggagcagggaggagatgggacttgtgagagcctggaggggtagcggggagggagaggctggaacagctgtttcattcactcacttgcaccagtcatcatgctgggaccagccagcacctttgacttccacgtggaggacagagcaacacaagagggggtgctgagtgtcaggggagctgctggcaagctgatgagccaggaggaattaggtagcccccccgcaactcgctgtggtgggaatggggatggatctccgcatgctcaggaccgcctggtggggctgttgctggccaggtctagggtggggcagggacacagctagacagtgctgtcctagggttggggggctgctgttttctgtgctgagggctgagcccctttcagaacatcccctttaggctttccttggagcccttggtgggacggcagctgtgtcttccctcaagttcccaggggtccccagcttctcactccggaggctggtgtgttgttggaaaaacaactgagaactgcaggcgagctgagtagacgccagcaaacctcaccctctaggtccttcccaggt

SEQ ID NO: 81642 - DNA, 1040 bp, Homo sapiens
cagcaaggtggatttaatttaagaacgcttcatgggcgagaggaacctggatatttggcttttaaacacaattcaagtggacagccatactggggaggtttgtttacagatattcatctaggcatctccacccttggatgggcatcgtcttaacctgaccggtgggtgacctcagtgcagtgtgggggccctgcagctctgttgaatagcccccaaccttgcactgggctccttgcaaaattatgaataagctttccactgcagagagacccaggaacaggggtggggggtgtgaagtccatacacccggaccagcagctgggagcactgcttcaggaccctccccaaggctgtcctcctccgaggacatcctagaacattctgtctggagatggtgaggacatctgcactttccctgttcctagccaccctcctctcatccgctcagcaaatagtgattgagcacctgctctgtgcctaatgccaggaatctagcagtgaacacaccgaaccaagccctgcccgcccgtctcccattccgtgtctagaaagagtgaaaagattggtctgccgcctccctgtcgcactcctgccctcatcttcttaagatgaaggaaattgttcactttatcaagcaagacagacctgctgcctcctcagggagaagacgctgcaggaaaaggcaggagagaagtcctcaagtcaccacgacagccccgcgttcgctgggccagctgcgagggtgggaaggcgagagcccagtggctgagctggagttttgggctcaatgggtaatttaaagcaatggtgcgagaaatgaggattttggaggctgtcctcatagatgacccaggatgaggtgggcaaagaatccaatcagatgggaattgatccaaaatattatagtaaaccctctggagctggggggaggagtttagtaatgagttttagaaatggtgagtggcatctggaacccaggataccagcaccgcccaggaacagcatctagagtgtcctcgtggatacacacagctctgaaa

SEQ ID NO: 81643 - DNA, 1051 bp, Homo sapiens
aggatcgcttgagctcaggagtttgagaccagcctgagaaacatagtgaaactctatctctaccaaaaatacaaaaagtagccgggcgtggtggtgcacacctgtagtcctagccacttgggatgctgaggtgggaggatggcttgagcctgggaagttggggctgcagtgagccatgatcgtaccactgtactccagcctaggcaacagagtgagaccctgtctaaatacacacatacacacatacacacacacacacataaagtcaaacagagagtgtaataataatgaagtctctcttccattccagtccagcctcctcccatgaggctgcctgtctgctgggtccctgggaattcttcctgctctctttttccacacagtgcacaccactgaccctgagtgtggagcagcccctcttgtttgtcccaccaaaactatatctgaaaataaaaatccagttttggtgaccaggccttttgtgggtgtttttggagacatcctctataattgaaataaacttcaactcaaatgatagcctctagagcccttggtccctgtcctaccatcatcacaaccccagccaatctcagtgcaccacttggtggttaaagtgctcggattcctttgtggtcggaatgtggctgtaactggaccctaaggagctgaggagagtcagaggttcctcaccaggcttgttttctgcacctgcagtggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcgctgtcaccacacacgt

SEQ ID NO: 81644 - DNA, 1042 bp, Homo sapiens
agtgaaaaaagcatttaagtactagaaaggggagataggccaggtgcagtggctcatgcctgtaatcccagcactttgggaggcacgcggatcacaaggtcaagagaccaagaccatcctggcaaacattctgaaaccccatctctactaaaaatacaaaaattagccgggcatggtggcgggcgcctgtagtcccagctactcaggaggctgaggcaggagaatggcgtgaacccaggaggcggagcttgcagtgagctgagatggtgccactgcactccagccgggcaacagagcgagacaccatctaaaaaaaaaaaaagagagagagagataaatgtctcccagattaccattgtctaaacctaaccttaggtcaagtgtcacaaatcgcacctattagaaaaggaaaggtctcttttggaggcacatgcaggaaggggttgctttggtcccactgcttcttccctgctggcgtttttggagctcccagctctcagctccgcaggttgttagctcagtcagtgcctggcccctcataggctgtcatgagtatcttgcagatcgagagaaagaacaaaaatacaaaccatgtgtgagcaaaacaccatttcattccactggcccttgttacaaatgcagctaagatctgcttctatgcatcttagacgtctcatcccttgttcctagcaaatatctttggtaaatttacaagtttataaattgcttttaattttatcaaatcagaaatttgtcttgctcttaattatatgaaaaggatgctccgtttctcatataatgagagaaatgcgacgttaacctttctgagttatcggattggcaatgtaagccatagctgcaggctgcaagggagcccgttccttttgacgtgtgacatgtgacgtgtgacgagttttacgtctagtaatgtagcctacaggtacacatgcacacagctgaaatgacgtgtgcagtaggtttcccttaatggacagctcctgcgtgccagtctctattctaagtgctttaccatcatgaagtc

SEQ ID NO: 81645 - DNA, 1038 bp, Homo sapiens
ctatactgtgttatagccttaaaatgtagagtgcttacagatcactaagaaatatttaaataatatcactaaataggccaaaatcctgaaaagcaattcgtaaagaaaacatacaaataaccagtaaacacaagatagtcaacatttgtagtatccaaataaaatataaactaaaggccaggtgcgttgtctcacgcctataatcccagcactttgagaggccaaggcaggtggatcacgaggtcaggagttggagaccagtctggccaacgtggtgaaaccctatctctataaaaatacaaaaattagccgggcatggtggcgtgcacctgtagtctcagctactcgggaggctgaggcaggagaattgcttgaaccagggaggtggaggttgcagtgagccgagattgtgccactgcactccagcctgggcaacagagactccgtctcagaaaaaataaaaataaaaaaaataaacgaaaacacaagaaggcaaaatcatgatagaaagccaacaagcagcagttgcagagatggtagaacaaatgtgtgaaacgaatctgtatggcactctgcactcggggccacagagtgatgtgatttaaagaacgggaatgcaggggcagaggagcctgggtcccacgctggctgcaccggtgacgggctgggagacctgggactgatgactccctcatcagcgtcttaccagcacctggtggacatgaaatttctcacgcagcctgtgtaggttgtcacagaagcccaggctcctctcccctctccctacctgccactgcaagtgtgtgttttaccacagcctttaggaattggtccatttgctctctgggaaaattccagcctggagaagctggtagagacctgcctccatgcctctgaggaaaatcaaattggctgcgacctctacagaacccaggaatttggaattcactgaatccagggttgctgcgctggaggcaaagctgggctgctattgggttggctggccctaagggaaaactcttctgacttttgaactca

SEQ ID NO: 81646 - DNA, 1051 bp, Homo sapiens
ccttggaaatccaagatctgccatcccaggtccgcaacccggagaagcaaggtcagtggctcttgggaatctcatgacagcttttgtatctcaagcctctttttacctctgggccttatttaactacggagtctctgataattctttgttttgtgttttagaggtagaattcccataacagaaaattcaccattttaattatttttaagtggacagttcagtggcttttagtacatccacgatgtcatgtaaacgtcagcactatctaattccagaatgttttcatccccacaaaaagaaaccccatacccatgaagcagccactccccattccctcctcccctcccagctcctggcaacctctaatccacttaccatttctttggatttgcctctcctggacatttcatatagatgaaataatacaacacctggccttttgtgtctggcttctttcacttagcatgatgttttcaaagtttttcaatattgtcgtatgcatcaaaacgtcattactcgtatggctaaacgatattccattgtacggattgatcacattttgtttattcattcacctgtgatggacatttgggttgtttctaccttttagctgttacaaatagtacagctatgaggattcatgtacaagtttttatgtggacctatgtttttgtttctcgtgggcgtatacctaagattggaattgtcaggtcatatggtaactctatgttgaacgttttgaggaacagccaaactgtcttccacattggctgcacccttttacattccggccagcaatatatgagaggtccagctccttcacattctcgttaacacttaatattctctgctttttaaaaaattataagcgttctagtaggtgtgaagtggtatctgtggttcttcaattgcctgatgatgcaccttgatgcacaaaagttttaaattatgatgaaattcaatttattttttcttctgttgcttgtgctcttggtgtcatacctgagaaaccattgcctaacccaaagtcacagagatttactcctgtgtt

SEQ ID NO: 81647 - DNA, 1034 bp, Homo sapiens
taaagcttgggagaaggcaatgaaggaagtcagcatctctagatcaatttatggtgcatgcaaagcgtgttttcaaatacttacagagtctccgagggaattacatcactgtttataactgttttgattgttttttatgactcagggcccagtagagccaagcagtgtaactcctgagaggctctgagcagaacgcctcatgcctcccgggaggagagtccaggcataatgggaaaagcgctccccgtaataagccaagcaccggtcgtgtggtggggagttattaatgtgctgctgggcggcggtgggtctgcactgaagaatgccatgtttcttcagctgcagatcactggggtgggtcgggggctgagttcaaagaggcatgaaccctaatggcctggaattggcaggatggtccagcctggacacagaaacagccttggggtacagattttggatctgcttggtctggggagtctgcttggtctggggagtgtgtcagaaaattctagcaggaaggagtcttgaatgattgaggctttgtttttaccctcagactccatcccatatggtaaagctgccctgagtttgtaaagggaaccatcgtccatttccatgacagggcaggaaagtgaggggaccctgctttctgcaggagatttgggagcacacaagcttggcaccctcgatcagcatgagagggcagcctccgaactccgagctgtgtccttgactgtgggtccacgcgagcttccattcgaggcagcgaggcctggaggcggaggcagtgaggcctggaggcagaggcgtgggctctggggccccaaatcccagctcctccccgcattagctacaccttgggtacagtccttaatttccctctggattaaatgggttaatccttggaaattctcaggccagtgccttatgctcagtgcacagtcagcttgggaaatgtttgctgattgctgttatttagcattgtgacttctattttcaatgctagtcttcggaacaaagtagtgggatttttt

SEQ ID NO: 81648 - DNA, 1054 bp, Homo sapiens
ttcactcccgttagcgggtctgtgaaagggtttcctggatgaccttctgctgtaatgggcctcagttctttagcctctcctccccaagccaggtgccagcacagcagctggcaggatgctgctggctcctgattctggagggtctctcaacatggccctagaacattcatgggcccagtgaggaacaaagcaagtgcgttgtgcaaggatccaggttggtccaggaagccaacctggggagagggcttcaaggagggagtgagaaatactgacatggagtagcttcccaggtagaacaggaaaagtggagagcttgaggcggagggtttcagcctgtggcccgtcttcctgcttcccctggcactcggttacttgaaaatatttatttttgctattagatagtattatgcattggaaaaaaaaataggaggaggccaacatatctgtggtctggagttcctagggagtcagcagggtggctactgttggtgggccttcgcctcctcaggagaagggagcgggtggagagcatttgggatgaatggagaacatctgaagtaccagagtaattaacgttgaaatgtggctgcgtggcacgtggcatttgctgtcattagagatcttttccaagtctggccgtctccctggcttcaacaacgcacggtctccaggcaggttttgcgggatcatttaactccgtggactcccttagcgtcctcggaagatggctttatgtacatagaccacagtttcagaagttaatagcagaagacacttttcagttactttggggactttaagatctttctaaatcagttttcatcattaaagtacaatgtaggtgtattcacgtgacagtgataatctctgcacattgtttaacttgaaagataaattacttggcagtcgacttgcattttcagcgttaccttagaaataactgtagggtggagaaccacttctgtttttttcattgactgttctactttctgtcttggagttaattttttaaagtgatgacttttgatagatggcttccttattttcttcctgg

SEQ ID NO: 81649 - DNA, 1099 bp, Homo sapiens
tttagctggtacttgtggctggaatgattctcagtgtggtcagaaatcatccatcctgtgggtatgggatagagcggagctgcaggaatctgccctgactggctgctgtctttcaaagacttgctttcatgtgtacgttcttaacaatgaacaccggtgcacagctgggcatggcggcacacttctataggcacagctactctgaaggctaaggcaggaggatcacctgagcccgggagttccagaccagcctgggtaacgtagcaagacccctgtctcaaaaaaaaaaaaacaaaaaacaaaaaaacggaaagaaaacctacacacaaatgaggccctggccttggctagtgatataaatcagaccaccctgatacttacccactgcagagaccacagggagctctgacaggacacccacaagctgctaccagcttcctggacgtaaccctttccacctattctgtcttcacgcagagttcatggtcctatccctctttgcaaatttagctctctctgcaagaagggtacctcttcaagtatgttttccagaaaaatcattcttttccccaccagaccagctctttcaacccagaaaaattaaagttgtaaattcttccatcatctgtaatctcagtgtcatttgcagcactgctagctctctttgatcctaggccattgcgatggaaatgacaggcatggctctggaatagagcagcttgtgttgggacccttgattttcctgtgaagaacagaggagtctttctggccccttcccctcgtatgatcctgtgattctgcaattttaaggctgctgctacaggcaaaggcacaccattaaaatccaaacagagcccccaaaaccatgctctcagcagcatccagatggtctgaatgcaaccttcttatccctttgaaggaacatttgggagatgggactctaggttcggggggagacccaccctacgaggttctgctgcggggctaagccttgttcctcttgtccctccagggccggcagggcctgggctccattttcgtctgggcatctgggaatggcgggagagagggggactactgctcgtgcgatggctacacc

SEQ ID NO: 81650 - DNA, 1084 bp, Homo sapiens
tacccacctgtccctccgagtttagtactcacccagacactaaatgtgagaaggaaaattaaggaagaggggcggtgtagacacacacacgcacgcacacagcatggggtcttgcgggcatccttgggacactggacagcttcctttatctccattcccccaagaaaacaccgaggcagcttcaatgaggctgctgagcacctaagccaggcccaaggctgggctgagtgagtgctggcacactcgggtatgaccaagtcagctgctgcccaccaagaactgccgaatacataaatcacccttccattacttagctcccagctccaacccactagatcgcttggatctcagtcttgatgacaagcgagacatcctaaaaattaagctgaatttaagcttcggagagggtgggtaagctggagggcgggtttcctgcatagaacatattgctttggatggtgttcctgctgagcgtctgtcatttctacgggatgatttccaaagatggagctcctaggatgaggcaccctccgtccaggaggggtcctggttgtttggcagtgatcgttcgggctctctggttcactgagcctatgggaggcttggggaggttggagctgcagagagggatctttgcattcggaattctgagcagtgttggtttcatccagctgtcaggggagtggggaagttgcagaggggaccacgtggtttcccctcattcttgtcacagttttgtgaaatactgaggtcatttgattttttttcgtcatttggaagtaaaatatgtcatacagagaaccttaaatcgcaactgtctcgatctgtcactgaaaatcctcctagaaatttgatgatctcaaaccaaaccacattcccccatctgcttttcctccttgtggccctatttgtcgcctacagtcttctgtaaaatctgactttatctttggtagatgatgtggcccggcggtgagagactgtagaagctgtaacttggcacaaagatctgtttaacgttggtccttaggaagcctggctcctctcacacctagttattcagaagggaccattagacattgctgtg

SEQ ID NO: 81651 - DNA, 1050 bp, Homo sapiens
actcgggaggctgaggcaggagaatcacttgaacccgggaggtggagcttgcagtgagccgagattgcaccactgccctccagcctgggtgacagagtgagactctgtctcaaaataataataataaataataataataataataataggtcttgttttttaaaataaaaaacagaaatatgcatttttagataccagcaggacatcatagcactgagggaagctgaaccctctctttgggacgtagcttgctttcttttgttgccctggcctgagttctttcacatcagccagcatggagaagaggagccagttttgcagaatgactgggaacagcccctgctggggagggactctgtgatgcggtgtcctcatccgagcctcctgggcccgggttcccgtcgctgtgtgcccggagcctgggcgccgacaccgagcctcctctgtgctttcaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaaggtgtgagtaaccagggctacaggggagcgctctgggacaagggtgacagtaaacattttaacaagtatcagagtgacactggccacagccctgaaacaagacagggaagactctgctgtgacaggtgccagggccagtgtggaggagtcactcggggagtctgagaagtggctcttgaccggcgagagcagaagtgtttttgcctcgttccagaacagctgttccagtgacagccaggtggccactgctagcacgaccctctctgccttggagtttgcccatccctggctgaagggggtacacaggtgggtgacgggggtctaaggcagctcacctggcctgttacttggactctgcaggggcctcggcccacctgcccttagaaacacccagctgtggaactctgtgcattcatcgcgggg

SEQ ID NO: 81652 - DNA, 1027 bp, Homo sapiens
acgcccacgtggctgacactgccgaatgtctctagcactgttgttgaacttctgatgtctcctatgcctcaaccttgctattgccttggtgtaaatttctctgacattgattttgaatacaattccaggcttttggagcagaagtttccagttaagcttggtgtcccacctaagtgttaaggtcaacatgccgagccctagagtggtcctccctctcccaccaccaactatcctacctggcctcccaagaactgcctttggtgactcttgtattctctgtcttgcttcatgcctgggaaatttcagggcatatattaaggggaaaaccttagggaaacctgaaccttcaaaactgggtagaatgaatggatggaatggaagaatttactgcagcgaaatcatcttcaaattccttttaggttggaagcttcttaccctggcaagtgaagaagtacatttggttatatgtttataatccatgtgctactgggtgaaagatgataggacaagaacatttgaaatgtatgtgttagggatctctgcccagcagtttccatcaaaagagcacacccatgattatcgtacaaatggatgggacagcaggattctactcacgtaaaatgtttgtccctgagcacctagggagggtgtcacctccagggtctccttcctgttgctcttctgcatgagtcctgcaccacctcttttaacctcagggaaaacttcactattttgttttttaaagtcagtcatatttaaagttgctgcttttgagtatgcactacgtgttgatgtagattctggaatgtagaacaaacaggcgcagactagtatgggtaaggtggggaacccctacttcagaaggtgaaccccagaaggaagctgcctgggccaggggtgtgtgcatgatggcagggagctgcagccactaagccttggaagagtctttaatggcacagggaaatgccctgtataaagctcagtgggggaaaaaaaggatttagaaagaaagtatatgccagaggca

SEQ ID NO: 81653 - DNA, 1110 bp, Homo sapiens
ccctgaatgtagtgcagactcctcgagagcacggccctggcgcccatccttatcccacccatgtcaggccccagagccaggctgaaccccagctttgagcattattcaatcaggtggagctgccgtggtaagaccaaagaaaacattcccactcagggtccaagaagtctttaccccaagatccttttaaaatgaaaaagtttttccagcttgaaaagaatgtgtacacgggatgataagagcaggagtgctccaggcactggtctgagggctttatatgtgttgtttcttatattaaccctgtggcaacccatgactgtccccactgtgtgggtggacaccaccctgaggccatggatgtccactgtcagctccaagtcacacagctggtgagcacggggctgggttttattgcaggtggcctggtgccttgatccttggtcttaaatatcagtgatacagccttgtgaacttttttccttgatcgtgaaaacaaatcatgctgattgaaagacatttatgacatcctgaaagtaattgtaaaattttaaattagcaataatgtcaccacccaggaactgatgctactactattttgctgtattcctttctagatttttctctgtgcatgttttggtaccatattgctggtggctgccaaatattccaatatatggcttaccatatttacttatgtccttactgtaaagcaaattccaataccagttaaccaaacactttcttcattcactgctttcccatgtgtgtatttcctttttcttcaggacaaggatcaccagataatttatcggcaatttcacaaggctggcttccttccttctctccctctctccctcccttccttcttgtctttctgtctctctctctctctgtctttttttttttttgacagggtcttgctgtgttgcccagactggagtgcagtggcaccaatcatggctcactgcagccttgacttcccaggctcaagcaatcctttcacctcagtctcctgaggagctgggactacaggcatgcgccatcatgcccagctagatttttttttttttttttttggagaggtggggtttcaccatgttgcccaggctg

SEQ ID NO: 81654 - DNA, 1022 bp, Homo sapiens
aagtgggagggatttcatgctctctttggtgacactggctcatgagtgaaagtttcaaaacaccctcccctgtcgcttgtcacacctgggaatgatatgtcagcaagcttctggcccacctgtggcccacagggaagaagacagggccaaggctgcccatggctgctcgctgaaaggatgcttggacaaggatcacaactcggtggcatggacagcctgcagcatggcaagccatttactggaacgcgggcagggccccctcctgggtctctgcttgtttatgttaccctttaggaacatccttagattttacctcgtcttatcaacagagggacagtcaacggatgcctcattttaacttggcttctcgagaaggaagctggaggaagcacacactacaaaagaaagtgttgctgcgcacctgtcttgagaagacgatgaagccttcttcatgattagaactccctgccccagagcgtagcttatctataactgtgctgcatgtttagcaggaaacatacatttggaaaatagagaaaaggataaaaaggtcagagtgaagttctatcttcaaagtatgacgttaaagaaatcctggcactttctacagatttgcagagaaagacggtttctgtttgggctagaagtggcatttggcaaaccttgcctttgccccaaatcacttatagttgattttccacaagaaaagtcaacagatgtcatctagcagtcatttagacctaatcacattttctttctttctttctttctttctttttttttttgagacagagtctcactctgtcacccaggctggagtgcaatggtgcaatctctgctcactgcaacctgtgagggttgcttccattcgatgggagggctggagttttagtcgcttggtttggggctggtgacacacctctgacctccacagagtgtccaggtggctcctggtttcaccccgagggggcattgaaggcagagctttgcatcccagctggggatgggagggggaggcactt

SEQ ID NO: 81655 - DNA, 1039 bp, Homo sapiens
attttaggtgtgttaaaagtcctatattcagtttgggtctgagggcaaagcattcccaggcattagttgtctcctcgaagtcagcagaaggaaggatagagacttcctaggcaaaggctaacgtagcagttaaattttttcaaataaaaatctccttctcacagagcttcttaataagctcctggcaaggcttctatcaatgcatcctgccagtaaagaagaaaggaagaaaggtaaacagcctgggcatcccaggccttcctggaacgttcctaggattggctgattgtttctcatagttctaattaaattgttagccccagggaaagcacacagacatctgaaccgattatgaattcagaatcgcaactgaaatacctctgtttaaatttgtctagctttaatgcaaaccaaatcaattagctgtcagtctgactaatatttactccacccagtcattacaattaaacacttggtgaaattagctgttttatggaagtatttagtgttatcttttattgcagtgcatcagaacgtttccctacgttggcaaagcatttttatgataccttcacatctggagagttgtgtaattaatattattaacaaaaggaaaagatgatttaatattattcagagacttcggaatgcgaggctgccattgtgttcaaatgaccaaactggaaatgaatgttatggggcttaggataaagttccatcaaatgcagacggtatcttattttaattagttccagtccctattgtataggagtgctttgataagtgatggaatgtacagtccaccccatgtcacataaaagcagatagaatgtacatttgggaaagcaaaacaaaactcaagggggtgtcagcagcaggactctgttaagcacgtgtgtgcacgcacacttattaggcatcttcttcgcactgatcctgtaccggaatggtacagtcattttccttgcattcttaattacctttacttgatgtttttcttaccgtctttgaaaagggccattttgctcagattgctttg

SEQ ID NO: 81656 - DNA, 1084 bp, Homo sapiens
gagaactgtgggaaaaccaaggacctacctggtatgtttcagagtcatttgtttatgaaccttacataaacacacacacctggatatgtatatacacgtgtatatgcacagatacacacacacgcctgaatacatatgcagttggctgtctttatccacgggttccacatctacacattcaaccaacctcaggtcaaaaacatgaaaaaaaaatgtatggtggatgtagaaactattttcttgtcatttttccttaaacaatatggtataacaactatttccacagcatttacattgtattaggtattataagtagtctaaagatgatttaaagtattggaggatgtgtgtaggttgtatgcaaatatgatgccattttatatcagggacttgagcatctgtggattttggcatctgcagggtggcctggaaccagccccccacggatgccaaggcatgactgtatacatatatatacatctgtatacaaacacttgcacatccatatacatatgcacacacacacaccggcatacgtatatacacgtgtatacaacactcacacattctatacatccacacatatgcacacacactcgtatacagacataatggaataatatgtacctgaaacataatataggcctcccatgatttccttattgaaatgaaggaaagtgcacacatgctgagggtactggttctctgggaaagaacctgccgcaaaggacaaggaccaaggtgcctgaaattccccatggtaactaacaatcttaaccatgccgagaggcagaaggttcaacggtgaagaatcctgactgttcattgactaaatgaatcttgaacagtttcactgctctgtgcctcagtttccccatcagtcagatgaggatggtcataacatctactccctacagttgttatgaaaatgaagcttattaattcatctgaactccaagcttgctgcctggaatggggcatgtgcccagcaagcgtcagctgttgtaatgagccaggggcactcggtaatagtgaggatccctggctgggggacaggtgaaggagggggaattgctgttcccca

SEQ ID NO: 81657 - DNA, 1330 bp, Homo sapiens
gcatctgatcaggcttgccctctttttcatcttggagcctctccccaggtcctgcgagtcaagtacactgagtagcctctgtccccttgcttaggtgatcactctggtatgcccgccgctggcccctactacccaggatcccgcagttcccgtggagagtgggaacctggtgctgtgggagcatcccttgtcaccggcgggatagagcggacagcctccatggacttctttaggaggacgctgaccctcccccaggcattttcctaaccccttggtgaggagaccagctccaggcctccccagggagtataggccaggtggcttaacagggtgtcacgcagtagatccctccagcctcccatttccctgcattcccagcagaccagcagcagctacatttgggaccttgttagaaatgaaaatccttggaccccaccacagcctgctcgatcacagactccgggagagggcccaacaatctggctttaataaaccgtctggggctggagaaccacagctctgcaggatgtcccggaggtccagcatactgacctcatcagcgattggtttttattaattctagacttggattagccaatcttgtagactatacacacccctcgatgttcaaggttcacattaaatgaccaaattgtgagggaaccaccttgtccacacgtgtgggtacatatgacctacttgcatttcgtcccgcttggagcccacctcccaggctcctgcccccacacagtggacatctccttctgacgcagttcctgtgccttggggtctgccttgttttatgggcccaggtggcgcaggatgtgggtgagtctgtggagaaagggcaccagcttgcaaggcagcagccccaggagcagcctgggaaggctttgtgcagaggaggcctgtttcctcctacgtgttgggagagttgtctctgcagatggtgggtgagagttcgctgccaaaaccactgtcttccctgccctgcggacacttcttcctcaccttcctaaaactgtaagagacctggagccgttgagcatcaatgactctttgactcaggaatcttaaaaaatcacaccctggggctaccatgggggccttctggttctccttgtgtattactagttgaatgtttatagctttcaatttctttttccccttctatatgctctctaaggacataggaagaatctacctgacctcacagctttggtaggcactgttattgccacaccctcttctcccagtgggcaccccacaccccaactccccggcacgttgttcagtgggactgccagtatcatgtataatcatgaatgct

SEQ ID NO: 81658 - DNA, 1064 bp, Homo sapiens
ttagatttgtttcagaggcttagacaactttatgtatcatgactttgataatctaagaccctcacaaccattcattcattcattcattcattatttatttatttatttacttatttatttgagacatgagtctcactctgtcactcagggtggagtgcaatggtgcgatctcagcttaccgcaacctctgcctcccaggttcaaggaattctgcctcagcctctctattagctaggattacaggcgcacgccaccacctccagctaatttttatatttttaatagagatggggtttcaccatgttggccaggctggtcttgaactcctgacctcaggtgatccacccacctcggcctacaaccattcattttagcacaagatgcaaaagcctgtctgtgggaatagatgctttctcttccccatggagttctgtgaactcattagtactttctaggatttttgtttgcttgcctgctttttcaaggaatttgctattctaccttgttctgatatttggtcaaatcagaaaacgttagaaaaccaaattgattctttcttacactaaataatcttaaaatccaaatgaaggctaggcatggtggcttatgcttgtaatcccaacactttgggaggccgaggtgggaggatcctctgagcccagaagttcgaggctgtagtgagctatgatcatgccactgtactccagcctggatgacagagtgagacactgtctctacaaaaaataaaaaaattagccagtcatggtggcatgtgcctatagtcccagctactcaggaggctgaggccagaggattgcttgagcctgggaggtcagggctatgcagtgagctatgatcatgccactgcactccagcctgggtgacagagcgagactctgtctctagaaaagaaaagaaaacaaaacaaaaaccaatccaaatgaaacctcagaggtaggtatggacacattagctctgggagactgtcaatacaaggctcacattgagggaccagaactaacagacccacactatcacaagccaggtcttaacagccttccttt

SEQ ID NO: 81659 - DNA, 1987 bp, Homo sapiens
ttcactaacagtgggacgtcttgggaatcttcccatgctcgtacatagagacctacctcattctttttaaatagttttatggcattttagagatgcaacatgttttgttataccacacctgtgaatgttcctttgatttgcctccagtttttttctgttataagcagtgttgcagtggttatccttattcatgactctgcacttgtgagaatttctgtaggatccataagaacaaaacaaatactagttataataataaatggtgattgctggcccttactgtgtaccaagtaacttttcatgtgctttccttgtattgactcatttaatcttagaaactctatggggtaggtgttattattaccctcattttacagatgtggaaacaaaagcacagagaggttaagtaactttttcccagttacacaacttgtaggtgccagagccaagatttgaacccgaatagtctgactccagagaggggacctgctgagtcaatgtatgtgtgcaagttacattgtgttagatgttggccatggctctcccaacagatagtgccagttgacactgcccccagaagtgtgtgtgggccccaccgattttgtgtagtgatgaccaattgtcatatttgccagttcttataggtgacaaatgagatctggtggttgttttaatatgcttcttttccctcattgttattcaagttaaatgttgcttggccagcacagtggctcacacttgtagtcccagcactttgggaggctgaggctggaggatcatttcagcccaggagttcgagaccagcctgggcaagatggcaagttcctgactctacaaaaaaaaaaaaaaaaaaattagccaagtgtggtggtgtacgcctgtggtcccagctactggggaggatgaggtgggagaattccttgagcccaggaggttgaggagtcagtgagccaagaccacatcaccgcactccagcctggacgacagagcgagaccctgtctcaaaataaatgagtaaataaagttaagtgtctctttatttattaggcattttaatccttctctgaattgcttatttatattctttgcccattttttcagtggggctgtttgtcttttaatgattgctttctctgtgttgtagatattcatcccttgtttttaagtacgttgcttttcattgaacactgttcagagtgtttgttggctttgcctgttgttgtttgaagtaaaatctgcagcaccatttgtttgccaggctttgggctcgtcactcagtgtaattcagagatgagtaagacaaagtccccacctaaaatagacagcacgtaactcttgcgagaggagtagtgaacggaatataggggcggagtccaaatgttttaggataagtgaggagaatggggcagcctctcaactggggattcagggaagcctttgtgaccagtggcgctagggccagacctggaggggtccatagaatgttcacagaggaatgggaagtgggggtgtgtttgggcagatggatcgtgagtgctttaatctgcatcccatccgaaaacaactcaccttcaatgacccactggaaaagagtctcatgaagaggctacttacagggtgtgcatggggacaagggaaccaacagagggtgttgaggtacccggggactgggtaggcagtggtggggagctgctgcagggatggaggcaaaacagtgttagcagatcctgtgggagctggagctgagtagggtgcagcctccttctggtgcctccattggcctgggcagtattgcctggagggcttagtcttctgcagcactgagcagggcagagaatggtggagagtgggtcagaggtgtcaggggaggtggagggagaaaaatcagctcagtaaggataaaagcagagatagaagttccagatgtgtgaaggcctcagcaatcctcgatgccattagagggtaggggggttcatttgctgctggt

SEQ ID NO: 81660 - DNA, 1325 bp, Homo sapiens
ccgccaactgcatgccggctgggaacgtcctgagcttttttggatctctgagcctctacacagattgtggcatctagaaagtagttcctctgatcttctgcagctcagccaggctgccgacacctctcctcctcctttcaccctgccctgggagggcttccgggttgtacttgccctgggtggctggcctcctcctggctcctgggactgggtcttggccttgccaccgaccagaagccctggtcttgctcccaccagctgatgtttctcctgactattgctccgaaggccctcaccagccctgcagggaggtgtcaccaggcctggttaatggtgatgaggccttagacccaggtaccttctgacaaaccagtgactgacaggccagggccggaccccacaccctctgactcaccttctactgctgtcacctcgtacctgcttcccagacaaaggtaaatcatcagacagaaaagcctttcggcttctgccagaatgaacagacaagaggcatagcaacctccggagaccccaccagccgccgtttctccctctgtccaccgggtgcgtgcacatgcgtgtgcgtgaacgcgcacagactcaaagggctgcacaccagcatggctctgtctcggggaatctgtactggctcctgctcatcagcattggaaccactcacacctctctctattggagggaaaaagaaaagccctccagtccttctaggaagccactcaaactacacatttgagtcactcacatttcagtcactcaagctgcacatttatcagctggactaatcatcttttgctgaaacctcctcctcgtgtgggtccctgtctacaagaagagacccctgtctaccttagtggcagagctggaggcctagaggtcaccatcgcctcctcctgctcccgtgctcccccaagcctgtctcactgtctcctgaatggctctcaggctccctgcattgcccctgccaccgcccagcacaggctgtggcctctgtggcctctacctgcctcagggcctcctcctgccccaccccaccgcctcgagccctggctgtagctgcagctctgcccatcccccatcttcatgcttttgcttcctttcaggctttgcttctgttgttcttcctgcccagaacggctttacctgtcaccaggttcgcccctcagccttcccacccgtcaccaggttcgcccctcagccttcccacccgtcaccaggttcgcccctcagccttcccacccgtcaccagattcgcccctcagccttccaagttctgctgcactgtcagttccatcagccgactcaccccg

SEQ ID NO: 81661 - DNA, 1108 bp, Homo sapiens
gttaatcggggtctccccagctctgtctagtgcagccagcatgaatgccacgcagcccggtcactcaggcatggtgctggcagtggcactgcggtgacattcactaacagagattagctggttggggataggagctgtctcagaggcttgtgtgtgattactcacggagggcctattactctttattccaaaacgagcttttctttcccccctctaagtgcactgctaatgtggaaaaggcctggagcatttgagcctctacccactcaataagaactctttgaaaaccttatttgcctttttttcagccaggagaatttgtgactcataaataagatgtagatattattagctttgacttacagatgagtaaatgggggtgaagtaagggaaggaagctgtttgtgttcacatggtacgcatatgtcacctctgacagttccatccctgctcatttgcttctgccgtattctctgttctgaggtctcctttgtgaaactctttctccaagcccttaatgggcaattagtgttatgttctgtacttgcctgaatcgcagccctggttttctcccagatagtcgctgtgctcaaggttcttgcttgttttactttcttccatacaactaataactggattcagtttatttcacatggcccagaggtaatttagactggtggttattcacctttcttgtgtcatggctccctttcagcacctgataaaggctgtggatcctctccattgtaaaatatgcatcaccagggacaagacaagacagcctctctttgtccctctactcatcagtccaggtaacaccacaggatttcaaagggaataaaaatgtggaagtgtccaatgtcattatcggcagatgacataactacatggataatccaaaagagcctggagattaacccctggagctaataagggagttgatcagcaacagccacctgcatggcagcacatctgagaagacgaaagaaaccattcttcattcttgcataaaagctgttagatacgttgaaataggtcttttaaaaaggtgagacttttatagagaaacataaaatatttagaagaaggactgagaaaagaaagttta

SEQ ID NO: 81662 - DNA, 1015 bp, Homo sapiens
tcgcgccgcgtccctggcgctggctgctgctgctggcgctgcctgccgcctgctccgcccccgccgcgccccgtctacaccaaccactgggcggtgcaagtgctgggcggcccggccgaggcggaccgcgtggcggcggcgcacgggtacctcaacttgggccaggtgagtgcggccggccccgcgcgcccaaaactttcccggcggcctccggcgcgcgcgaggggggcgcctccgcagtcctgtccgcccggccccggccccgcgcgcgcgtgggaaggctccgggaccgcttggggacggcgggcggccggggcgccctgcgggggggggtgtcgcccgggggggcgcgcgcgggacactcggcggggtgggggggactggggtcccgcgtgggcgcccacgcaggtccggcgcgccgaccgcaagtcccccggcagtgccgcccaaccccgcgctcggaagtgtggcctcagaagccggggcggcgcggacacctgccgggctccgggggagtctgggctgcctcaggcgtcgcgcgccgtccgccgctgggtcctgggcgcccacccggctctcccccgcgggggagcggcccctctgccctcgacgggcggcgcgagctccggacccggtgcgcgcgccaaggcggccgcggccgctgcttgggtgacatgagcgtggcccggcgtctcggggactcgcgctccctcggtgtccgcggctcccgggggtagatggccgggagcctgcaccctggagcccggccgccgtcggagaggccttgggacagcgcagggccgggggtcctgggtttaaaacctctccaggagcggagggagggcgctttgtgtgggggcttctgccgcggttctgatggccgagcggtgtgacctttggcaagtcgctcccctgacaagctcctttgcagtcagtggcaatgtctacaccgctgggttgtcggaaagatctaatgctgcgttgccacagagcctggaccggggcctgaccctca

SEQ ID NO: 81663 - DNA, 1028 bp, Homo sapiens
tacatgtagttatctctagtagtttctctttgtttttataaaaattccctttagtatacgaagtcactttccatttttgaatatttattgtattttagattatgtgaattaagggtagatacacagccattttcagtagatagtcttcgtatttataccttttgacgtttctgcctcctctctttttccaatcccacgctcatttgtcaccttatttctattatttttccacttcatccatcaaaataaccttcagtccgtgcttctttcccttcagcaaatttcctctactgctaaaaccctgttcctgatgttggaatattaaaggctccctcaggactgtggaaatggaaggattacagcgggactgatggagacttgaaatctagatctggttttgctactgggatcttgaacaaattatttatcctctttggaccttggtcctcatctttaaagcggtggggttggtctgacgacctaaagtcatttctgctttgtgattctaagtgtccaccttccagccacatagtcacgggatcaaaaagagtattttgtagaattgttccttaatacagtgagtaaagtaggaccagttttaaacaagcattagtgtgttttgctaggtggaggctctgactataatttcatcactttaaagtgacattacttcagtgaattgaaactggcagagatattttactgattcttatttggatgtaaaaaacagcagtgcacttgaattttaaactcagattactttttagagaaagcacaagagttcttaactcttgcaggcttttgaaagcccttcttttcaggaatacttgcaattttgatcctttcagttggtaaaaatacattgcacactcattaggttggttggaaataagttgcagcttactgaagatgttattaaagtagagaactgttttgaactttggtagcgtaaaactgtaaatattatattagcaaatgtggcttatcgaagtaccagtgtgaaataatgacattttaaagttgatgcc

SEQ ID NO: 81664 - DNA, 1050 bp, Homo sapiens
tcatttgcgccctagtgccaggtggagtcagtgtgagcctgtaagagctccccgctctcatttgcaccctagtgccaggtggggtcagtgtgagcctgtaagagctccccgctctcatttgcgccctagtgccaggtggggtcactgtgagcctgtaagagctccccgctctcatttgcgccctagtgccaggtgcagtcagtgtgagtctgtaagagctcccccctctcatctgcaccccaggaccacaagagctgttctctcaggtggacaatagagagatgggatcagaagtcattgcttccctcaagaaacttaactatcagaggatgaaccaaatgctcattagatgatatttaatattagtgaagaaaaacttgataaaaacatgtcatgggactgctgacttaatgtttggtaaattgctgatttaaaatacatttctttacctttcttttctgcagtggttggagaaaaggaaaagatagataatgctgtaaacgtgcgaacaagagacaacaaaattcatggagagattttagtaacttctgccattgataaactgaagaatctcaggaagacacggacactcaatgctgaggaggccttttgaagtccttccctgatatttgcttctgtgtaactttgttttgacccttaaaaatgtatttttcttaacatgttagtacttctacgactttggagccactgatgggtccactcatggcctcagctgagaaaggagacgatgaacgtgtagctgacatgcacgaagtttaatttactcatgtccacgggggacgtttagagggcacgtgggaaattttccagcaatcaatgccttgagaaacttaaatggggaaatattattcatcgagaaagtgaaacaaaacactaggaaatgattatgaaatgttagtgattttcaaaagatgggcttcaaataaaagtctgcagagttttttttaaataggagggaaaatcttattttctaatatgtctcaggtatttttatgacttctactaaaattcacactgaaactttatctt

SEQ ID NO: 81665 - DNA, 1051 bp, Homo sapiens
aggccaaggcaggcggatcactagaggtcaggagtttgagaccagcctggccaacatagtgaaaccctgtctctactaaaaatacaaaaattagcacatagtaaaaatacaaaaatacaatacaggcatggtggtacatgcctgtaattccagctacacgggaggctgaggcagaatcgcttgaaccagggagacggacgttgcagtgagccaagatggtggcactgcaccctagcctgggtgagggagtgagactctgtctcaaaaacaacaacaacaaccacaaattaatggcatttgaaatgcccagtagccacgtggcttgtggcctccatgctgcacggtgtcgctcaaggctgtgagctctttgtatccctcgtgtctcagcacctagaacatcagtagatgacctttcaatgtttcttgaagaaaagtagagttgttttcttcatttcaacattgtgtgtaataatgtgtaaatatgtttttcttcgtagtacaataaatttaaatgccgcattctgaatgagaaagttaacactgcaactaccaccgtgtacaggtttgtgtccacacatggtaaacgctgctcagtggtaaacttgaaggtgttagcagtagaggccgagtttgttttctggttggagatcgatttttcaagttgtgtagttgataatctaccgtagttacaatcttcaaaatgttttcactaaagagaaatgattattttcccctttttagtaatcaggacagtactgagacccatattttgtttcctgggtgttagctataacaggatttttctccatgtgagtgatactgttgggaaaggagtttctattctgtccttccacgttcttattaatgtggcagtgggggccattacaagccatctcctcggcagtgattctctgcctcatacttactgtccagagtgcaagtgtagaagagtctgccccattgtccagagtccaagtgtacagtcttcatgcattagcaggatactcatgatgagaccaaaagaaaatactgggaaacaaaggcaggatca

SEQ ID NO: 81666 - DNA, 1059 bp, Homo sapiens
taaagttctgtttgagtctctgctttacttcttttgggaatatacttagaaggggaatttctggatcctatggcaattctgtttttaagttttcgagaactcgccataccgtttggtgcagtggctacaccattttacagtcccaccagtgatgcacagggggttcagtttttccacatccttgccaacacttgttttgttttttttttaatcatggacatcctaatggttgtgaagtggtatctcattggggttttgttttgacttgcatttctctgatgacgtactaatggtgagcatcttaatgtgcttattggccatttgtgtattttcttgaagaaatgtctttggagaaatgtctgttgagctcttttgcccattttttaattaggtttttttgtatttgagttataagagttcttgatatattctggatatccatttcttaacagatatgtgatttgcaaatatttaattctgtgggttgccttttttgcagctacttttaagaactaaacacaattaatctttgttaaggaaaatgatttgttgtgaatatatagatacgaaacagttaaatcatgcagatacgggtttttctcccaacaactagcttctttaagtagttatttaatataaagtgccttgtataccccgatagtagtgatggaagcagaaaagaaaggaaaaggaaaaaaacccttagttttataaatatatcatcattacgataaactttgcttttgtttttatacaaattaataatatagctgtgtccttgtcagaattttattgattaatgttaaaattagatcttctagaacagtactgtccaatagaaacataatggaatccactagtctgagctacatgtgtaacctataattttatggcagctacattttaaaagtaaaagttgcaattaattttaacaaatttttaacccaatatataaaaagtataatttcaatggtagccagtataaagaatgattaacgaatgattttcttcttctttttgcaacattatacttccaaagtccagtgtgttttatactca

SEQ ID NO: 81667 - DNA, 1050 bp, Homo sapiens
ttttttaaacagtgaatgtggctgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgcgcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaacagtgaatgtatattacttttctacataaaataaatattgcaaaacaagaaatatctgtcctattagtttatgtttgtactttttatacacttcaaaaaaaaaaaaccctagaaattcttttaatattttaaggaatcattgtaacagtgataaagttaactcccaagtggcttttgtcttcttagtcaggaactggctgaaagcacggtaatagccaaagtcaatggtgaactgtgggacctggaccgcccattggaaggggactcttctctagagctgcttacatttgataatgaggaagctcaagctgtgagtatttaaaaaccagacagccaaactttgggtagttatgttgtaaactacattatataagaggccacatattgaagtcacgaatgttgagttttttgggggtttctaagatttaaaatttgattattgatgtttaataaatatttgtggcatgaatgtatacaaatacatgtcagtttttaaagtagcccatatttataatttcttttttttttttttttttttttttttgagatggagtcttactctgtcacccagactggagtgcagtggcgcaatcacggctcactgcagcctcaacctcccctggctcaggtgatcctcccacctcagcctcccagctacctgggactacaggtgcacaccaccacactcagataatttttcatattttttgtagagacagggttttgctatgttgc

SEQ ID NO: 81668 - DNA, 1049 bp, Homo sapiens
aggcaagtctgaggagccgagggagatcacagtaaaaactgtcaaagatattaggaccacaaaaaggtaaatctaccacaaaaactaattggaccaatgagtggataaggccaatgatagaggaagtggctaaaaagtatagacacattcttgggctcatgatggtcaggtagtggagaggtttacatatggccatgtatctgtcaaaggccatggctatgagcagcaccatctcagtgcccccaagagcatggctaaagaagatctgagtaatacatccccgaaaggagatggccttgtgcttcttgaaaatatcacaaatcatcttaggggctgtaattgagcaaaatgccatatcaatgattgagaggttagccaggaggaaatacatgggggagtgcagatgagcatccatggttacagtgaatacaatgacaaggtttcccatcatgctcgcaaagtagaacaacaaagagaaaacaaaaagtagaagctgaatctcccgtgagttggtgagtcccatgaatacaaattctgataccacagagtgattcattccattcattgcctcagactccaagatcagttttcatgttacttacctgaaggaagaaagaaaatgagaaagaattacctaggcaagtattcatgttcaagaaagaaagcctccagccatgaaaataactatcatattaacatcttacacagccaaataaccctcatcacatgcaccctggacttccacttagaggggtcagctggctgctatttggcattatggttttcaaaactactactactaaattaattccatccttagacctagctctcctctgcttttgtgttacatgaatatttcctatttgatccttcccaggatgttctatttgggtgagatataaggtcatctttaaatacttttcactatgatttcttatcaatggatatgatttcagccagtcacatgagccacctaacaattactcatgcacagcatacagctttcaaagtctctattctattatttatattgcttgattagactttag

SEQ ID NO: 81669 - DNA, 1128 bp, Homo sapiens
gttgcagtgagctgagatcgccccactgcactccagcctgggtgactgcgagattccatctcaaaaaaaaaaaaaaaagatattatagtaatacctactttttttttttttttttttttttgagtgcagtggcacgatcttggctcactgcaatctctgcctcctgggttcaagcgattctcctgcctcagcctcccaagtagctgggattaaaggcgcccgccaccacgcctggctaattttgtatttttagtagagatggggtttcaccatgttggccaggatggtctcgaactcctgacctcaggtgatccgcccgccttggcctcccacatattaagtaatacctacttttgacagccatgagtagcatctttttttaaatgtggtcacttcttttttctcattgccagagtcgtgtcccaaatgcgaacatcctcgtgcttacttcatgcagcttcagacccgctctgcagatgagccgatgaccaccttctacaagtgctgcaatgctcagtgtggacaccgctggagggattagggccaggatggcccagctgccctagtgtgtgcttgccttgtccctcggggtagatgcttagctggcagtatgagttgtgtgtcctgagggtctttgctagtgtggtggaaagataaaccttttgaggtgaagagccagggggtcaggaaatatggcctatctgccaggcagggtggatgaagtcatgaatgtctgggagtttttctgtgtggggaggagacagagacccataactaaatatgctctgtgtaaagtcctattctttcatcttccactttattggcagttgacattcccttactcccaatcaacactcttaaatatttgtactgtttgtaaaacttagtacatgtccctaaatatttaactgttacttgtaaacttgtgtaatttattatttattttaatcaaaattctgaatatttcatttaaatgaaagttggaatattgccttctcagtgttttaaatagcttaagaggtagaaagcaaaccccaaatcacagtgatcccagaatagactacatacttacatttgaacaggctacgaaaatgttaatcaccgggatttcaatttctttctttattc

SEQ ID NO: 81670 - DNA, 1030 bp, Homo sapiens
cgcgcccccagcccccgcccgcacacacctggatcggcagatcgcagagcagcgggtcctgcaccaccatagccagaccctcctggaacacgtccatggcctcggagtgcggcagcgcctcttcttcgtcctcatcttcctcttgcgcctcgggcccacccgcggcctccgtctcctccagggccgcccctctcagccgggctctgcccgcactgccagcccgcactagggaggccaagcgcgcacgcgcaggaactgcggcccgccccagcgaggccgcccagccactggcgcgccggggggggtggggcggctgcagtgaccaatgacaagtgcgagacagcctgcagcagggccgggagcgcagaatcgccctgtctattggttggttggtgtggcgggaaggctgccaggaccaatgtgagctcgaggcgggcggcgcatcggcgctgagcggcagtgggagctgccgggagttggagcctgcggagttcgagaccatgctgctgttctgccccggctgcgggaacgggctgatcgtggaggagggacaacgctgccaccgcttctcctgcaacacgtgcccctacgtgcacaacatcacccgcaaggtgggacccgaaggccggcgctgggcgcgggcgactctcgcaggccttccgcgtcctccgactgctgctccatcgccgccagccccggcgtctgcctctgtccgctctttctcgcgcccctttctggtctgcagcagatctgtgggctctactttccaatacactcagaaagccccaccgtttcccaccgccttgggttcctgctcccacgctcgcgcccttctctgcgttcacagcggcggccacggtgatttccttaaagctgaggcacgcaggtccgtgctgtgcgcagaaaccttcggctcttctccagctcacgcagacgaaaagccggagttctcccagggcctaccaggttccgacactgactccctcccctgcgtgcgtctccgatttcaagtcctaatgcccttcctgtt

SEQ ID NO: 81671 - DNA, 1072 bp, Homo sapiens
gaggaaatcagagtgggcatggaggcgaaaggctgtgactctatctgacactcagttccctgccccggggacttgtgagtcggagtgcttctgggtctgtgagaggatggccactgcacttcctggccttcccagaagccacacgcctcccctctgttgtttcttcgtggtcctccacagcctcaggaggggagtcacagatatgtccttctgtagggcaggtgctttatgcctttccttctttttcagctacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacagtaactgtcagcataaacctgggggccctcaggactaggacagggtgagccagtgctccctcctttcatgtacttggcctgagactgacctctccctaggtccaaatgccctagtcacatggcagacccacggcctggcccactgtataaaataaacctgtttgcttcttagtttgaaaagtagaaagccacagtaacctgggtagcaaagactgagattgccccatcacagaggtgagttaaggggagagaattggtacaggcgagtcctatagtccaagatggcgccacaccaccaaagccttgaggccacaccactccccaaaccacacaactgtgttaccatgatctccacagcaaggaggaaataaaagcagagcggctttagggtttgcatcctggagctcacagtggcagcaagcatagcacagctgtgtgtgggccctccagcctcagcctttagggttccctgcagcaggttcggtggacagggagggagtgtggggtggaaattggagctgctaagggtgggggcggggtgcttcccagcatgtggggagggtatgacagtacatccctaggtccctgtcccagcgtcggctaccagccactctaagaaagagcaaggtgcacgt

SEQ ID NO: 81672 - DNA, 1092 bp, Homo sapiens
tgaggagtcaggagcagcagtcacgctgtctttgcaaggcctctgtgcctctgggtgagctaggagcccccatggtcctgactccagcatctcctcccctcctccagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaagtgggtgcaggggccaaaggcggggttgggggccgacccagcagccgggtctcatgctcacttccccgtccccagggccgctccgttagggatggcacctttcgccgggcacagcgtcgaagcttcactccagctagctttctggaggaggacacaactgatttccccgatgagctggacacatccttctttgcccgggtaagaagtgcccggggtgtccccccaccccacgttcccttcctgcctgtgtccaccctgacctcatgtgtttgctcaggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgtgagtgcggcaggcagggaagaggggcagagagagaccccggggcccgtcaggaacagctgggcgagtatcggcattcacctctgtgggcgatggaaggggtagcctcagggactgggaactcactactcactgggccaccaggggtgggagacgcagagctgggcatggccccagtctcatggcttgcctgtggaatgggacagcaatcttagaacccaggggctgggcagaatccaacggggaggcggaggtgacagaggtgatacttgctgagttgcagaagtcagtgtgtccccgttccagctccctgccatccccggaggcccgcagtgttgct

SEQ ID NO: 81673 - DNA, 1008 bp, Homo sapiens
ccaggttcctctgaactccccccgctgcattttccttcccggccacgaccggcgggtggtgtctccgagctgaaactccagcccagggcgggatggtccctgtcccggctgccctcaccgatgggaatagcaggagccgtggagctgggggtgggggactgactccgccttctgccccacgacactgactcccccatctgtacacttcgaagctccagggtgggctgggagcgactcccgaagacagactctcactctgtgcgcagaggccaacggggacaggccttctcccggctggggtgacagccagaccccagatgctcagggcattggcagagggcctggttgtctgtcatgctgggggcatgtttgtggggctgggcggggaatgggcaggggatcttccctggccccccagggcctgcttccgaccgaggtggtcctgaccagagtttcttctgtgtgtgccgcttgagatggtgaatgtgtgtgtctgtcccggtgggtggggcctaggtctggaggcccttctcctatcctgggaactcccacccgccaacgggacttcctgttggagaccgggagaagattcaaggatgaaactggcttttcaggtttgacccagctagatgcctgggcagtcccaggctcggttctcctcacccctgtggagctaaccccaacctcctagccccgaccccaagggtgggcagaagctggggaccaagcagctggctggggctcaaggggtccctgaggcggagccccctgccaccaggggtcattctgggcaagccgggccccttttcctgagaatggggcaggggcaaatggagtgcatgggagtctggtggtgccagattgaaggggcctcagaccctttcccagcccttccaagtagctttcactggctgggtggcctccgttgcacaagcaggcccctcaaccagcacccctcatgagctggccggtccccaccttggggagctgactttctagggtgcgctc

SEQ ID NO: 81674 - DNA, 1051 bp, Homo sapiens
gttgaggggcctgcttgtgcaacggaggccacccagccagtgaaagctacttggaagggctgggaaagggtctgaggccccttcaatctggcaccaccagactcccatgcactccatttgcccctgccccattctcaggaaaaggggcccggcttgcccagaatgacccctggtggcagggggctccgcctcagggaccccttgagccccagccagctgcttggtccccagcttctgcccacccttggggtcggggctaggaggttggggttagctccacaggggtgaggagaaccgagcctgggactgcccaggcatctagctgggtcaaacctgaaaagccagtttcatccttgaatcttctcccggtctccaacaggaagtcccgttggcgggtgggagttcccaggataggagaagggcctccagacctaggccccacccaccgggacagacacacacattcaccatctcaagcggcacacacagaagaaactctggtcaggaccacctcggtcggaagcaggccctggggggccagggaagatcccctgcccattccccgcccagccccacaaacatgcccccagcatgacagacaaccaggccctctgccaatgccctgagcatctggggtctggctgtcaccccagccgggagaaggcctgtccccgttggcctctgcgcacagagtgagagtctgtcttcgggagtcgctcccagcccaccctggagcttcgaagtgtacagatgggggagtcagtgtcgtggggcagaaggcggagtcagtcccccacccccagctccacggctcctgctattcccatcggtgagggcagccgggacagggaccatcccgccctgggctggagtttcagctcggagacaccacccgccggtcgtggccgggaaggaaaatgcagcggggggagttcagaggaacctggggcacccccggactctagactcccgctcctgggaccctcagctgttgggcgggggctggagccgagctgtcccgcccggccaggccgctggggctgctaatccg

SEQ ID NO: 81675 - DNA, 1046 bp, Homo sapiens
ggtctccaactgcctctcctcctctgaccagccgtcccacccccatgggccccagccaggacttcctggggagggaggggccatcagccggctggaagccaccagctgtttgtagcactgtgtgccgcttcccggggtgggggcataatgtgtcatcaatccgtgtttataaagcagccctggatgtgattccacaccctccctgcttatctgcagccatgcctcccaaacaatgagtctctccttcctgtgggaacagccccccatccccccgagtgctccccctcagtctagtagggaaactgaggccccagttgagcctttgtcctcttgatgggcagggagaggatgggtgttactttgtacttatatttattctgatgttacaagtgatacatggtccttgcagaactcacggggagtccagaggctcccagaggggtgtttttatccccacctttcttatgaggaaagagaatcacttggagagcagattggcccctgccccaggaggtggagaggccggcaccggggcgccagcaaccaacttctccagatgttctggactgagtgctgggggttgcgcaatctctgggcactccccccccccacttcctggtttgtggtctcatgctcccaccacaggctggaagcggtgggatgagagttccaactgtggcctgcagagtgggctggcgggctggtccaggacaagagaaagtggtgccaggtgagaggagggggcctggggcttcctctgtccccagtttgtcccactgctgggctggaacaggcttgttggaggaggcaaggatatcagtggaagatggagatgagaacacccttgaggctttgaaaggagtgaaggctagtattggtgctggggtgagcagccctgacccccgacctccacaataggccacaggctgtggaggggctggagctgcctccagctgtaggaggtgtggccatcagtcgctggagcctttataaacaagtctttgagagatgtggctgtattggctacaggggccagggttctagta

SEQ ID NO: 81676 - DNA, 1044 bp, Homo sapiens
ggtgtgatgacgggcgcctctaatctcagctacttgggaggctgaggcaggagaatcacttgaacccgggaggcagaggttgcagagagctgagatcacgccattgcactccggcctgggcgacagggcgagactccgtctcaaaaataaaaaaaaaatacaatgggcatttgtgatacaacaaaacagcacgtgtggcaggtgcgtcgtaggaacagggcaagggcgcagcatggcatcagggaccacaatacgtttgtctctattcagcatccttgtcaggccacagtcatgcccacttgagcccattggtggacaagatgatgtccagcagagaagagggtgtctcaccctgtgtcccttggatcagggacagccctctgccctctccataacctcctagtggatgcccttgcagacccctcagccaggcttgggtcatgcactcatccctaaaagggtcactgcagtgagttgccatgaaatcccaggccactctctgggctgaggagggtgtggtctcccccaggaggctctgccaacaaggaagaggggtgtgtgttggccatgggggtggggaggggtgagaggccccagtatctgccactggtggaaatggtatcagtgaaatcctgatcagaaatttgggatggaaaaggaaacaatgagaaaagggctgtgggaacctcctctccagagtggtagttgggcccccccagtgtgcccccatggaggcacaggagtgtgcagagtgaagcccctggaggggcattccctctaagctccagggaagatggaacagggccaccctttctcccctggacatggcctggccaagcctggcctgttcacttctgtcctcatggctctggatgcctaaggatttctgggcttcccgcccaggcactgaccccttcttcccaccaccctatctccaggaaggcctcctgaatgctccccacactgaccccttcttcccaccaccctatctccgggaaggcctcctgaatgctccccacactgaccccttcttcccaccaccct

SEQ ID NO: 81677 - DNA, 1195 bp, Homo sapiens
tagtagagatgaggtttcactgtgttggcaaggctggtctcgaactcctgagctcaagtgatccacccgcgtctgttttatttcttaaattcatgtgaagtctggatatcttgcagtccttttgaccaagtcttcttacttgcctgggatatatcccccattcccatccccagttccccagccccctcccaggaggtgaccctggccagcagctccttgttgaccctcccagagatgagtagacagatgtgtatctgaggacactgatgtgtctcacactccttactgttcaacgcctgagtctgggcagtactttctcatggggactggactctacctggcacaaggctcctcactgctcctcactgccagccccacctgctaacccagagacattggagggcctggccaggacgtgccttctcacggtgggggtgggggtggggtgctccacccccaagcccagggtcactggcctcagctttcttgtggatccactcttgtgctcagggtggactttcaggtagatccaaggagaggactttctgctctcagggtacctgcccacagcctctttttaaacagtgtctgggcttgtgtggaggtggacttgctggctgggtccaactccagggccagtgggccaaagaagagaggaggcagaggggcagctgcagcagcacagggtggggggtttgctcagcgaagcagtcacaggggcctccacgtctcaggtcctgctcctcagccagatgctgggtggccccggtgtgtggtgggagcctgtgcaggtgtgatccagatgttcccctggcccctctcccttcccaggagggtgagcgggccttgcagagctggctggcagctgggggctccctttctgagaagagggcctttctgcctgtgcgtcagcacagggagcgtgctgtggccatgtctagggccatggctccctgatcacccaggaggaagttggagtggggagggggaccagcctcacctgctgccacccgcagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctt

SEQ ID NO: 81678 - DNA, 1131 bp, Homo sapiens
gttggccaggcaccaaaggctgtggaagccccaaggccaggctctcacttcagcctaactcctggccactagcatacccaggtcccaattctggtctggctctgtgctctgtggctctcctgtgtcccccatatgcctggccccctcctccaggctggctcttctaatccaccttgagggatcagaggtgagatgcaggatgaactgtgcccatggctcctgctgctgctcaaggggaagtgcccaggctctgtccacctggaggcctgcctggcctcataccgttctgccctcatcgcactgtcctgacccacctgccacactttgcttctctgctgcccactgaggccagtgttgagaacacggtgggggggtctgctgcactcactggcatgctcacctgcctgcaggtactccccgctggccgagcagttctcccaccagttcccatctcatgacctgccgtccgttcttgccaagttctccttgccggtctccttgtcagaatttaggaatcccctggcccccgctgtgcaggaggtgagtcacagaagctcaaggagcccagagtggcaggtgtgtagtggataggcactacctgcctggctgttggttctgatctgagagccctcagcactgccacctgcttctccttggttttgggggcttgccgtgcaagtgctacgtgcccagcaggacccaaaagtcagctgccgggccacctgcagatgcttggccagtgacccaacacttgagcagttgttccctccccatagagcccaccctggctgtggcaggcagtttttagtgttagaaccgagttaagcaggagagtgcttaccttttctgggcctacagacctgccttgtacccctttgggactggggactgcctacagatgagggtgcaaaggcagttttgttctcactgggccaggcctgaccctctgagagttctgcttctgtcttcactccctgccatggttcaggtggccacagggtctgtgggtatgagttctggggtcactggtccccagaatctcctcattcaagagagcctagagaggaccctagtgggcctggatcagggcaacgggcaggcaggttgggagctaggagtggctgggggata

SEQ ID NO: 81679 - DNA, 1038 bp, Homo sapiens
gacctcgtgcaggacctggtgcatacctggtgcagggttccctgcacttcgtatgttccgtgtgtttgagtcccaggtgcatacctggtgcatacccggtgcatacctggtgcaggacctggtgcatacccggtgcatacctggtgcaggacctggtgcatacccggtgcagggttcctgcacttcgtgtgttccgtgacaggtgattgttttgcagcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggtatagctctggaggcccagatgggtggcatgtggcggtgctggggcatcaggaaaggcaggccgcctgccacagtacatccacaggggctgtgtccagctgagagccgcggcacagcccaccatggggtggggccagtccctgggatggctggaggttttggcatctgagtcagacctgggttcagggctggctttgtgagtgagccacgggactgacttgttcttctgtctcagagaggtaaggcgagtctgtgagagaaaggactggggtgcttgcagtcctggaggttgaggcaccagagctagggggtgggcagggcagcagcgggcagggccatgggggtctcacagtggtgcatgaacaacatacgggaactaagggcaggaagcttggatgcggggccctcccatgtgcagaacagagacctaacctggtggccttacgcccctgtgtgtgcacatgtgttggcctgtgcactctgtacaagatgccacgtccttgctgagccacatgcttatgggcctgtccatgcagagggctgccctttctgattagatggagggcccctcagcctcgtctgcggatctggttggagtgtgggaggaaaagcgcaggcaaggctgggcacggtggctcatgcctgtcatcctagcccaggact

SEQ ID NO: 81680 - DNA, 1090 bp, Homo sapiens
ctcctctgtgtcatagaacaagtgctgttggctcttacttaaggcaagggcgctttgtggtgagcggtggagttgggtggcgccctggcttctccatcagggagttttagaagctcctggtgaaaacaactccttccttgttttgtgtggttccccgaggggatgacgtgggctgcatccccactgtggagcctgttcttggggcagggcttcctaggaaagacagtgcatgcagggagggcggtgtgttccttggcttcattcaggaaatgcagctccgtgcctatgtgcctgacacgttttacaatgtgtagagagcagagaatgaaacccacaagcccccctcctcaggagtgagttctggttggggagacagcattaggcagcgggtcaggggttggagtgtcaatggggctggggtcaggggtgcttcactgagaatgtgacacttgagtggagaccgatggagtaaaggagccttggggcgtctgcagagagtttgtgggcaagggcaaatgccagggccctgagcacagcgggacctgagtgactgggcacagggagtgaggccacaggaacgtgggtgttgcaggcccatggctgggactgcccaggtgggagtgtggggagcggtagtcagaggggccagtgctctgggtggcttgggcctggtgatgctgaaaaggcctggattttggacatccctgcaggtggagcagatgggatttgctgatggtttaaagtggactgtgaaagaaataaggaaactgggatggtgttgctatgtttggcctgagcaagctttgggacccgaaagaaccaagttacccttactgatagaatgtggagtgaaaggttttccgtcgtagtgaagtgttggggctggctagcacggctggcttgtggtgaccacttggtatccacatgcactgcaactgaggtgctgtgggcatctgcagactgcagggaggtgggcactgtgtgcttctcaccactggaacactctgggggacttggcattccttccctgccctcctcgccctctgagacagccactgttctgcctggacgtgcacctgtgatgggtctt

SEQ ID NO: 81681 - DNA, 1763 bp, Homo sapiens
agtgctaggactacaggcgtgagccaccacgtccggtccccagttgctattttaattaaagctagggttatggtgtggctgaatagcctggtggccctgtcctgcaggacctaacatctgtgaatataggctgggaatgtgaatcgctcaggaggccaccccaacacttgtgccatacctagcacttgtgtctccctgtggatcccagtggccctcagtgacagcatgtcactcattcatatgaccattgaattgtgtctcccaggagggcagggatgtctcttcactttctgcaacacagcccctacactcagcctgtggaggagcacagctcatccgctaggggtcgacggaatgtgtgggtgggaataacagcagtgtagattccatggagtgtgaagaagtgatttgctgaatggttctccgagttaacaggacctgtggtggggagtgatgtccagggtctggctgggtaggtggtacttggtgcggagccttgcactgcaaactgtcgagagcagggttggtcccatggaccctctgtgaatatcctgagttgtagtacccatttccataaaaatgcacctatatataaactttcgtttgaaatttcaaggtaggctgtttggaacccacatagatcttttgggttatgcagcatcccactacttatggtaggaagccaggcccatccgtgggaccagaggatgcagaggtttgcaggatagcttcacaggtcctgtctagttctaaggttaggaatggatgctttctcagatgctaaaagctgaggggactagactaagcttgtgcacatttctgtcttggagatgaacggcgagagtgtgtttgaagccagccattcccttttgcatagtcattgtcaggatgcagggctttggctggggcacctatctcctgtcacagactgggctgggccctcttggctggcccagagctgtgtgaggggctggataagtcttgaggaggacagtgttttcctccagagtgttttcagaccaaaccattaaacaccttgcaaatagaagtgcaagctcggcaggaaacctttcagggcccaaaccctgcttgtgctaagggctcttgtcttaaagctgcagacttaaaaacagtgacaaacctttctctttccccttgttaacagacctcagtgcagctcctggcttaccctcttactgtgggggatttacaggctggaggttgggccggcacctttccagagcagtcatccctctgacatgttcagggaatttgcccaggtctgccatggcctttggggcactcctggtggcagcacttgtcaccgctctagggagctgggttagttcataaagaagcaccagcctcagtgcagagtgctctgagggagaaagcagcaggtgggtgagctgatgcttgggaaaatggagtaaagtccacgtggaagttagaggaaccaacatggcgtgtctctgccagaggagagggccccatgccagtgtacaaaccagaccacatgactgcggctccaaggacagctgacacggtgagggcagcagagatgaccaagctgggaagtcactagaagaaccttcatgtgaccctcctgccctcatttctccatacccatagctggaacttgttcctggctttccatgaggtgtgttccaagcccctgttcctttccctataactctctccagtttctaatgctccatacaatttgattacaattaggtgtctttttttttaaacgttaattt

SEQ ID NO: 81682 - DNA, 1413 bp, Homo sapiens
ctctctgtccctgtgtttccttcaaactacaagttaactctgaaggcttggttctatttgggtacaagttttggggatgagaaagtctcatgcgtgatgccttaaacttcctgccactttatgtcgtgtatggtgaaaatatggtgtttctaaaagttcccattagtgctggcacaccctaggtgttagctttctcagcatgtccctcactccatgtcaggcctttgcaaaccggacatgctgggacaccccatgagtgcaggtcactgagcgtcactggggactgcaccactttgtatgtctggaaaggtcaagcatatgggccctggacatccaactcatggacactgttgtgcctcagctgaataatcacatatccaggatcattgtcctcctccttgctttgctcgtggaagtatttgtacacagattcttcttctaggtgggtattttgttttgaggcaattgtatacaccccatatgtcagccctctggtcccaaggacactgttgaggcaatgcccttgacatggaggagcaggtctgctgcccagtggtgggcacagcatgggagcaacagtcctttctctggcaagggatgctgccttgttgtaagtccatccaggtgtgagttctgtttgtgaacatgggatctgatgagaatatagagaatttcttcagctccagatgaagaacgtatttactgtctgggtcaggctttgcccctgaagcctggctgtgaacactttgggcatggccttccctctcagataaacaggagggggaggcagcaccagaggttgtaatcagcagtaccattcacccctttcccttgtcccacctccacccccacaggatgactcagcagtcctgttggcctccagaagcactgagtcatggttggcccagttatctgctccctcaagtgttttcacagacccccacagctgcatgcctccacccttggcttgggcagatgtgcttgcctggctgactgtggtccctgataggttccagagggtcgagggcccctcttgttcctgagagcctcctgcactgtcctttgacccagtcatcatggttgcagaaggagctcttgggcagagatatgggcctggagcctgctggttttcttgttaaccagtgtgacttctgctgggaagagcttctcatccttcaggaccaaaagtattcagtgaacaattggcctggtgcctctctttttgtaccgtgcatccctgtagtaacgtggcctgtcgtgactgaattcttacaaattgtagactggttctgcctaccagtagtcagcagtacagtggtgaccacagacactagcagggtctttgctcagggcaggttctgttcttagtttgttacatggctcgctaatttcttccattcagtccttggtgag

SEQ ID NO: 81683 - DNA, 1072 bp, Homo sapiens
cctgctggctgcctcagagggctccatgaacagccactaagtcaatgtgactgtttttttttttgagacggagtttcgctctgtcacccaggctggagtgcagtggcacgatctccgctcactgcaacctctgccgcccaggttcaagcgattctcctgcctcagcctcccgactagctgggactacaggcttcactgcgcccggctaatttttgtatttttagtagagacgggggtttcattatgttggccatgctggtctcgaactcctgacctcgggtgatccacccacttcagcctcccaaagtgctgggatgacaggtgtgagccaccacgcctggcccagtgtgcctttttacttcagctcacagatttccagttggccgtctctgcagaccctggcctctagcagggaaagagccttttatttggctgttgtgagggcgccttgaagtttaggtatttataaacgcgaactgggctaccactgcttgcctctgagaatcccagggaccatctcacagccaaactaaatttggtccctggactggtgcctgagggctgaggctgagacatggctgtgactctttatgacagagcagcagtttttagtggagattttgggctgtcagagcaagggacctttctggagtggtggtggttatttttctgttacctctgtgtcccctgagtcactgggtggcagagtggaggggcactgtttagataggatgtgaggcgttggccctgggtcagttgctagagcagaagtgtttggtggcgttttaatacctcaaaccctccttcaacattaccatgtcccacagatgggagttatagaacagagtgagccatttagggtttttgaagaaagcatattatgcctgtggtgtaaggcacttgaatcctccatctctgcaggagagacctgcagtgggctgctgaggacttggctgtgggtcctgcgtttcccaggataactctaacaagattgatttcagaaggtccaactgcaacctgactgggttgagaggctatttccaaatggcacaaataggtttgaccaaaccct

SEQ ID NO: 81684 - DNA, 1028 bp, Homo sapiens
gggagtgtgtgaccctgtttctcacatgttgggagtgtgtgatctgtttctcagcgtggggagtgtgtgatcctgtttctcagcgtggggagtgtgtgatctgtttctcagcgtggggagggtgtgaccctgtttctcagcgtggggagtgtgtgatcctgtttctcagcggtggggagtgtgtgatcctgtttctcaacgtggggagtgtgtgaccctgtttctcagcgtggggagtgtgtgaccctgtttctcagcgtggggagtgtgtgaccctctttctcagcgtggggagtgtgtgatcctgtttctcagcgtggggagtgtgtgatcctgtttctcagcgtggggagtgtgtgaccctgtttctcagcgtggggagtgtgtgaccctgtttctcagcgtggggagtgtgtgatcctgtttcttgtctggtaagttgcttagtcgtgatggtcaacagttaatgcttaatggtggcacttctgctagacttttgtgcagtttttataaaatagccttgtaacttttcatggtttttaaaaaagtgatatgtttttgtttggtcttgatggtcctgttcccatttcagcgagccatgtcctccaaccgatgagcaattggttgcagggtaagaccgagacctctccaccgtctttctgtcttgattccggctgccttctcttcttgtaattgtgcttaattcctgatttccctccatgttgaagagtgactgatgaggcacacaggcgtggacctcactgccccagttcccccatgaatgcccagacttcccaccaccccggctttttctctacccagtcatttagctatttcacattacctgagaggccaaggcatggctggctggcacccgggagacttctgggaccaggcatgtcacacaaacctcctcttcctccaggtaggcacaagtagtcctgtgagggtggcgggcaagcaggagtggactctgtcatctccctagtccactgccgccctagagagacctgtgactgttgctcctt

SEQ ID NO: 81685 - DNA, 1004 bp, Homo sapiens
agctcagagcatgttcctggagcaaggcagtgaaagtgcatcaaatccactctctgtgtctttgatttttttttttttgagacggagtctcgctctgtcacccaggctggagtgcagtggcgcgatctcagctcactgcaggctccgcctcccgggttcacaccattctcctgcctcagcctccggagtagctgggactacaggcgactgccaccacgcccggctaattttttctatttttagtagagatggggtttcaccgtgttagccaggacggtctcgatctcctgaccttgtgatccaccagcctcggcctcccaaagtgctgggattacaggcgtgagccaccgcgcccggcccgtgtctttgactgttgttcccaaaagtgcttttctttctgaaaccagagcttcagtttaccagactgaaacagtattaacaggctacacagtgacttgtgagtggtcgtggcctgccttagaaaagtgaggacacagccgtgctgctcactattacaaacactggccagtgtggccatttaaattgaagttaactgaaataggccagatgtcgtggcttatgcctgtaatccaagcactttgggagtcccaggcagatggatcacctgaggtcaggagacagcctggccaacatggcaaaaccctacctctactaaaaatacaaaaatttgtcgggcatgggagcacatgcctgtaatcctagctactccggaggctaaggcaggagaatcacttgaacttgggaggcggaggttgcagtgagctgagatcacgccactgcactccagtttgggcaacagaacgagagtctgtctcaaaaaaaaaaaaaaagaagaagatggaaattaactgaaataaaaaattcacttgcggccgggcgcagtggctcaagcctgtaatcccagccctttgggaggccaaggcgggcggatcatgaggtcaggagatcgagactcatcctggctaacacggtgaaaccccatc

SEQ ID NO: 81686 - DNA, 1036 bp, Homo sapiens
ctttgggaggcagataacctgaggtcaggagttcgagaccagcctggccaacatggtgaaaccctgtctctaccaatatacaaaaattagctgggtgtggtggcggacacctgtaatcacagctacttgggaggctgagacaggagaatcgtttgaacccgggagccagaggttgcagtgaaccgagattgcatccagcctggacgacagcaagactctgtctcaaaaaaccccccaaaaacccaaaatgaagcccttctgaaaaggataactgctaactaatgtgtagatgatgggagctccttccctttttcacttcgtgggagattttttggagggaattcctgaggttcacattgttaacacatagccatcctcatccgctctgtttctgcaggggtacacatgccacccttgagctggctggctcagtgggcgcacacgggcgctgtggtctgggtctttctgccaccggtatcacagtgtagctggtggccttgctctgggctctcctgccacaggctgtcccctccaggaggacagatgggtaggtgggctgctctgccagcccgtgacacaggtctagcccagccaactgtctccaaggaaaggagggtggaaggggccgccctgtacaggagtcacttgggattgatgctgtgctttgcaggcatcacccatgtcgatattccctgcgtgttgctgttcctcccgtgttggtattccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttcccccc

SEQ ID NO: 81687 - DNA, 1250 bp, Homo sapiens
ggaggagctcgcacggcgccaggtgatgggctgcacaggcactgtcccctgcctgcgtcctggggcctgtgcactgttgcgtccatgctcagagtggctgagacttgtgtcctgaccaggccctgcttacctctgttttggtttttgtttttgatatttttttttccattgtgtttttacgtagtgtcatgttctgtgcatatagtgttgtattctcctttgcactgtttatgttacagtgaaggctctccttattaaaaatcttcgcaaaggtcactttttaatggctatctaacactccatatgtggtgggcaagtctggttggcctccggggggtttccaggtataggggatgtagggccttgcctggcctggtctgcgggtccatcgtcagtgcctgagcggccagcagaaggggggcagcagcctccactgagcctctggttcccatttcccaggttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgctgtcctctgcgtagaggcttttcactgtgaccctgtgccagtgccaccagcacctcacagaaaccgtgacttactcgtgggtcacgtcttgtcttctggcatccagtagatggcagggcacttcctgtcccctgcatctgactgacgggacccaggtgtgcatgggtgtttgtttgctcgctcccacacaaccttctgagtgtctgagctgcccatctcccatggggaggagggaggggtccccattctgcattcatttatttaggaaaagctgtcttgtctgctcagctgctaccatagccttaacttgggactcaggtgagttacactgcatgtccccttttgaagttactagcagaaaacaaagacccatggggctgggcatggtgacacatgcctgtagtcccagctactactaagaa

SEQ ID NO: 81688 - DNA, 1049 bp, Homo sapiens
taaagcattttttcatgtgttatcttcttcattaagaagttttaaaaatgaatgtgttggccgggcgcggtggctcatgcctgtaatcccagcactttgggaggctgaggcaggcgggtcacaaggtcaagagatcaagaccatcctggccaacatggtgaaaccccatctctactaaaaatacaaaaattagttgggtgtggtggcatgtgcctgtaatcccagctacttgggaggccgaggcagaagaataggttgaactcgaggtggaagttgcagtgagccgagatcacgccactgcactccagcctggtgacagtgagacaccgtttcaaagagaaaaaaaaaagtattcccatttcctaaaagtgtcccttcaatttttaaattaccaatactgagctcatataaaggtgatttgttaagtagcattcacactctggtttgtgtaacttgctcttcctcattttttgtttcatttatttagaaaactgtcgctgaaaagcaggagaagagaaatcaggatcgcttgaggaggagagaggagagggaacgggaggagcgtctgagcaggaggtgagcctgagggctggcactggatggcctgcattggcctcgggcattccctgctcggtccattccactgttgcttggaataggcagggcctgcccaataggccgttataaaagaaaatagtaaggccaggcctggcggctcacgcctgtaatcctgtcagtttgggaggctgaggcgggcagaacacttgaggtcaggggttcgagaccagcctggccaacatggtgaaaccttgtctctactaaaaatacagaaattagctgggcgtgctggcatgagcctgtaatcctagctactcggaggctgaggtgggagaatcacttgagcccgggaggcagaggttgcagtgagccgagatcgtgccactgcactctagcctgggcaacagagactccatctcaaccaaaaaaaaaaaaaaaaaaagtaaacagcatattcagtccaacaaaacaaaacaaaacacgtcccagcg

SEQ ID NO: 81689 - DNA, 1049 bp, Homo sapiens
ttgtatttttaatagagatggggtttctccatgttggtcaggctgatcttgaactccggacctcaggtgatccgccagcctcagcctcccaaagtgctgggattacaggcgtgagccaccgcgcctggcctggtcttgatctcttgaccacatggtccgcccacctggcctcacaaagtgctgggaccgtgcctggccgcgtttcttaaataaacagtgaaaattgagttggttataaatatctgaagttttgtttgtgtttttttaatatttgtttaaaagtcacctctgtcatcttatcaaatattttcattttggagattgaatttgtggtggcagttctatatacctcacttttatttctccattttccttcttcaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgagggtatgttcatctgtttctggagaaagctgaggagtcttggggtgttttcacatttctttaatttttaaaaaccttatgttttggccgggcgtggtggctgatgcctataatcccagcactttgggaggccgaggtgggcgaatcacctgaggtcaggagttcgagaccagcctgaccaacatggtgaaaccccgtctctaccgaaaaattagccaggtgtgttggtgtgagcctgtaatcttaggtactcgggaggctggggcagaagaattgcttaaacccaggaggcagaggttgcagtgagccgagatcatgccattgcattccagcctgggctatagagtaagactccatctcaaaaaaaaaacaaaaaacattatgttctgatctctaagaacttgagttttatagtgaaatacgcagatttcatcacttggattcacacaagagacatgatagctcagagtccaaaggagccttggagatttatt

SEQ ID NO: 81690 - DNA, 1016 bp, Homo sapiens
cttctgtttttctcttcagtggaactaagcctctccttgttttttcttttcagtgttgtaaaagcatttcttaggatttatgcaattgctaatttgaccaacggtgctattttgtttcagaaggtaaatcctagtaattaggtattttggttacagcttaaatctgtacatttaaacctaggcattttattaccatacccagaagaaaaagtcataaagagagacagcctagacaatgaccaatctgtgatgatccttggaagcatgtcggaagtgacaaaggtgccactggtttcattggaacataggactcgtttatggttacagtctcaatgctggcagtaaggatgccttcattgttaagtgtggatctttagctcttccacttattttcagactggaaatggagcaggagaaacccttgttgcctttgcattcactttcattttcagatgtctgcttacctcattctttctcctcacaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggttggtgagataagtgccttagggcaagagaaatcttagtaatttggcagcgttgaccgttggaattaattgagcccatgcttgctcccattttttaaaaaatttatacattttgggcccagcacagtggctcacgcctgtcatcccagcactttggaaggccgaggcgggcggatcacgaggtcaggagataagaccatcctggctaacacagcgaatccccgtctctactaaaaatacaaaaaaattagccgggcatggcgccaggcacctgtagtcccagctgctccggaggctgaggaaggagaatggcgtgaacccgggaggcggagcttgcagtgagctgagattgcgccactgcactccagcctgggcgacagagcgagac

SEQ ID NO: 81691 - DNA, 1033 bp, Homo sapiens
gaacatgagggaataatatttacgtggctcacaaagaccagtgagtacatcatatgcatctctcacaactccccagaagagggcctccagcacgagtctaggctcagccttttctgtccctccgagaactctatgaattgctgccaagtgttttaattttcctcagaatttctttgtaatgttattgagggttggaggtccttttacaaattttggaaataagtaaatcaaatgagaagaccatgcttccaaacaatcattctgtttaacagatccccttgatttaatgcaattatgaatgcgttagtggtagtgtagtttaagatctttcccttgaatgtacaggctttaaagaaacgaacctaggagtgtatttcctatcaagcaaatgggttctaagactttacgctttacacatcattgattatagcgctgtgcttttcccgtgctaggcaatggatcacttggagtcctttattgctgaatgtgatcggagaactgagctcgccaagaagcggctggcagaaacacaggaggaaatcagtgcggaagtttctgcaaaggtatgcttgggtggcttcggtgtctggtgtgttcttaaaaatactggcttgtcaatagcttttttttttgagatggagtctccctctgtcacccaggctggagtgcagtggcatgatctcagctcagtgcaagctccgcctcccgggttcatgccattctcctgcctcagcctcccgagtagctgggactgcagacgcccgccaccatgcccggctaattttttgtatttttagtagagacggggtttcaccgtgttagccggtatggtcttgatctcctgacctcgtgatctgcctgcctcagcctcccaaagtgctgggattacaggcgtgagccaccgcgcccggcgttgtcaatagctattaactgaccctcagcactgattgtgtggacagtactctctgccttactccagttaaggatagagggctgtgatcaagcattcatgtgtcatggaattctcatccct

SEQ ID NO: 81692 - DNA, 1035 bp, Homo sapiens
caggcatgcaccaccacgcctgggtaattttgtatttttagtagagatggggtttctccttgttggtcaggctgatctcaaactcctgacctcaggtgatccacccacctcagcctcccaaagtgctaggattacaggcgtgagccaccgcgcccggcccctctgcggctctttggaggtgtttagcgcacgtgcctagtgcagcacaagggcacctgtctgctgtgacagttctgactgacatcatgggcttttctcaggctcagtgaccaccggcctgtgtcagtgctgctgggccgggagagctggtaacagcaccaggcagtccgtgtgtggagggacagcctcctcagtggagatgacgtgtgctgatattgtccagttttgccatactgttaggacacaagtctttgtgctggtgctgtctgtgctcaggggcttttagggtttatgtttcataacgctactcagagatagagagagattgggtgactttctagtaagtggtaggttgtgattaggacttaatttttggaatcgaatgtcttttttttatcatttagatctgctcttttaagaaacaggctaaagttgagaaacactttgaagggagagggcagtagaacagaaagccaccttttaaagaacttggcagctcttggttggcttgttctctgttgtgaagtttaccatttatagttgttgttttctgtttgagccagtcttgctctgtcgcccaggctggagtgcagtggcgtgatcttggctcactgcaacctccgcctcccaggttcaagcgattctcctgcctcagcctcccttgtagctgggattcacctcgtaaggcgaattaaccttagcatatgatagttcttttagtgtttcccaccacccttttcagagtaagcaattagacgtctagagtttcttttcctctatctctttgggtaaatagcaaccagtggtgcccgccaccacgcctggctaattttttgtatttttagtagagatggggtttcaccatactggccaggc

SEQ ID NO: 81693 - DNA, 2303 bp, Homo sapiens
gccatggatggggcttcagcctccttcctatgtaccgtcctgctacttcctccccggcgggcgccgcggctccgtgcccctccgcgaactgtggagtcggcggagggctggaatcagcgtgggctccaggtcgctggcagccgggtggcagaactcttccgaggctccttgggaagaagctacacccgagggagccggatgggcctcgaaaacctggcccgctctggttctgtaccattgcaaggggaaccgtaaactgagcttttctaacgtgggtttctgccaagtacttttccagctgcccccttccccccagcacacaggagagcctctgtgtagccagcgcttgacagtcgttaggtaggttgtactgtgtagggaggagctcaagatcatgatggttgtcacaggagaaagcggttgcatctttgcaaaactatatacctgctgtggtttgtgttttcttttctgctgagtaatgaagttgtaagttcacactggcacattctcagggctgtgcagattatttgcactttatttcataggtgaataagtgctttttagctttctttgtatattgagttgcttttgaattgcttcccatatttttatttcatacaaactgaacaattgtggcccctctattttatttataaaggttcagtgtatctttgcctgcctacatcaatctgcaagggagttgcagaaagcctcatgttcatcgagccgtgagtcacaaccaatttctaagctgttataacaaaaaagtgtttgctttttttcacaagtaactttaaaagtgtagtttagaaagaaaacattttcaataaaaagacactacattaatcctggatgcttgcaaatcctaaaatatattcctcctctagcgttgcacagctctgtgttgtatacacagactagctttaaaatttgtcacataccactttacctttacttttatgtatcattcccccgacttccttactgcaggtgtgggcaagaaaacttttcctttaacacttttcaacagcgggcataaaattctgcagctgaggtcttgaagaatgcagatgggtacagtatgtgttggagctcacagtgtgtattgactaacctagttccttttttgctttttttggtattgtcttgttaaaagtgactcccaggtagcaactctcttttttaagggtgggaacgaaagggacgtaggaagaatagatctagattatttaacagtcttcgatagagtttgaaagctttcttcttcattcaattttgggcaaaatactgcctctgcatttgttcataacaaaaagattagattaataagtagcttttgttggtggaaattaccagctctataagtcacccttggtggttcatggacctctgattagcttgggttttgcagtctcattgccacatgtatatgtggagccaatggccttttggtgctcagctgtttacgtctgactccttgacttctttggtacagtgatggagtcagatctcattaagtgtgattctccatgatataactagcctcaaaaaaatgtgtattccactccagttgtaaatatctttagatcagcttttcattgcatttgatggggagaacacagaaatgatagtctgcaaatcatccaggtgaattgttatactagttattttttggtggttaatgtgataatattgtcttatttaaaaccacaaatgaatttcaggagacgaaaccagacagagggtcaagtttacagatgaccgtgtctgcaagagtcaccttctggactgctgcccccatgacatcctggctgggacggtaggtgcattttgggggacctcatggaacactctgacatgagtgctgtataggcagtgacggtttttctatgttgaattttgttttaacttaagtctctttttctctaagtggcttaattatggcaggtgttcctccactcgtatgtatgtttgcatgcatgcatgcgatggagtgtcactctgtgttgcccaggctgaagtgcagtggtgtgatcacagctcactgcagccttgaactcctgggctccagcaatcctaccacctcagcctcttgagcagctggtactacaggcatgagccactgctcctttctcaatcctccactcttcaacaggcagaaatccctgatgcccttaaaatgatagattctattcatttggtaggattttatattatggaacaaatttcactgttgtaaaattctgtctgtaaagttaccagattttttgtaaagtcatttatactgagatattcacaactaa

SEQ ID NO: 81694 - DNA, 1021 bp, Homo sapiens
acagctaactcgcctttccacactaattagagaccttcttaagtataatctgttaagactgacaccctaaacatttatttagcttttatttcctgggctggtggcccatagttagagctgcagccagtccccaagaagccgacgccagcagacccctctgtgctgcagctttgtgccgtgggactgctggcctcgccgacctcttgctttatcgacacagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctggtgagcctcggcttccccgcccagtggggtccaaagcagctcttcccaggggatggggcggagggggcagaactgtgtctgcgagtctagaagtggcctttaaacagtgaatcaatcccaagaggctgccagttctatgtccaaggttttcccggagttttagggagcgatagaccagcctttttatttttgagatggagtttcgctcttgttgcccaggctggagtgcactggcacaatctcagctcaccgctacttctgcctccggagttcaagcgattctcccgcctcagcctcccaaatagctgggattacaggcgtgcagcaccacgcccagctaatatttgtatttttagtagagaccgggtttcaccatgttggtcagggtggtctcgaactcctgagctcgtgatccgcccgcctcagcctcccaaagtgctgagattacaggcgtgagccacagcgcctggccctaattttgtatttttggtaaagatggg

SEQ ID NO: 81695 - DNA, 1021 bp, Homo sapiens
acgttggccaagatggtctcaatctcttgacctcgttatctgccctcctcggcctcccaaagtgctgggattacaggcgtgaggcaccttgcccggccaacttcactcttttggtgtttgattttagggcataaagtttatcacttgagtccttgaatgaaaggaagtgtaaaccctgacgagtatggagtgtggactgtctagatgccccctggtctagggagggatttatccctgaacagaaggtgccagaacatccaattcttaatgcccagatgtcctgcttgttcctttctgaaggttaacactaggcattgttgcccaccccctggttttcacgaaggaaattactcatcctagtgaggaagaagccaccgtcctcgttgggtgccctcacagtggcaggttccatgtagcagagaagtaggtcgtgctggacctgatcgttcctggaaaccaggcatggcccgcggagtatagtctgtggttttctctttcagttatctatgactttctggctgtggatgatataaacggggacaggatccaagatgttctttttctttataaaaacaccaacagcagcaacaatttcagccgatcctgtgtggacgaaggtaatttcattttatatgaaaaaggcggagctccctgtagaaagaggaatcgtcattttgggtcaccctctcgctttcagtgtttgggggaagcagatggtggtgtttctggaacccatctcgtcatccttcctggcagaccagaaagaggcctggaagcccagtcccagcactgccctggcccctgagccccgtggggtcagcattagagccccgggagcctgcaagatacaggagatccacctggcgggaggggctgtggcctaggagaggtgtgaggaaaacagacctggaacagcacatgctggggctggccggcctgcctgcccagatggtgcaacagtgaggtgccggtgtctctccctacaggcttttcctctccctgcacctttgcagctgctgtg

SEQ ID NO: 81696 - DNA, 1120 bp, Homo sapiens
cttcccagacaggattcgggtctgaccacttgccggggactcgcccagagccccacgttcccaactcccatagacccagcatactcagggggctccatctctaccaggcagctttggggcctccccaagaatggtggagtacacacttcccatttgtgctgttgcagtgttgggggtgaagctctgagggctgggagcacctgtgaggcactggggctgccctgcctgcctcatgtgccccgtgcagtgtggaggcaccaaccatcgtggcagactctctgatgtcagcgtgtctttcctcaaaaccaagagcctgtgggccccttacccttccacatctcccattgtagagtgccccgcccccaggctcacgtccctctcttcctgggccttgtgtcattgcagccccaggctcaggtccttctcttcctgggccttgtgtccttgcagccccaggctcaggtccctctcttcctgtgtcatcctgtgtcattgcaggttagtggccacctctactccggcagcaccgggcaccagattggcctcagaggcagccttggtgtggacggggaaagtggcttcctccttcacgtcaccaggacaggtgcccactacatcctctttccctgcggtacgttgtttctgccacatccctggccagcctcactcgtggagcatgactgccctgcggctcctcaggtcctgcttctgctctcgaggtgctggagtcaggaagcccaggggcctggctccatgtggcactgcgtgcccctggtccgggttcacagcgtgaccctggtgacctcgggcccttctgtgttttgaatagcaagctccctctgcggctgctctgtgaagggtctctacgagaaggtgaccgggagcggcggcccgttcaagagtgacccgcactgggagagcatgctcaatgccaccacccgcaggatgctttcccacaggtgggtccgggccgcagcctttctccatgcagagcgcccaccccatggctctgctcgcctgcctcagcgttcggacaatctgtgtggagcccagagcagccccaccggcagggaggtgctcggggtaccgcaaggtcaccctgggctcagatgtgagaaat

SEQ ID NO: 81697 - DNA, 1030 bp, Homo sapiens
ttttttttttaagacggagtcttgccctgtcccccaggctggagtgcagtggtgcgatctcggttcactgcaacctccgcctcccgggttcaagtgattctcctgccccagcctcccgagtagctgggattacaggcgcgcacctccacgcccagctaatttttgcatttttagtagagacggggtttctccatgttggtcagactggtctcgaacttctgacctcgtgatccgcccgcctcggcctcccaaagtgctggaattacaggcatgagccaccgcgcccagctcttctcttttcaagctgtagaactgagaaacgggttatgggggcctaagaggagcaccctgagacgggcggtgccagagcctccactgggtgcctgaggccgccccggggacccggcgcccctttctcccactctcctgtctagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgaggtacagggtttccccaaggaccgcgcaggtgctgcaccccttcccggcatcccgggcacatcccgttggctggcgaggagacagcgctgggggtggggccggaggccgtgtgctgctgcccgggcttcttgcctgtctctggtacttgccccttgccccagacgtcggctccgtgtcctgggccctggtccagatgtggccatgggagactgaggggcggacgtgttcctgggtgcttccttcatctcagtctcctcactgagacccctcgtgagcgcttcctccatattgttccagaaaacccatcttcggccgctacaaaccagacaccttggctgtagccgttgaaaacggaactggcaccgacagacaggttcgttgttcttccttcggaggtggcacctttgttcttagctgaggatagactggtctgaaagcagacggggctgcggccc

SEQ ID NO: 81698 - DNA, 1080 bp, Homo sapiens
gcaagtacggatgtggtgagaaggacccggctgagggatggagcctcagttttcctggggaccacagcagggccccacaaggggtcgtatgtgcagaggattctgccatcttcctgggggtccctaggcccaggtcctgagggaggggctgtgaaggcctgaggacagcattcctgccctccctaaccacatcagggtcccgggccgacctgccgtcggttgtacccctccccaggcacagactgtgactacatccaagacttgtgcaggcccccagccccaccccgccttgaatgggggcttagggtgaccagtgagggaggcagtgtctgaacagggccctaaggagcgagttgacctcagttctagttggagagactggccagtggtcagtggagtctctcggtggtgggcaggcagggagatcctcagacacctcctgcccagcccaggcttcttcccagggaggtctgagggtggggtgacactggggaggcacagacgcaggcgtcctggacaccttctccctgcaccacgccagaccccgtacttctggacaagtaccctgaggccggctgcagagctggactatggtgagcaaggggacggctggccccagacaagttcccaggactgggggcctcagggtgatgccgtgaggcagggcagagctggcccctctgcaggctgtccctgttcttccagccatctacctggccaagaagaacatccgaaaacgggggaccctggtggattatgagaaggtgggaccccccacccttcccgccccggctgggtacagctggaggaacccaagcctcactcacggccccccggggcttcacggtttaccccagaacatacagcccaggccccaaaacccaagacagtccccaaccccccaactgcccacacagtctcactgggggcaggggccggggtgacccactggaaacctcgctgcccccaggactgctatgaccggctacacaagaagatcaaccacgcatgggacctggtgctgatgcaggcgagggagcagctgaggtgaggccccgccctgccccgccccgcctgcag

SEQ ID NO: 81699 - DNA, 1047 bp, Homo sapiens
cctagagggtcagtaggtttgggggccgccgagggccctagagggtcagtaggtttgggggccgccgagggccgctgctctctagcaggtagcccctgaccctgggctgccctcatctgaagtcttcgctcccccgccctttggtctccgagtcagggagggggcccttgtggacatctgggccagaggagctgcaggcctggcggtctctggaggcccctcctgaaggtctgggtgcggtgcggcacctccccaggccgccctgctctctctgctcgctctctccctgagcccccagaggcttcccttgagtccctttggatagtgggaggtacagctggccagagggggctccagcctggtgctcgaatgccagggtccgctagtggctgctgctcacgcccctccccacccccagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtgggtatggcaggggtctaggcttggagggctgggtctggggggctggtgaggagcctggtgggggtggggggcatcctgcagacttccagtttctcctcagacccaagcctgcccaatgtgcaggtgaccaggctgacactcctgtcggaacaggctccggggcccgtcgtcatggatctcacaggtaactcgcaggatgctgcaccctgaacacaggtagggccctcccaggcacgcttctgcacccctgagttccgagccctgggccatcacagtcgcacacctcatgggtaccacaccctacgtgggggctcctggagcaggtctcagcctgtaggggagttccgaccctagctgaggtttccccaataggggacctggctgttctgaaggaccaggtgtttgtcctgaaggaaggtgttgattacagagtgaagatctccttcaagg

SEQ ID NO: 81700 - DNA, 1050 bp, Homo sapiens
cgtgcagccagccttggaggctcccgagtgagcactgggcggtgagcagagggggcctgaccccaagagcctggcagagcctggcgggtggttcccaccgtccacaagccactgtgcaaacaccccatgactgcagatgtggtgctgagggagggccccagttggggtcacctccatgacggggctcagcccttgggaagcagacaccccacacccgtccacttcccccctgcaactcctgagaggctggggcaggtactcccagggggatgtggggtgctcccagcaggcagtgaactcaccccccatggctgcccacttcacccacatgtggtcattgcactgttcactgttgccctgggagggggcgcacatgcagtgggggccgtggggcatggacaggaggctcctcgggatggggtgtggacacgccgtcccctgccacaggcctccttcccatctgcggtgctgcctgctcactgccctcctcacctccgtcctgcagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctgggtggggcccaggcccggatgcagaggcctgcagggcctctgtcaatt

SEQ ID NO: 81701 - DNA, 1045 bp, Homo sapiens
agcacagacagggcatgaagtccaggctgcgttcctcacatttagaccattctctttgtcctgccaggtgtaggtgagggtgcactaggttggaagtcgtggaaacccacccacctgagcccaaccctgaagggcactgttgaggcagagcctcaggtgtgccttagggcctggcacctttgctttgtgccattctgactttgcctgcctggtgggcgacttcgtgggctttgtgttggaggtggctgctgcagtgaccttgggctctgggctcccttgtttacagatgcttcccgcagctctgacggatgggcccgctgttgctctgaggagggcacgtgtgccgctgtgtcccgtctgtctcagcacagtcacggtgcgtgcgctgggggctgtgcagcagggtcactcctgaaggaaagtgggttctccacccagacagacggctgctccccagtggggagctgggggcagtcctccaaaggaaggctgcgggtaatgcaaagggaaaaggagagtgggtactgaacaggcggctggtgagcattgctaccacagcagggcctggagcttaggcctcacgtgttaggggatgcatatcctgtggagagccggttagtcgtcccggtgtgtccggaattggtgggttcttggtctcactgacttcaagaatgaagccgcggacccttgccgtgagtgttacagttcctaaaggcggcctgtccggagtttgttccttctgacgttcggaggtgttcggagtttcttccttctggtgggttcgtggtctcactggcttcaggagtgaagctgcagatcttcgcggtgagtgttacagctcataaaggcagtgtggacccaaagagtgagcagcagcaagacttactggaaagagagaaagaacaaagcttccacactatggaaggggacccgagcgagttaccactgctggctcccgcagccagcttttattctcttatctggccccacccacatcctgctgattggtagagtccagtggtctgttttgacagggcgctgattg

SEQ ID NO: 81702 - DNA, 1231 bp, Homo sapiens
ttttgtatttttagtagagatggggtttcaccgtgttagccaggatggtctcgatctcttgacctcgtgatccgcccgccttggcttcccaaagtgctgggattacaggtgtgagccactgtgcccggcctattttttttttagagacaggatcttgctctgttgcccaggctggagtgcagtggggtgcgattatagctcactgcagccttgaactcctgggtcaagtgatcctcttgcctcagtcttccaagtagctgagactacaggcatacgctaccatacccggctaattaagaactgttttttggtagagattgggtctcactatgttgcccaggttagtcttgaactcttgggctcaagggatcctccagcctcagcctcctgagtagctgggactacaggtgcgtgacaccacgcctggctctgtggatccttcgtgcttccagccgtgagcagctgttggctggtaaagtgtgtgcaatgtgaggaagttggtgtgggggacagattccacatagacaagggacagcagtgtggagtggtggctgggggatagatcccccttcagttggtcctgggttttagggttttatttgtttgctgtgacttgttcagcactctaggcttttgaacccaacatgcttctctaaagccctctctccagccccttttagccaggaccacttacatcatggcaggctgttgtttcagtcacctgcatggccgggttgacaggcatagccagagctcctgggctcctgtaggacgtggcaggaaggaccatagaccatggcaggggttctgttggagcccttatctactctcttttgcacaccccttgcaggcttgtagcagcagcagcagtagtagcagcaaattctatagttccctgatgtctaagagggtgggtggtttggttttcagcttaaggagtgaagtcacatgaactatagcttccttagctaaaaattgtatttgcatttccttttattctgtaccttctctgttccttgaagtacccatttactatttgctatctgaatcctcatcagagaggcttttcagagtcaagtgcagcattctgacagagcattttaagattgtctccagtgacggtgtccgagcgcctctgtgggcctgggtggtgtccttgatccctcggtcgatggggctgaaggtgacccatgattatctctctttgaggcgtgtgttgagagtcggagga

SEQ ID NO: 81703 - DNA, 1032 bp, Homo sapiens
agtgctgggattacaggcgtgagccacctcacctggctttggtttcagttttaagatctccattcagggacaaggatgggaaagcatgaaaaacagactgtttttgtttgattttcagctggtgttgacttgtcttgggtttctagtttcagaaaagctaagcagactttttcggattacattggtcattgagaatttcagtgatgggggaataaattacatgtgaaatagtagccctgaaccttcaagagttaaatcaatggacagctgggaagatgtcagagtcgtgttgtgttacttgcctcctccatgtaaatcaaaatgtcaaaagttacgtttgggtaaaataaatacctacacacgtaggtagcattgagtttgctgccatgatgcctggagcatatgcctaagcggtgacgaaagggaattttaaatacagtatcatacttgtaggcatcccgcccgttttatggactcactttattgatggtagctacaggctgtgggccagattcagtgcttgcaggcatttgatactgaactgagtaaacgtgactgctttatgtgtggtgtgtacttgtgtgtacactaaatgcttggtgtgcttccctgtgggaacccagagatttcaggaattgggacatgtttcaacaacatcagtagcttgtagaggggttcatgtgcttccagggacaccaaaaagtcttctgtcagttgacagccaaaaatacacatgattgtaagaaaattttcttctgggctctgaaaatttggttcacacatgaattaaaacattagttttggggccaggcaaagtggcctgtaatcccaacactttgggaggccgaggcgggtggattgctttgagctcaggagtttgagaccagcctggccaacgtggtgaaacccaaaatacagtaattagccgggcgttgatgactcgtgcctgtagtccccgccacttgagaggctgaggctggagaattgcttgagcctgggaagctgaggctgcagtgagctgagatcgcccca

SEQ ID NO: 81704 - DNA, 1041 bp, Homo sapiens
caagcccacacgcagcgcccgcaccctcaccctcagaccctctccgggtgtcccgaggaagggtcaggggaagagacaaagggagcagggtgaggcaggatgaatcctgacggacctcggaccccaaaaccgccccggtgggtcttccacgtcaggtttcacatggaggcggcatcaaagacccccgactgatccaggccggcgtcccggccgccactccaaggttaggagacaagccatgtcaagtcggtgccgtttaagcagcattttttcgaggagaaaaaaaaaaaagaaacagaagcgatataaagaaaaaaaatgtccacctatgacacgggaagcggccagcccgatggatcagaagcgccaaatcccattactcgggacttcagggacaggccctgcaagggcagctgcgattaagagcttgtcaatggactctcctttagagatcaaagcggggcgtgcttgtgtgtgtgtgcgtgtgcacgtgtgtgcgcgtgcacgcgtgtacgtgcaggagcggacactgtggggtgacagcacagaggtcgtgcaccgcagcaccacggggcccatacgtcgccgacgcggccacctccacactgcttgcgtccttgctgccgtgtgcgacgtgtgtggacgcggctgggggcctgggccgggtacctggtcccaacacctgcaccctttcaaaggcctccacctcctgctagaggccgtgccttccccaggttctgcccagaggagcccgcaggggccgagctgggtgtgaggacagccgtggctgcgtctcctccccccgaccacgtcctgctgcccacagaggccttgagctctcagttggcctggcaggcgcgccctgggggttcaaagctcccgttgacacgattgttaggttattaggtaaactctgagacgtaaatcttttaatccactgtggctaatccggttcacttttgtttgccacgacagacgccgcggcgacaaaggggcctggggcccagcacacacagtcacacgctcagaacttggccgcgg

SEQ ID NO: 81705 - DNA, 1144 bp, Homo sapiens
tgtaactccagccctctgctggccccaggcacgggctggattgtgtggggctcccaggctcccttgagtccctgtccctctgacacccaccagccacccaagctggaaccctggccacatggccacacccagcagcctgggctcccgtgcggtcctggctccctctgccgcagcgccccgcagccctccctaggcgggctccagccttggaccatcctccctaaccactgcctgctgtcctgggatggtgtccctacccacatcctgtccccagacaagctggtagctctgagcatggcatgggaagggcttcaaggccgggttccatcctgggacaggcggctcacaaccaggccagtgcgaagaagcttggatccggacccagagtcctgggggagcagccgcggcccgagacccccggcgcccagagtcctgggggagcagccgcggcccgagacccccggcgcccagagtcctgggggagcagccgcggcccgagacccccggcgcccagagtcctgggggagcagccgcggcccgagacccccggcgcccaggcccatgccaagcccggttccctgggactggccccgaagtcgctctcttgaaggtggatccccatggaccatgctccaggctcccctggatcccgggtccctctgatggccttggtagtggcctccctgggctgcagcagcccaaggctctcgcttgctccttgcagtcctgcagctgttcatcaccagattctgctcatcgggtgctgggcctgggccaggaagtgggactcagcttcccgggcttaggggaagccttcgaaggggtcttggccaggcagtgctgctgtcagagcgcgtggacaagccaacactgtttctggctgtcacggggctgggggcagggggtggttccggggatgctcagtgccctgcagtgcccaggatgtccacgggtgacggttgagaagcctcgtctccagacatacgggaaagctttgccaggggccaatgctggtgcgccctggagggaagaggcgttcttgggacgcaagagggcactgcagcccaggggagagcgggtgcagccgcaggtgtgtgactgatggcgagacggtctcctcagtgtggccaaagacccagagtcc

SEQ ID NO: 81706 - DNA, 1053 bp, Homo sapiens
gggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttacttggagaccacaggtgcctgtgcgagggtggggctgtgtgctctgctggcctgtgggtggctagagatggggagaaggactccctatggtcctgttccctggcgaggctgtggtgagacccatggcgcccaggagccctgagcccaccactggggccgggagctgtggactccgagacccctgctcctggcccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttccct

SEQ ID NO: 81707 - DNA, 1054 bp, Homo sapiens
gtcttctgtgatgccacacggagatgcgggtctgagaccccgcaggcagttgtgagggggcagtgccagctgtttggaggatgccaggaaggaaggtggtaggcaggggaggccaggccccctgccttcgagaagcccccacccatgctccctgggtccttggggccaatgatgctttggggactctctgtggcagctggccctggcaaggggagactcatgccctgggcttgtgagctgcatgctctgccctcccatctgctctgggaactgcaggctgggtactgccccaagggggtgcccatgggagccccacagccagggcagaggggaggctgggaagcaccagggtcctgcagggctgagtgcggggcctgaacctgcagataggcagagaactgtaggctgtgggcagaggtgtctgatggagactggggggtgggagcccctccccatggaacagtgggtgggagactgaagccaccctgatgggggacttctagaaacccagtggtacagggggctagtgagtgtgtgggtgcagagcggccatatgcgtctgtccagtttgtgtgagcatcgtctaatcccccagagatgcctgcctggccacattcacctgtggatgcaatacagaagctgaaggaggggcatgtccctgccggctggcagagctagtcagaggctggcagagctggtctgagggtggcagcagctccgagggggcaggcagaggtgctgtggggccgtggggtacgcgtgctcctgctgggccttgagccctcagagacgtccctgcagtcatccctgtgtcttgcgcaggtgctgtttcttctgggtacactggtcatcgccatgtccttgcagctggaccgcaggggcatgtggaacatgctggggccctgcctctttgccttcgtgatcatggcctccatgtgggtaaggagccgggctggctggcactgctgcccaggtgctcggagaagagagcctggccccttgctctagccacgttcctggtcctgctccaaccagtgaatgcccatatctgctg

SEQ ID NO: 81708 - DNA, 1046 bp, Homo sapiens
gccagcagacacctggaaagcctggagtgcgtcgtgggtggagcctggccagcccctgcccagtcgccacgccaggttcccctggagcttggcctggatttgccgacaggctgctattggcaggtgtatcgtttcttctggtgcctctatgggagggtcacgaggctggcaggagagcctgctgctcacctgtctccctcctcaggaggggcctgggcctgagccagccactctccagtgagacctaggcagcgctcctgagtgtgtggggagggggagctgcagcagaggggagggtcccgccccctgctgtgtccactgtgcttttccttctgaagcctttgtcgttaattaacctcggagggaggggcccccaaagggatgtgccctccgccctgacctacccaggagaaggctgggacccagggagggaaggatgcccaaggtcgcaagggcacgaggctggagctggcacggggggctgggggtgagagcctgagtcctcgcctggggccatgagcaggatgtctcccacgggcccttctccatccccgcaccaggcgtgggtgcgttccctgaggacagttaggagccttgcccgcttggaacgcagagggcagctgtccccttgttctcatgactggccaggcttctggcctgggtccctcccacatgcagtatctccctctgggtaaggggaatttgggctccggtctcgccgtgtccaaagtcatcatagcccaagcaggcagccaacccatccagggatggagatgtgggaggctgagaggaggtgggaggaccgtgccttgatatccagggcatctgtgatgaggggcgggggctccttcctgacacctgctgggtccttcggcttcgacctgggttggccatggggagtgtagtcttctaaggttggagggggtccgggtggcagtgcgggtggggatggcagtcagagtggcgatggcagtgcgggtggcgatggcagtgtgggtggcgatggcagtgcgggtggggatggcagtgtgggtggcgatggcagt

SEQ ID NO: 81709 - DNA, 1050 bp, Homo sapiens
gcggagcccacgcctcggggagaatttcctgcgtgttccgagcgcgcccggcgcgacctctccgtcctgggacccccgcgatccctccatcccgcgccctccctccagcgtccccccggaccgcgcgcgccccggtccgtcccccgcgcgccccacgtgacccctcccccctaccggcgccccacgtgacccctccccccggcgtccgcgccccccccggtcccgccccccgaccccgccctcgccttcccggctcggcctgcggggcggggcctgcgggcggaagtgcccggggcgacggcggcggggaccggccgggccatgggcgccgggggcagaggcggaggcggcagaggcggaggcggcagaggctgcccgggcggcggcgggggccggcggcgcgggacgcgggccgggtagcgccgggccgagcgcggagccatgggccgggctggcaccgggaccgggggcgaggcggtggccgcggtggtggcggggccgctgctgctgctgctgcttgcccggcccccgcctgcctccgccggctacagcgggaagagcggtgagcgggaggcgcgggcgccatcgggggcgtggggccggggctgcgggcggggcgggattgtgacaccccgggcgcacctgtgcgctcatctggcgccggcgcggggttgggggtccccgccgcgggttgggggtgcacagtggccctttggggcgcttcgtgtcctaggggtcgaggcggacgggaccccgcgcttcctcctcggtcccccgatcggggttgggccacatcggcccctggagcgccccctcccctccctcctcctcccagagcgcccaggtccggcgcgcccggcgcggggaagtggaggggcccaggggactctgcccgggactccagctgggaggagtggctgggccgtgagctcaccggccgggtccggcctgagagaggggcagagccgggagaaagttgttagaccctgtagcgggggcccgtgggcgtcatggctccagcccttccgcagtgacccccagccctggtac

SEQ ID NO: 81710 - DNA, 1089 bp, Homo sapiens
gatggtctcgaactcctgacctcgtgatccgcccgcctcggcctcccaaagtgttgggattacaggcgtgagccaccgcgcccggccccggacccttctttattggcctcaaaacgggtcattttgggaagcggcgcggggctggccgcgcttccctgggccccggccctccccatggtgtttacggggaggcgaacggggagcccagaggctgcgagcctggcctggacccaggagccaggggtatcccacaagtcctggaggctctgaacgcggcgctgacgccgaatacctgtgaaaaagactcggggaggagacccgcagaccgccgagcttctgccgcgggaaccgcgcccccggccccgcaatgcgcctgcgcctcgcgcgccgacttccagtcccagcaggccgcgggcgggggcggggcctccggggagaattcgggggaggggcggggcctccgggaagcaatcagggcaggggcggggcgtccggggagtggggcggggctcccggttccaggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcggtgagcggggcctgggaagcgagcgcagccttggtgcggggtccggtccgcgggcgccggcgcccccacgtggtccccgagggctcgcgtgttaggaaacctgtcttgcctggctcctttctttcttttttctttctttttttttttttgagacggaatctcgctgtgtcgcccaggctggagtgcagtggcacgatctccgctcactgcaaactctgcctcccgggttcaagcgattctcctgcctcagcccggctaatttttatttttagtagagagggggtgtcaccgtgttggtcaggctcttttcgaactcctgacctcaggtgatccacccgcctcggcttcccaaagtgctgggatttacaggcgtgagccaccgcgcccggcccaacctggcctcttt

SEQ ID NO: 81711 - DNA, 1071 bp, Homo sapiens
caagcagtcctctcatcttagcctcctgagtagctgggactataggcaggcatgaccatgctccgctaatttaaaaaaattggctgggtgcagtggctcacgcctgtaatcccagcattttgggaggctgaggcgggcagatcatgaggtcaggagacggtgaaaccccgtctctactaaaaatacaaacatttttaaaaattatttttgtagagatgaagtatagtatagtgatactgcccaggcatattattgaactcccaggctcaagcgaccgtcctcgggcctcagcctctcaaagttctgggattgcaggcatgagccgtagcgcccagcctggcatcgccttttatttgccctgtatcatttccagtctcttagccttgaatttgagtgaaagtgtgtgtgaatgagagtgagcatgtgtgtgtgtgagcagttacatatgtgagctggtgtgtgtgtgtgtaatatgtgtgtgcggtgagatgtgtgggagcatgtgtctgcaggatcagggatgtgtgtatgtgggagtgggatatttgtgtgtaagtggcatattatgtatgtgtgtgagcaggtgagtgtatgtattctgggtctacatgctgactgaattgctgaaaggcaaatgaagcttgggttgtataaaacagaaaatgaccaataatcccactatcctgagaaaaataacattcccattattttactacatttcttttcagactttttttttttttttgaaatagagtcttgctctcttgcccatgctggagtgcagtggcacaatctcagttcactgcaacctccaccacgtgggttcaagcgattgtcttgcctgagtctcctgagtagcttggactacaggcgtgcaacgcctggctaatttttatatttttagtagagacggggtttcgccgtgttgactaggctggtctcgaacaccagacctcaagtgatccacctgcctcagcctcccaaagtgttgggattacagatgtgagccaccgcacctggcccagaccttttttaacacagacatagacacacaggtgactgtctataaaa

SEQ ID NO: 81712 - DNA, 1040 bp, Homo sapiens
gaggtgcaggggcgttggaggaggtgcagggaagtcagggaggaggtgcaggggcgttggaggaggtgcagggaagtgagggaggaggtgcaggggcgtcagggaggaggtgctggggcctcagggaggaggtgcaggggcctcagggaggaggtgcaggggcctcagggaggaggtgcaggggcgtcagggaggaggtgcagggaagtcagggaggaggtgctggggcgtcagggaggaggtgctggggcgtcagggaggaggtgcagggaagtcagggaggaggtgcaggggcgtcagggaggaggaggtcctggggcgtcagggaggcggtgctgccatggcattggacacatggcctctggggctgcggggtctgctttacttttgagtaatttgatgtcatgatttatgtttcgttcggaaggagagtgaaactagaataaaacgaagtcgaagatgattttggaattatttcatagcatttagaagaaaggaaaatgtgatcatccaaaccgcacttcagccaaagttcacttcaggtgttagctccatcgtggctgcagcagcctgtgttgtctgtcagccctgtctgcgtcgaggagtgaccagcaggatgtgctggcctagtttgctgggaagcacaaggaggctttcctgtcacagccacaggccttgtttcaggaatagaatgagatagagagggattgttccaaataggccattgctgtgtctcacacaccctcacgctttggaagaataagggaaacgcacgtgaaaaattcctaattaattgaaaattgttttagtttttataaggaaaactaatatgagaatggtatttaggtcctaccaagaatataaaaatgccatctgtgttcatatcccctgctccgccctctggggcaagaccctcagattgtttgcccactgtcagaacctgagctgtcatgcgctgtgtccaaaatgcttcgctgtatattgaaagtttttagttctgtgtttcagtgtttataagcgcaggcaagactgttagcatt

SEQ ID NO: 81713 - DNA, 1095 bp, Homo sapiens
gtggcctgttgagcacgaggtcttctccctgcagatcctgatggccagtgctacggtggtgtcgcttctgcccaagatgaggagcccctggcctgcccggacgagttcgatgacttcgtcacctatgaggcaagtggttttcacccaggagcttgggggaagtctggcatccacctcttcctttatgccctacagctcgtgcctcctgcctccgggctgtcttccgtagaagctggcgtgaaggaagggcctcccgccctgtgtgcaccgtggggctctgtggctgtgacgggaggcccacagttgtctgtcccacacgccctgtcagcctgggcaggaatcctcccccagggcctgtcgccagcagaagtggggtgggcagtgatgtcatgaccacccgctgccaggctggcaggcacaggcggagcagagggcttgggaggattccttttgtcaacttgcaaatgattttctgtgtttggggatgcctgactaatgcctgcccctgcttggctgtcctccaccctgctcccagatgcagccagggttgtcatggtgacgtggcgtctcctgtgtctcctgtcactgtgggtcccttgttctcaacatagctggggagagggtcttcgagcacagccgtggtcgacagagcgtaaccatgtccgccggtctggagggttagattccaggagagccacgtggctgcagcagaaaatgcatgaagttgaacttgagcccttgggggccgccgggaaggtggaggtggcagccgccagtcctggtcagcctgctgccgagcaagggtaccagaagtggggctgagctgctggccggtagggcctgggcttctcatgtcagtcctctgagccctgactcctcgaaagctgaggctggcacagggtagtttttgagttgcttttggacgccactgtaccgtgggagccatggtattatactcagttccctgttccgagaagctgccccagggattagtcaccctcacccttgggtgggcagcttaacttctgcccacacagaccctgggggtggttctgccttacggcggtgtcccagttatcagctgggctgcagctt

SEQ ID NO: 81714 - DNA, 1089 bp, Homo sapiens
gatattgcacgactgcactccagcctgggcgatagagccagactctgtctcaaaaaaaaaggtaaagaaacagatttatttatttattttttttttttgagacagggccttgctctgtcacccaggctggagtgtagtggcatcatcactgctcactgcagccttggcctcccaggctcaagcgatcttcccacttcagcctcccgagtacctgggactacagtcgtgcgcatccatgcctgggtgatttaaaaatgttttttgcagttgaggcctccccctgttgcccaggctggtctcaaactcctgagctcaagccatctgctcgccttggcctcccaaagtgctgggattacatgtgtgagccaccgcatccagcccactttttttttttttttaaacgtggctcccaggactcacgtgtggcttgtagcacaccctatggaaagcaccttccacaccctcagctcgggggtgccctggccttcagtcagaagacatcatttctgttttactttgcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccaggtaatgacgccttgttccagcacaccctcctccctcttcttcccgtggttagtagtgggaagtttccctttttggttcgtgcattggtgagagaacttgctttccttgacgtcatgtgattaagtaaaccatattcaaacattttaaatttatacctggatttatgaaagttgggagaagtccctcttctccagccacatccccagatcactctacatttctgaggcttcagcaaaatcctgtggcacagagctgtgtttgcacacttggcttgcgggctcctttgctgtgggccgtggatcacatggtggtctgtgcaggcttttgagggaggcctcatgatcataagtgagtcttcagattcatttccttataaatatctgacatccccaaactggaaagctgtgactctgaata

SEQ ID NO: 81715 - DNA, 1021 bp, Homo sapiens
gagcctctcaggcagcgggactctccctggggccccgcctcccaccctgcacgctgtggggccaccagggccctgcctcctcccctgcatgcgcagcccaggccagtgcttgtcttggtgggaggaagtgatcggtctttgcaagctgtgctgtctgtcctgtgtgtgaaagaggatactttctgcattttactaaaagatttctttcattgagctcatgagacagaattgggaaagttaaagatttagtctttaagaacagatatgtaaacagctttcaggattgtcagtttaaatggagttttgaatactcacagtgagcgtgtgagggagctcactgtgtctcagcaggggagctcttgtggctggccctcatgtctaactcccagttacagaagacggttttgagtgctttgcacatattgacgtgcccgttgggcatcgtgttgatttcgcttgcggtgaagcccctgggtgggcagctctccagaagggtctggtgaagaaacgggccactttggagctttccacagcagccctagcctagcagaagaggtgagtgagcatacaggctcatgctggcaatctgggacggcttcctgaagaacgggacctggcctgtggggagggtttgtaaaggtggcagaaaggtgagttatcctgacggttctagcatgtttagaggtatctgtgaaactgcttacctgtcttgagcctgccctgtccctgccccagggggcttctgccgaggcacatccttgctggcgggcgctcactgcccacggccttattgaggcttctgtcctgcctctagttccatttccagggcacttaactcttcttatgttctgtgaaatgctgtgaagcacagggcccccagccagtgcccattcaggtggagaggatgggggtggggcccggcactgatggccattctggagcatcgggggtcttggcagcactggtgagaaagcagaagtgctctttgaagagggtcttcccgggagacccgaggccgccc

SEQ ID NO: 81716 - DNA, 1906 bp, Homo sapiens
gagcatgatgcatcagtgcctgagtcgaagccagcggcaaactctcctgtcacagcggggcctgggtcacttttcacttgggggcctccgaaggccaagcgtttgggggtaatttggcttcagaagcattgggacagtgcagccagcgggtgggaccaggtgtggcgctggcctctcagtcgtggtctggggtggctgcatctggaagcctctttgggggctggagtaacgagacgtatgcggcctcaccccagcactgccgtgtccttgctgttttgctgagtgagcatttgtgcatggacttgcctggggggccctgcatgccgggagcattgctgaaaggccgcccacctcgtatctccacagcctgagtttcctgcttcctcctgctcctctctgtctgttctaacaattttcctgtttattttgttttctgcacagtccgacaaagcggctctccagcaagaaggtggcaaggtaggtgggtctctggttcctgctgaaaaacgttctgaagtggataattaatcatagttttttaaaaaacattttaaaatgttcttttccaaggtattttttaaactcttgcaagttactttacatggtttggggctgaaggtatcctgaaggagtgttgggaaaggggtttccagggctgtgaatttggacctggatttgtgaccagggagggtacgtgtcagagcttttggtgctgggcctcttgtgtgttcactaaggtctggaaggggccgccatccccagatgtctgctctatgttagctctgaggtagcgagacccagtgaggagcctggcttctcagagccgggtctgggcagctccccaaggtgagtcgaaggtgagggatgggtctgactccaattcctaaagaccatttcttcattttccagcttcgtatagatctgttggcttcctgctgtgaaagatggcaacatacacttttatcttcctcccctgccagttcttaccgaaataaacatgcagggttaaggcccttcccagggagccactcagtgtggctgccgggtggcctctgctgccgtcagagtctgcctttgtgtctttatctgctttgccttcctagtccccgtcctgcttcgtggcccggcatctggcagggctgggagacgcctctccagcttcctctggagcatcccctctggagcctcctctctgccctgttgtgccgggcgttctccaggcctcgtggctgtggtcctggacaggtctccccacactggtgggttcctttgtttcgggggttggatcctctagctccctggccccgtcttccttctcatttgttttctctggtttttgtccagcgtatcttcctgtagcttcttgagaaaagaggtgctcaggagataaacttgagcttgggttggtttgtactgtgagagtgggatcattttcctgtaagatttttgacggcattgcttatcttctagagctaaagttgttaccatgaagtttaacctttctgactcggtttctttgggaccagcctgagcaacttagtgaaaccctgtctctacaaaaaaaaaaaaaaaattaaaaattaaaaattaaaaaaaaaaaaggaaaataggcaaggtctagctgcgttgcccaggctgtagtgcagtgagtggcaattcataggtgcaagcatagctcacaacagccccagactccctgggcttaagtaatctttccacctcagcctcccaaaattctcggattacagaggtaagccaccacacccagccaagaacagaaaccttttgttttccattttcttttattttgagacattgtcttgctctgtcacctgggctgaagtaccgtggtgcaatcacagctcactgcagcctggacctctcaggctcactccatcctcccacc

SEQ ID NO: 81717 - DNA, 1891 bp, Homo sapiens
agtggctggtcccctgtaatgctgcatctgtgtgacagcctcaagccctgctggctctctctccgggcacccctcacttgcttcttgccctggccttgggcagcactccggtaaccccagtgccacaggtgaggaaccgaagctggagacagctgttcatggcaggggaggggccgagggaggctgagcgcctggtctctccctcctgctggttccaccagttcacacgaggcaattggagggaaggattctgctgcccggaaaatcctccggaaccacaggtgttgttcatgggcctgagccgctcagtgaagaactcggccgttggtggccgagttgcccctggtccagccctctggcccgcggtgtgatgcctctactcatggcaacaggcgtggacaggtgctgagaaggaggacgacatcattaaacaaaacagcttggggtctttgaaaaacagtgacagaaacccaggaaggctggtgacttgtcaggtctgtgtctgtcctgggtggccactcggccctggaccgtgaggctgaaatgacaggagacacggagggtgggcttgggtggtttcctcataagacacagaagaaggaggcccccaacccgggggctgcctcgtgcgctttgctctcctgttttcctgctctgtccctctggtcctgccctctgacccctggcacagcaggagtgcccagaagcccagtgggacttgttctctgcctaaagcccttccgcatccctcgtacccactcggtgtggatgtgggttttctcaccaccaggctgtgcctcagctgtgtggagccactggcctctcatgccccacgctggagagaacgctgaggtctgtgcggttctcatgtgaccctgtagctggtccctggctccccactgtgggatctgcctgcagcacttacacttgggaccgccctgtctccctgctggatgtggcgccgagggcagggtccgtttctgtttcttggtaggcctagtgtctagcgctatgcagccgtgcgcagagcaggcggtcagtgagcacctggggttggccctcaccacaggcagttctgaatacctgggttctggcagcccagggggactcctgcgtgctccaggaaagtagcacagcagcccctgtggcgtggacacggccacacctgagctcggcctgtttctgagtctgagagaacaggcttgctggcctgtgatctttgcatgtgtgtctcgctgcagggaggctgtgggttggggctggacctagacccgttcagccacaccctgtcactatgtgggtcacacacagctgggtggagacctcccggtgcgtggcccagggaggtgtctgggcgtggagtctgtggacagccacattgtaccactaggacaggggctgctgctgggcccacagggtgcacggaatggggtctgtgggaggatgggggcatcctagcccagggcagggaccccgtgggccccccaagatgagctgcgtcaggctgttgctttgcacactctgaggggcctgcctgagtgctgcatgggaagccagcagtgtggccgccctccccagaactcatccagggcaccagggtggacccatgagtcccgtcgggtcatgggcatcagcctcgccatcctggcctccagatacaacgatttgtcagattccctgaggtcaaagggaagcttcaagggttgccatccccgcctccctggcggtcctagacgggatgtcaggaggacgcagggccatcgctgctttttaaatgtcacagtgactgcagcgtctgctcctctgtggaaggagcttgctccgctaatgagggagttcctcctcatggccttcccctcacttctcttcaaaaagttgccctttattttaa

SEQ ID NO: 81718 - DNA, 1031 bp, Homo sapiens
ccgagatgcacgaccttcacccccctcaaccctccaccgtggccaggagggccccgagccccgtctgatgtgccgcaggaggcgagggcttcccaggggcagcgtggagaccccgctgaagtgcgaggtcgggatgtacccgtgctccgccctctagagtccaggatggcatcacccacgggtcaactggggcgcagcctgcaccctccccagcagggccagggccagagtcgtgctgccacccactgggggctgcgctgtccccctgggcccacacgtcccctgctcctcacctgtcgccagccggtggcctctccactagggctgagggcttcctcgacacagggccggcgccaggtctgtggctgtccacgctccacccgtccctttggggctcaggcagtgcttttgggcgctctcctgggtggggtcttgtccctgccaggtggagcgaggccaccctgcccagcctgagcacatggccgtggtctctgcagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggtgaggccttctccaaggccggggtggggcgggtgggcgggcgaccggccgcggtccccgcgaggtcaccctgaggctctgcgcaggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggtggggcggcctgcagggtgggcacgggcggcaggggcagcctctgaccccagcc

SEQ ID NO: 81719 - DNA, 1048 bp, Homo sapiens
ggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaatcacgcctcctcctcctgctgttgccccgcgcagggccctgtggaagggcggggaggttgcaggtctgaggggtaggccctgcccaggcatcccgggcaggcggacgggtgggggcccctggagatggccgtggtggggtgactcacaagcttgtaaggggcagccggccctgccaaatggacgcagccaggaaggacggagtgactgggcgggggcaggggtcagaccctgcggccgcagccccagggccgggaaggactgggcagacgggacagcagcgcatgcagcttcttccagcgaggcatccgcacggggggctctgtctgaacccatcagtcacccggcaggagcaga

SEQ ID NO: 81720 - DNA, 1027 bp, Homo sapiens
tgtgtgtgtgtgtgtgtgtctggctagcctgtgtgtgtctggttagcctgtgtgtgtgtgtgtgtgtctggctagcctgtgtgtgtgtgtgtggctagcctggcgcccgtgtgtgtgtgtgtgtctggctagcctggcaaccatggctagcctggtgcccgtgtgtgtgtgtgtgtctggctagcctgggacccgtggctagcctggtgcccgtgtgtgtgtgtctggctagcctgtgtgtgtctggttagcctgtgtgtgtgtgtgtgtgtttgtgtctggctagcctgtgtgtgtctggttagcctgtgtgtgtgtgtgtgtgtgtgtgtgtgtgtgtctggctagcctggcgcctgtgtgtgtgtgtgtctggctagcctggtgcccgtgtgtgtgtgtgtgtgtgtgtgtggctagcctggcgcccgtgtgtgtgtgtgtgtgtgtgtgtttcctcagtctttaaagatgctcacgttgctttctcccgtcccatacctcctctgctatcgatcgcttctctttcatcttcctctggctgtgtgatcccagcagctgctagtgcaggcttctttgtgccgccgaccgtcccagaggctgaggtgggagtgtgatgggcgtttgccccacagtacgttgagttttctctcactactcgacagagaagagtagcttctgccctcccatctccttcggtagacacaaggcactttttttttttaaggtaaactttgtagatgaagcacaaagaatacacacaaagaaagcgcacagatcgtgagcacgtagctcggtgaatttacccaaagtgagcccaccgcagaaccagctccccctagaacatctgtttactgttagacccattgtgtttcttttccgacgatatctgtgggcagttttccttagtccctgtgaaagctcttccccagcagggcgtgatgggtccctgggctgagctggtgtgaaaggtgggctgtactgggtggtcccctatggtggtcacacagccagacacgctgggccc

SEQ ID NO: 81721 - DNA, 1027 bp, Homo sapiens
gacctcatctgcctggcggaggtgccccatggggagcagctaggggtcacctgcagttgccccctgccttagacccgggggtgcatactctggaagcctggggtgagaagctaggccagcccaggagaccccgggcagctttctgggccctgtcggcggggcgaggccctgggcccgtgggagttgctgctggctggcaggcgcttcttggcaccggctctgggagcatgtggtgaccaggtggcccggggtcagcacctgcgaggaggccaggctccgtgttagtcacgtgcactgtgaggtgggcgcgttgagcgctgcctaccaccacctgggccaccgagggcccctcccacctgccccctgtcctgctgagctcaggagtgtggcctgggtgtttgtggtcccctgcacagtgggggacggtgggaggaggatctggagagggacacatcactcctctccactcccacgcagagtgttcaagctctggcccctgtccttcctcgggagcaaactctccacgtgcgaacagctccggcaccggctggagcacctcacgctaatcttcagtacacggaaggcggagaaccctgcccagctgatgaggtgtgggcctgccctggtctctgcagggctgggtgcgtgccctctggccccttctccatccccctctgcaccacgctgacccctccggccaggcaggcctcctcctgcggccccaggctgtgctggccaccctcatgccggccgggccggacctcccttccaggaaggccaacacggtggcctctgtgctgctggacgtggccctgggcctcatgctgctgtcctggctccacgggagaagccgcatcgggcatctggccgacgccctcgttcctgtggctgacgtgagtggactggggtggagcccggtgtcccgggtgggcgtggggacccctcctgggcagcagagccttcccgggccagagccaccgccccacaaagccagttctaccttctccatgctctggagacacggccc

SEQ ID NO: 81722 - DNA, 1060 bp, Homo sapiens
gccagggtcatgaaacctttcctgtccagggaggcccatgtgcagcccagctgggacttcctgccctgcccctgtgctgattctgtaactcctgtgctgagagccagaggcacagcttgtctcccatctcccaccttccctgcatggtctgtgccccgtttccagccgggtgcagccccctcctctgcagatctagtgcatttccatgctgcctctgggccttcagcttctctgtcttcctccctcagcaccaaagccccgtctcttccattaggagcttgtcttcctgctgggggtggtacctgactctttggcccaccctcgggcctctgtggaggcctccttgaggcctgactgggtgggtcttgtgtgggctgcaggtgtgcactgggcctgcttgtggccaggccaggcctctgggggcagcatcaggcacgtctgtgtggctgtgggggtgcagggagctccagcccagaaggaaggaggggcggggctggggaaggggctcggcagctttgcctgtggtcgtccgcacctgccaccggcctactttgtcctagacctcccttttgcaaaagtgctcagaaatataaatatttaatttaaaaatgaaagtctcttcctgctgccaagctcttatcctttaaatattaaataagctctatttataaagaatgttcttttctcagccgggggtggtggctcatgcctgtaatcccagcactttgggaggccaaggcgggcggatcatgaggtcaggagatcgagaccatcctggctaacacagtgaaatcccgtctctactaaaaatacaaaaaattagccaggtatggtggtgggcacctgtagtcccagctaattgggaggctgaggcaagagaatggcgtgaacccgggaggcagagcttgcagtgagccgagatctcaccactgcactccagcctgggcgacaaaacaagactccgtctcagaaaaaaaaaaaaaaaaaagtgttcttttctccttcttgccagtcctgctgtggctgaggccttggcccaggcttggaaggggcctgcgca

SEQ ID NO: 81723 - DNA, 1041 bp, Homo sapiens
tgcaggtgctgagcctggctgcccccgccccagcgtggcccctgtgtccctgcagcacgtggccgaggagctccagcatctgctgcagtggctgatgggtgctcccgccgggctcaagatgaaccgtgcactggaccaggtgctgggccgcttcttcctctaccacatccacctgtggatcagtgagtgcagggcaggcgggggccccagggaccccagagcttgctgaagagggtagggacccagccagaccccgccccctgtgcccccaactctgctccccagcgtcctgtgtgtgtgaggcctgctgtgctcagctgagggctggggcctgggcacctcccgagggctgaccccaccctgccaggctacacgcacctcatgtcctgtgtgtgtgagggttgtgctgggccgagggctggggtctgagcgcctcctgagggcctaccccaccctgccaggctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggtgggcgtgggcttccccctccccaccgccccctgggaggtgcagaggctccggctgggcgggcgttcgagtggggcgggggcggggcggggcggggcggggccgggcccgacagcactgcgtcctgtaggctgtactgcctgaagatccatggcctgtcctcactgtggcgtctgttccgggggaagaagtggaacgttctgcgccagcgcgtggactcctgttcctatgacctggaccaggtatggggcagggttcgtggctggaggggctgactgcctccggcctgtgcccgctgggccagcgcggtgcttgggcaccacaagggggcagcctgctcccgtcctgcagctgaggccgcgcacaggccctgggaatagataagtctgcggtgtgggctgcacgtggggctctgaagcagcgcag

SEQ ID NO: 81724 - DNA, 1090 bp, Homo sapiens
ggccacgtgggtggcctttcaggaccctctgggcagtgagtgctgcgctctggagtgggcgaggccctatcctggccagtaagacaccctcactgccctggagcacgcagctgggtgcgtggtggaaggaccccacggcaggtggggtcacgcaagaggcctcccctggtgcctggcactggggcagacagtgggaggtgagcagaaccacctccagcacctgcttgattcccaggcctcgatcccctctgcatgtgaggctgtggggaggcacctctgacctggtgagagggccgggtgctccgcctccagctttgctccagagcaaggcccaatggcagactccgtgccctgctcagggtggggtccctgctctccccaggaccctgcagcctctgggcccccttcatcgtggcccaggatggggtcggactgctctgcccccaggcgcgtctggccgggccggtcctaaatgctcctctgccacagctccggctcctggtggtcgccgtgcagggcctgatccatctgctcgtggacctcatcaactccctgccgctgtactcactgggtcttcggctctgccggccctacaggctggcgggtaagtgctgcgtattgggcagctggccctgggtaggtggaggggaaccacacctgtgggccctgcagaagcaaggacagcatgggccactgtgcctccagcctggaagccgtggtatgcatgcgcaagcgggcagggaggacagggcctcctagtcccagaggtctgcaggaccagctgcctccagggaggtggagagagactcagagactcacctgccgcgcaggttcagaaccctggagacctgaggccacaggcctttgttcttctgccttgggattttctgggcttgggagtctgaactgcaggccaggggccaagcgcggcaaagtcagaggcactaggagccagcagggcggccaccatccagtaagtgccccgtccgctgtgccggaaaaccccgtccactcaacagcacagcctgcgcccgtccctcactggggctcttccctgcttgccggacacctggcttctttcagtggagtc

SEQ ID NO: 81725 - DNA, 1034 bp, Homo sapiens
gaaggcccacgcgggaccccctcccccttacccccagggcctgaggacactggtgtggtcctgtggatggggcccattctgccctgtgtcggaggcgcccttggctggctggggctgccctgggccccacagggctcaagttctgggtggaacagaaccgactgagtgagtcctggggtggggtgtgcgtccctgtggcacggcccctcagagttgggcagccccgaggggagatgcagcttctgcctccccccagcgctcccttctggctgcaggctcacttgcctccttgggaactgggactggcttctcccacaggcaagggaatgtctgagacagcactggccctgcctcacaactgcccgcccccaccctctctctgcagacggggttggagctcagaccaccccactgaccgctgcccttgtccttccagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccag

SEQ ID NO: 81726 - DNA, 1183 bp, Homo sapiens
agtagctgggactacaggtgtatgccaccacgcccggctaattttgttgtgtgtattttagtagagacggggtttcagcatgtcggccaggatggtctcaatctcctgacctcatgatctgcccacctcggcctcccaaagtgctgggattacagacgtgagccactgcgcctggcctgaacgtttgtttttaacttccagtggcatggctaaaatacactagataggtggcatcactggggcttgcctgcctgagcatgcctcttaatttaggtggttaacagagtgagtgagacggtgtggtcctcatcccctctcatgggggcctggacccagccgaatgggatgtggccccagatgaactgggagcagtcagcatccagcctccccagagtccatctgcgcttcagggaatgccatctacgctggcgaacttacctctcctggtccctgccctctccccttgctttgtttcttgggctcttgtccgtcctgtctgactgccctgagcgtctgctatttgctgaattgtctgcctttggctgctgagagtgtgggcgcagcatcccccactctctcaactcgggggttggcagagcgtgggattacctggactgaggctgagcgcgcttcctcctggcatggcttcagcagtgggcagcagcaccgggggctctggaagcttgtgctcctggcttcagcctggaggaggggttggaaagggccagggaggaagagctctgtgtccattttgaggtgggggaagtgtaaggcccactggggcattgggggctcacacgttaggcccctgcacctgccgcctcctggtcctgcacttgacagtgactgccccagaattggtaactcctgactcaggtggtgggcggccaagttgattgtgaaggtggcgttgccttctaaagcttggctccaggggcgctgcgcactcccaggaggctggcggcgtgcgtgtttgtgcatgttcagaagagcacgggaaggattgggtttcatcaatcggtgttttcccaggacatgaaggcgtgcttctgagggccggctcagccatgctggccagctcgcctacccaactgcaccacacagccaggagctggagagacaggaccctccttcctccctgtccccttcgtcgggctgtggggcattgccacacttcctctga

SEQ ID NO: 81727 - DNA, 1060 bp, Homo sapiens
ggaagcgcctctgggctgtggaacgcgctttctgtgtctaaggtctcaaggttaagacgtgcacagcacaaggagcaggtctttgtggtcaggtggcagcttgccaacctcaggggccagccctcttcatcagggtgaagttggtggatctgagggtttcccaagggggctattcagggtctcagaagctcaggagcagctggttctcaggactcagcatcttgagaatttattctcctttgaaagagttgtagcaggagctttaggcctctggccctcgtgggaaggacgtacgtgttaacctccattgctttctctcctttgttgggaggtgccctctgtgtttccagcttccgtgtttcttcagggctgcctgctgggcagtgggtgcccttggcagggaggccccttctgtgcaaggcttactgcttcagcatggcccacagctccttcagctcacaccggatcgcttacctgcctggaagtcttgtctggcatgttcctcagacaggtgtgtgagcgtacattgccctctccagcttcacaaacaaatgagtcatcgaagtgacctttttcttagtactggcacctgaggcagtggcgtgtgaccacacgcccagcacctgtgggagcccctgtgagctcttccgtgtctcctaatgtgggtgtgcgctgggtttctggatctctaggtctggaaaggctttcctttctttgacacccagcagtgatcttagggagtgcttcatgctctcttcaggatggaacagagcgctttgcatagagtgcccctgggtgatggtggcgagttacccggcaggaattatgcttcatccaggagtgtgggtggtgcacgcggcggggaggagaaagctgcagttcaggagcgaacctgcagtcaggctccagggtgtgggccagggtggtgggcccgtgttggcccccaggaaccacccgcacagggtgcacacccttccccaagcccagccgctcccgctctgcagggggcatcgaaggtcctggattaaggcagttccaccctcggcaccgtgtccccaca

SEQ ID NO: 81728 - DNA, 1044 bp, Homo sapiens
cactggggatggtgggggacagggtggcaggggacagggtggcctgagcaagcccctccttgcctgggaactcagggcctcctgatatgcagatgggagcccgtggcaggatgatggcaggataaccgtcagcccaaaagaagcggccacgagacgccgccgagagccccaacttagaagccagagtcaccagcttcctggctagggtctgtccttgagggtcaccagaatgtgaggaaagacccagacaggcaggaaaagagctcagggaaggacatcttaccattggcgtcatcagagataccgcatccacgaatgaagagccagacgctgccagaggggaacgctcagagcaccggaaggagcttttagaaattataaataagcagcacattttaaaaaagccatagaagggctagaaaagaaagttgaggacatctcccagaaaatagaacaaaaagagattaaaaaacaactgggcagtccctgcagaggtcaccctggctggcgcggctcaggatggagggcgggagctgtgtgcctggaggggggagctgaggcacgtcaggatgtgtctccagactgcaagggccacagagtacgaaaaagaccacccagagcaatgtggtcaaagaccatgccttaaaaggttttaggaaacagaatgggtcccacgggagggtggggatgtgaacggcaccagcctggtggctcgggtgccaggccagggccagatgtagcctcataccagcccagctgggagtccgcttgctgagacttggtctcctgtagctggtggggaagcggcaccctgtgcggtagacagaaccagcagccgaggcgccggtggctttgctctggtggcaggacaggtgttctgacctccctgcctctgtcccctgaggtcagagcgcctgtcctgtggagcggctctgaccaggacagtgccgtgtgtctcatggggttgtgttcaggtcggctgagaggcagcgcctggctggggctagatgaacaagagggttattgggaacagtaaacctgagg

SEQ ID NO: 81729 - DNA, 1019 bp, Homo sapiens
gtgcctccaggagctcctccctctaccccgccctgccccaccccgtcacctgcttgccctgaccctgcctggataattgagaccttccaggccaagggccccctccccaggatcctgacacctgtccctctgagagtccagaccttttccagagtgacatcctggggccctgtgtggtcagagggctccatgtggtcagtggctgtggcttgctgggaacaagacactcggctgactgtgcttagagaacaggccgctgtttgtgtctaaatggtatccatggggacgttgtttcatagtcttcttacacttttcctcttcactgttgctgagaatcctgttctgacgcgcaccgtgggcaaccgggtgcggagcctgcaggatgggtgggacgcagacgtccagcgggaggagcatcccagagcagcctctgattcaagagcaaggtgctctagaggccccggctctgtgggtgggtgacgtggtccccaggcttttcccggcatccccgttccttttgcagcagccatggctcctggtggccctgggccatggcgccatctaggggtggcctaggggagtccccgggccatcagcatctgtcttgtgggtgttgctggcgcctgcctgcttggccacattggcacgtcgaggtgaccgtcaaggagaagcagctatggcctttgtggcaatcgtggtgtccaactttggcctctcaggtcagcctcatgggggcttcaacagccaggaccaaaatgaccaaggcccctccgtccctgtgtccctgcttgacagaaccaccggaggagggaggtgcgggaagggtgttgacggcctgagcgcggtgcctccctgaagagtgttgtttcacttgtgagtgtgcacgggacagccgccctggcctgtagaatcaagagcagggacagccgccctggcctgtagaatcaagagcagagacagccgccctggcctgtagaatcaagagcagggacagccgccctggcctgtagaatcaagag

SEQ ID NO: 81730 - DNA, 1127 bp, Homo sapiens
gggtgatttacatctacaaaaatgccttcttgtcttccttttgcttttaagtatttcgtgatttttctgcaataaacatatactattttggtattaaaaaatatggggcgcagttatgttggatgacaataaagggttgttggggagatactggaaaaggcagcagggaggctgaacctgacaggctccactgcgggcatcccagccccccccgacgggctccaccgcgggcatcccagcccccccccgacgggctccaccgcgggcatcccagccccccccgatgggctccaccgcgggcatcccagccccccgccgacgggctccaccgcgggcatcccagccccccgccgacgggctccaccgcgggcatcccagccccccgccgacgggctccaccgcgggcatcccagccaccccccccgacgggctccaccgcaggcatcccagctcccacacagggaggtctgtgggacacgaggccagtacagtcgtgatttctgttcagctgcatgagaactaaaaaagaaaaaagcagttcataagctctgcatttgccaggctgaggtcctggaaagcaagctctgttatcatctccgtgttctttccaaagcatctggcacaactggttatgtctttgttttgtcttgttaactctggaaattctgagctgtcattttccacatgcgaggagcaggttacagacccaggtgcacatgttggtcctgggttgagggtgccaggtgcttccttgccccgggagaagcacctgagtctccaggcgggcctctgaccgccgtgactgagcatttgggccaccccgggagcccagccctgtcctgtgtctctcctgcctggtgagcagcggtgaggtgcgggtgcatccagccgaggtgcagagcccaggtttgcagcagggtttctcccgccgcccctgatgagacacagactagcaaggactgtctgtcccagccgggatttgtcactctgcctccctccgttagagagtggagaggcctggaaggtccccgcggcctgggtcttgcagatggcaccagcaaaggccaccggccactccccgctgccgtcacctgtcacacagcagcagtcccgcggctcttcccgcg

SEQ ID NO: 81731 - DNA, 1134 bp, Homo sapiens
tctctccttggccagcatgcacgcttttacatgcactgctgctgtcttcagcatctgcacggtacatttcactgccgcttactcagctgtcccctgaggctggacatttaatttgtgtctggcttgtcgttgttatcagcgccactgtgacacacatcctcagttacttctgagttgtgggcttgccatgcgggaggttgccatgcgggaggttgccactagggagagtgggctgtgttgtacgctttggtggcccactccccagtctctccacctcccccagcagcaaatgagccagccccagtccctgtgccccaacctccagggttaacccctgggtgtgcatttgtttattctgaatcttatcatttatcgcccaccagactgacttggccatctctggcctcgaagggtctccctcagcgagaggtgtccttcctgagctgtcgctccatcctgagcaaggccttcgccctgggagcttagtaatgtcaaccttgttctaaacaggacctggggctacacttcagtcttccagatatcgaaagatggttctaagaggctctaaaaaccctaattttcagatggacagtgccctcttctttcagcctcagcctcttgtgtgataggctcttccattacgtgaaggttttgtcagcctaggagtagggtggatcacagctcattggctggatctggttgcagaattgtagggtgggagtggacgttggggagaggcgggcataggggaatgggcctgtgatgtcaccgtttcgcccgacagggctctgagtgtgagcagtgtgctcccctgtgctgctggagagccatgactgtcactgccgagatatttagggcaggtggaaacagcccagagctgagctccaagtaattggtctctaagggatgtggcaaaaagtccccgtggcaaaacctgctctgcctggctgggggagcttcacagaaactgtcctggagggactggcattctgctctgcaagttttaggttggaaaactcagaaatgcccccactcagctctgtcccaggtactcccggggggattcactgatggactggccgagaggacacttagcttccacagctgcacgtcccccggctgccagaaccccgc

SEQ ID NO: 81732 - DNA, 1082 bp, Homo sapiens
aatccagagcctacccggggcccaggtacctccatccagcctgccttccccgggagggctccccggacccaggcctacctcatcgatctccttgatccagcggtcgatgccgtcaaaggaccagcggttggtgatgtcatacaccaagaggatcccctgcaacagagacttgggggtcatcaggggtcactgacacgcatggccagcccaggcccagggacgctcaggtgcaggggcctcagttcccgggcagggccaaggatgcttattacttggcggatgggcagatgagccatgccctccaggcagagctggtgcagccctgcccctcacccctgccctcacctggcaggactgcagcaggggggtgggcgccttccatggtgtcagaaatgccgcttcccctccctcccctggagccatcagcctgtggaagtttcctgggcaggcagatgcggggttctggcagccgggggacgtgcagctgtggaagctaagtgtcctctcggccagtccatcagtgaatccccccgggagtacctgggacagagctgagtgggggcatttctgagttttccaacctaaaacttgcagagcagaatgccagtccctccaggacagtttctgtgaagctcccccagccaggcagagcaggttttgccacggggactttttgccacatcccttagagaccaattacttggagctcagctctgggctgtttccacctgccctaaatatctcggcagtgacagtcatggctctccagcagcacaggggagcacactgctcacactcagagccctgtcgggcgaaacggtgacatcacaggcccattcccctatgcccgcctctccccaacgtccactcccaccctacaattctgcaaccagatccagccaatgagctgtgatccaccctactcctaggctgacaaaaccttcacgtaatggaagagcctatcacacaagaggctgaggctgaaagaagagggcactgtccatctgaaaattagggtttttagagcctcttagaaccatctttcgatatctggaagactgaagtgtagccccaggtcctgt

SEQ ID NO: 81733 - DNA, 1539 bp, Homo sapiens
cgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtccccacgttttgctgtgtctggtggggtgggtctggcagtggcggtgccccgtgccaggggccagtgctgcttcatacccggcaaactgacctctggcctttgttttgcctgctgttccctgcgctgaccgggctgacctgccgcggttggctgggttcgcctcaaagtgagggctggagctgggctggagcagctgggcctggtcacggccattctcctcttcccggtggatggaatcccagctgggctgtgctgagccctcgctcacagtccccggcagcagatggcctggggcggactgtccccaacagcagcaggactccagagggccaggtcctccagtcagtcggcccgctcagcagagccgcctgcacgctggccaatctggtgtctgcta

SEQ ID NO: 81734 - DNA, 1050 bp, Homo sapiens
aacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggtgcggcccccggggcggccacttctatcggtgcggcggtccggggcctcaagagcccacggcccgcagccccggaggaaaaggatgcggctcgggctctgagggtgcggggtgggagcctgggggtgcccccggggcaggccctagctgtgcggcccccgcggctgcggaagtgggtggacctcggggtcccccttcccagccgctttggtctccgctcctcaacgtgccccccagcctcccctaagaaattctgtgggggcgtcggaaaggcgggtgcacaggactcggcccccacccaagcgttcgcctcctgcagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggtctgtggggagcccagcatgggtgtctgccgtggcaccactcaccctgcatgggggcagctgggatgccagatttgcccccatcacagtcggggtgagggtctccagcctcccccatcacagtcggggtgagggtctccagcctcccccatcacagtcggggtgagggtctccagcctcccccatcacagtcggggtgagggtctccagcctcagggcctggcttctgttgggggcagcacctcactgccgtcctgttcctactcaccaggggctcttcagagcagcaggacacctgctcaaacccagggccctgctcatcacctacggggtgagtgggcctgtccacggcgggcctcccgctcccagtcctagctgctgtctcctgccctgctgag

SEQ ID NO: 81735 - DNA, 1050 bp, Homo sapiens
tggctgtctctggtcactcctggcctgagctcagcctctgcccgtcccttaatcggctgtttgtcaaggcccctgtggtgccgtgaagcaatggccgctcggcctgccagggcgccaggaccctgcgctgtccgccgtggccggcgcgtccacacggtggcgcgccgcacagcctgtccgctctggcccgcccggctcgctggtgcggctgtgcgggcggggccggaagtgtggggacagcgcggggccgagaaccggaagtgcggggcgggcgcgggggcagagcgaaaggcttgaggaccaggtcggggccgggttccgggtcggggagcggctccgggcggcagctatgaggcgggacgtgcgcatcctgttactgggcgagggtaggcgccggcccgggggtctcggagctgcggcggccgtgaggcggggtgagggtctcgggggtcggggggcgccgtgaccttggccctcgcgctgaccgcctcgccccgcgcagcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcaccatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggat

SEQ ID NO: 81736 - DNA, 1034 bp, Homo sapiens
cttgcagacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattcaacctagaatgtgttgtttgtctttatgtgggctggaaacgccacccctcctttcattcctgggtcactgttctgaggtctcaggcgtgtgcatatggcctctggaaggtccactctgggctgctgtggcctgggagcccagtgtccttggaggtcctgcggtctgggagtgggagcccactgcgggaggacggtgcgcgcccggcatggactggggggcgccggtgcctgagatgtttccccggtgactgaccccttctcagggtccagtgtgccctggcactgcccactcactccccagagcgtcctgccagcctggctgagctgcgccgagaacctgg

SEQ ID NO: 81737 - DNA, 1070 bp, Homo sapiens
ggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcgtgagtgcgcccgcgcggggagggcggcggcggtggcaccggggagggccgggcccgggcccggccggccccaccgagggtctggctcctcttcggggcgtgtcctcggctcccaaagcccagccgtggttctcgagcccagcgccgggtgccggagaacgagggtgcgatgctggatggaggccggccgggtggggggagggcaggggccctcgacccttgaggaccccaggtcctaagcccggactctccaaagatttggaaaactttacaaaaccaagtggaatcaagcggataggctcagccagtactccactgtgcacagatccttggacccaggggctttgacaactgagaaacctagtttcttgattctagccagagcgcagaagctgggacgggccgtgggtcagagtgggcacgctgagcctacgccctcatgcggctggcccggccttggtccctagacccggaacccgctggtgg

SEQ ID NO: 81738 - DNA, 1013 bp, Homo sapiens
tttctcaggtggatgagaagaggaaggtgagtgtgtgtcgcttgctgccgatggctggcaggtgctcgtgcagtgccccttttcagcctctgaccgtgtgcccctgtgccacagaagcgagacatccccgactacctgtgtggcaagatcagctttgagctgatgcgggagccgtgcatcacgcccagtggcatcacctacgaccgcaaggacatcgaggagcacctgcaggtgaggcctgcggctgggggagcagggccagtggcatggtcctgggccccatgactgccctctgcccttcttgtcactgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaggtgggacgtgctggtgtgtgaccggcagtcctgccagctgttttggctagccgaggaaggtggagatgaagacgctggtgtcaaggttgagcgtagcatgccaccagcggtcggggaagtacagcacctggtggaggaagggggtgcagcagagattagctgcgggcctctagcctggcctggccctctcctgccagccactgacctcaccagcccggatggtacactccaggggccgtgcagacggtggcagggctgggtatgtgtcccggagccaggccagcgtggtcttgttggggtggaactctggcgtctt

SEQ ID NO: 81739 - DNA, 1051 bp, Homo sapiens
tctgaactgatgacccacccaggctgaccaggccagcccacctcactgacctcctgacccctgacctcatcacctgtgcagccatggagaagatgtcccgtgtgaccacagccctgggtggcagcgtgctgacaggccgcaccatgcactgccacctggatgctcccgccaatgccatcagtgtgtgccgcgacgcagcccaggtggtcgtggcaggccgtagcatcttcaagatctatgccatcgaggaggaacagttcgtggaaaagctgaacctgcgtgtggggcgcaagccttcgcttaacctgagctgtgctgacgtggtctggcaccagatggatgagaacctgctggccacagcagccaccaatggcgtggtggtcacgtggaacctgggccggccatcccgcaacaagcaggaccagctgttcacagaacacaagcgcacggtaaacaaagtctgcttccaccccaccgaagcccacgtgctgctcagtggctcccaggatggcttcatgaagtgctttgacctccgcagaaaggactctgtcagcaccttctcgggtgaggccacagaggcaggtcagggcaggtgggcgtctctgccggtgcccagcctgtccatgcaggcggaaaagggctccgtgcatcagaggccctcaggatcactcccagagggcttcctcagggggaaagggaatcggcaggggagggatggggcaagttgggctggacggcatgtgagccagggcagtcaagtgggaagaggcaagagatgagaccagcagaaattgaggctaggtgtggggtgagggagggcagagccccagcggtctcccagccagcctgggtggtgagcagagagccactgactcccttccctcatgtcggagctacagaggctgcctcatagcaggaggtctgccaggacttccaggtttcctggcccagggaggcagaggaggtgggtttgctgtccagtgccctggggcccttttcctaacaggcccagctccccgatggctgccctgagccagctctcccttgttca

SEQ ID NO: 81740 - DNA, 1081 bp, Homo sapiens
ggatcccagcacccactccccagggtgtccagctttcaaggctgagctgccctgggcttgaccatgggccctcagtctgctggggcagcaacacgggtttctcttgaggccacgtgcctgctgcgccatggtgcccctcctcagagcccctggtgcacccccagaagcatctcaaactgggggcgggagaggagctctgccgctgtgccacgtgccaagtggcagggacgcgggtgtgcctgcgtcacggggctgccacggaatgtgtcagtctgcaccctgtccccaatccccagccaccccagctgtcagccaggctctggggctgccactgcagatggagcccgatgtgcatttctctggccaccagggccctgcccagctctaaggccctctgcaggcagggctcaatggtccctgaggttctatgagggctgagtggttggttaggctgtgccccagtctggtgctgacagagatgggggcaccagagatgggggaagagaccttcaaactgggggcgctgaggggtgaggaggtttcccaggcatgtgtccaaaaggatgtcccaggggtgggcacgcggtgtgcagcctctgcaaggaatgcagcgccgtggcagggaccctgcaggatgagggcagtacttggagagaccactagcccagggcccagcaggaaggcatcgagaccccatgaggcagaacagggcagagcgaggaccctgtgaggtacacctggcaggacccaggtagagggaatcagccagccccggggcttttggagccaatcctagctctatgtaacttctggaaaatccgtctgcaagctctgcttccccactcctagttaggcagtgtgtgaaggaaggactctggccggtcagaggaggggtgcgtgtggtgccagggagagcggggcaggaggacccccttccctctcttggctcaggccagatggtggaggacgggcagccacttcctcagccctgcagctcctgaagagagagccagctgaaaaggagatgggccctcctcatccgaaggctctgtgtattgcaaggcccaccccagccctgggg

SEQ ID NO: 81741 - DNA, 1351 bp, Homo sapiens
cccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgagtggcggtctggttgggacagggtgggagtcccgaagtcttaccctgcctgggcttggcgggaatgtgccttgtcggccccactgcagaaggaaaaagtgagctacaagggttggatgggcttgtcaggccacacagcctgggactgctggggagggatggcctccccgccctcccttcccgattcatctctggaaagagctggcaggggcagagtggagggaaggggaggccgggcccagcaatcctgggcctctggtccctgaacggttgggggaagagatggtggggacagaatcgaagcctccggccaaagctgtccggggctccctggcccagcggtgacctctctcccctcccccagcccaaccaacaaaagtccagtgtgcagcccggtcaccatggagacgccgctcgcctccctgcagggcaccaggcccagctcttgcttggctctcctggagcttggcgcctgaccctgaaagggatgggctctcgctattctgccccctggccctgggccagggaccccagaccacccttcctctgcccccacttcctatcaccctagctgggctgctgctcttcagacctcagatccgggaaactagaggggtcccagatgctggggtgcatatgtcagatgggagtgcaggagggcggcccaggacagctgatcgctaggcatggcccccaggcccacgtctgtgtgcattcctgccttggaggtacgcgcctgcaagtgtgtttcctgagtacaggtgtcgccgagggcgtgcacatctgctgtgtagctctctgggacccccaggtgccatcaggccctgagcgtgggctctgctcatttgcctgctgcctcctgccgcttgtgcggacaagggacggggcctggggtgatgccgggagagggcagggcctctcctcaccaccccctctgcatgccaggtgcctgcaggccctgcagcgacgctgagctgctcctggccgcatgcaccagcgacttcggtgagtgtccccgccatggggggagcctggagcctgccttcccctgaatgc

SEQ ID NO: 81742 - DNA, 2119 bp, Homo sapiens
ggctggttctggggccaggaccgcccctctccaaggcagacttcccttcattccacgacaaagacgcgcagccccgtttccctggggctctagcccgtgagatcgccgggtgtatcccgactcccgccggcacgtgcgctcccccagggcagggcctgcctgtccccttccgcgggtcgccagcagccagcacaggccgcaaacggcggtccgcagagcggaccaacggagccgaccctcgcaggcttggagccggacgcggcggggcagagcccccgaggctgcagctcgccggaacccgcgggagggcagccgggctgggcggagcgcacagcgccacggaccgaccgcgcaggctctgccggccacttccggtgtcgcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgcggggcggggccaggccgggcaggggagctcggctgccgctcagggtctcaaggtctgggcgtggccggggtgagctccgccccgccgtgtggtagttcgggccgggctgcgggcggggcgggagcggccagtggactctcgccgccacccggtccaggtgccctacgtcggcgcgagcgcgcggcaggtggagcacgtgttgtcgctgctgcgaggacgccccggaaaaacggtggatctgggctctggcgacggcaggatcgtaagtgcctgcgtctgggtcttcgccgccccacaccgcccacctgctggcgggcgcccctgcccacatcctggttcccacactctcggtgcccacaggtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtaacctggggatccctggccacccgctgacagcccaaggtgcggctgacacctgcgagggctgggggccgggactcggaagctgcgatgacccggtgcccaccaggcctctccccggccggggcgacttctcttccggcaggtgagcctgagggactgccgcaacgtgtctgtgttcctggcccctagcgtggtaggtgcggggttgccagccccgctgggaagccccagccacaccccagggtgtttgctgctctgaggcctgggcctgcctggtgggtgctaggcttggggctaggggggtgagcgcggctgttttctaccggccccgcccccgccccctctactctgctgttctctccctcagctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtgggttctatcctgactcatgttttatggggggctgggtgggagggttctgtgctggctgaggagctctgctctgctctgctccttgggagacggcctagtggctgccggtccttggatgctggggcttggctggaggcacagcccccactttccaggggtcccctgcacctgccagcttcctcagcctcaggatttcgtgcttgtacctgctcagaggaaccatgcttaagtgacttgcccagctgtggacaggtctgcttttagcgcctgaggcagccatcatccttcattccaaccagaccagggccctgggg

SEQ ID NO: 81743 - DNA, 1271 bp, Homo sapiens
aggggccggccagaccggtggttgctgaggagggaggatagctcttcctctctccatgcctccgtttccccatctggggaatgcggcccagcgccccctgcacataccctgtgcagatggaaccaggtgcgtgaaagcgcccagcctgggcgcagcggacgagcacgcggaacggagcggcagcccgcccgcaggatgccctgagctacactcgctggacaccttctgtgtacctagcagtgctggctgagccccgggacgggggaagtatatctctgcacctctggcctgagaagaggggcgcagacgtccccatcaggggccggagaactcggaaacgactggctcagccggggcgtcgggagggcttcctggaggaggtgccagcgccgggcgcggcggggtcggagcgtgcgcgtggcgccccaccgggcacgcgcaccgccggcgggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccggtgaggcgggcggcgggggaacgcggctgtcccgggtcaggggtcttgcggcggcagggcggggggccgaggggcggggcctgggaggaaggcgtggcctttggggactggggctcggactgggggcggagccggggctggttggggaccggccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagagggtgagggcaggccgcgggccgcagggacccggccgtgtcccccgagagcctccccgacccccctggtaggagcgagcccccacgtgctctgctctccggaagtcattggcggctggggttccttgtttatcttggggctccctgaagttacggcacctctggcc

SEQ ID NO: 81744 - DNA, 1044 bp, Homo sapiens
tggacccttaggaaggcatctggggactgcgtgttgggctgagtgagcatctctggcttgggggaggctgctcattaagtgcctgcctgcccgcccacccctcggcgccatgctcccgcgtgggcagcgggccctgcgcctcactgcacccctccctgcagagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggccgttgtcagtgttggcagatgtgccaggagaggagctgttttcgtaggcgtgttttaggaggggtgcgtttattagacaaacgctgggagacaggcctggtggggacctggctgggggatgatgcagcccgcgatggctgctgcttcgtacttggcttgccccggaccacagcctcgtaacggtaacccctgctttccaggggcctggcacccccccctgccagggtccacacgcagggttgtggcgggaccacccctgcaggtccagctctgtctcccaccttttgcacagagcttcaagggaagcctccagaagtcaggggtgagaacccgtcttgctctgcctcaggcaaccccgggacaggctgaagcccctcacgcacttgggtgcccgaccagcagcagcaagggcagcacctgtgggcctcggcccagggccaacggaacaggctctgg

SEQ ID NO: 81745 - DNA, 1017 bp, Homo sapiens
gtcctgctcgtcctcagggcatcgtggccgcgtggcggcaacgctcctctcgggacccatcctggcggcagcctgaacggaccatcctccggccgcggttccggcgggaagtggagagtgagtgccgtgccctgcgcagtctggcaccaggctgggcagcacccctgggggtgggcatcactttagggtctcacctgcccctccctggctctgcagcacatcccattataatcacagagagtggacagaatccctgtttgccagtgggtaaactgaggcacagggagggtcacaaatggcccgaggtctcatctcacaggaggtgtgggaggaagaaggggtcaaacgaactccggccctgacccctgacccctgtgccctgcagagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgaggtagttcatgactcaagttcccaccggcctgctgtgtccaagccatccccagcccctctgggagtgacatgggccctcctggtctcttggcctgcagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtgaccgtccggctcgggggtcatgtggcatgagattgggaagggctgaggggcagagtgggggacaaagcctgaggttgggcgggcctggggtcaggggcacggcctgaggttatgctggtggtggagggatacatctctccttgccacaaggctcctcggcggcccctcccacaggtggccaccctgatcgaccgctt

SEQ ID NO: 81746 - DNA, 1067 bp, Homo sapiens
ggggcgcatgggggggtgtggaggggggcgcgtggagggggcgcgtggaggaggggcacatggaggggggggcaagtggagaagccctggtggaggggcgcatggaggaggggccaacggggggtgggagggcgtgtaaggcgggtctgcagtggggcgaggccttaggaagggcagcatcttcccgtgtggtggggcctagggaagggcagccattgagctgaggtcagctggccggagacctccgaagtctggagaggctgcggtgggcatctgtgggtggggcagtttggacacaggagagcctggcagccctctggcggcgctgagggaaggagaccctccttgatggctgcccggggtctctggcagccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaaggtgggcggggcggccaggccagggctgggggcagagctgggggcgtggaggtgggcgctctgagtcacccctctctctgtagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtcttgtggcctccgaggactttctgtgaccccaccagcgtggcccctctccctctggtcttgcgcccccaggccaggtgggggcccttggaggtcttcctgaccctgctgccactgtgctgagggccaggccagcactcagggtggccccaggagccggtggtgggagtcctgtgcccctgtccccacaggcttggccccggctaggac

SEQ ID NO: 81747 - DNA, 1057 bp, Homo sapiens
atcccaaaacctggccctgcctcttcctgaggtgaccttgagtccgtaaaactgacgcccctggggtgacgcttgagagccggaagctgttccaggaggagggaggggcctcggtttctcccggggcatgtgggcaggaaggccctcgggatcccgcatcagtcccacggccgcggtgcggtcgtcacctgtgatcacggctgcctggcgccccctgccggccccacctcagcccttcctcgcaggcctggccggggcaacccagtgggcctgatgctgcctggcacctcgaggccccagagccagtgagcagacgctcgctcgcccatctccctagagtcccgctgtgcagctgacaccccctgccccagccccacggctctcagctgtccggttccagcgtccactccgacagccactgcaggcaggggccccgctgtgcctcagtctcagggggcttggttgggggtggaggaggccggccgggcccaggcaggagtgcggaggggctgcctggcctggggcccctatcctcggggtcagggtcgggggtggcccgtaaggcctgcacgagctggtccagcgactgcagcagtgtgtgggggctccagcaggcatccagggagggcaggaaggggtcaggcgtgcagacctccacacactcggtgtccgtggggatgcgcaggtagaaagcgtgcagcatcattctgaacggccggtcctcccggcccgagacttctccgtaggtcaggtcgcccaccacggggtggcccagggcactgcagtgcacgcgcagctggtgtgtccggcctgcgggatgagggcggtgccggatcaagctgggagcggggccgatccacacctatctccctgaccaggacccacctcccgtcatgaccccgctgcagtcttgaagcagcctcttggggtggaactctccctgtcccctgccatgagtgaggatgacagtatttaggacagaagattgtgttcaggtcaccactggtgaggacagggccagggtggtgctcggtcctggagaatctaggccagccag

SEQ ID NO: 81748 - DNA, 2217 bp, Homo sapiens
gtcgaggatgatttccacaaccagttcgcggccgagctggaggtgctggcagagctggaaggtggggcgcggcccccggccgttggggaggagctgcgaaagccgggacagtggcgacctcggggagggcgtgccgggggccgaaggggcctccacgtcgccgctggcgggatctgctgtctcggggcggccgctgacaatctcctctcccagcaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacggtaggttggcggcattgccccagggcctccggagtgggcgcgaggctgaggaggcctctggttccctgcatgtgtctcccccagcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacgggtgtgtggcttggacatgggcgtcccatcccatctgtccagtgggactcagatggagcccatcccgtgccctggatgaggcctggggggtggggagggttccatggctgagagcagtctcggacacccatatccaagggtgaccccacgcttgagtttctgccactgagccccggtctctctccagagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcaggtgcgtggctgtggccttcctgcacggtgggtgggccagtgctgctcaggaaagggtccttggagcccctcacccctgccatttgcttaaagcgggtcctgtgcagagccccaggggtgcagagggggaggctgcgtcatggggcgtagacttagaggacacagcctccccacagcaggttgctgtccagcctgtttgtatggcctcgggtggagagggcctccttgcttcccctcctgcttttgccctttcctcctttctcctaaagctgcccccaatttccctttgcagctgacccatctggatggcttcattcctttggcacccctgtccagtctcccacccctcactggccagcttactggggttgtcccacccgggtccctgagcactgatgggggctgacgtgaatcctgtgacctaggaggggcccagaggcaattgtcctcccttccccacagggctctctcctccacgtcccatggcgaggcggtggccagctggacctgctgggtgtgtccttagcctccctgaagaagcaggtcgacggcgaggtaggggctgcgggtttgctggggggcggtggcggggccgcctgagccctcctgattccagcctgttgtttgcacagcggcgggagcggctgcttcaggaggcccagaagctttcagacaccctgcacaggtgacttggttggcccttccgccctggggacccttgttggctcttgcaccaactcctagctcctagcgtgtgggttggcatggtccctgcgagttgtttgtggctcaggacgtggtcctctccagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacgtgaggtcttgttctcactcaagtgtggctggcttcctctgttcccaagatggaagaacctgggcccagtgatttttgcacagccaatccactgggcctcggagacggagtgggctctggtttgcccttttgagttgtaggtggtgaactgagcacagggctgtgtgctactggtcccctgtgacctgtgaggcaggctaggggtccagggtgtcacctgatccaagtctctgttccctttcctaccttcacagcagctgacact

SEQ ID NO: 81749 - DNA, 1057 bp, Homo sapiens
tgagtcccccagtgcctggggtgtgctccagggtcatgctccccggctgtgctccatgttcagggcccgcatggggccaggagtctgaaagcacggtcatggcgtctgggggtggcgggccccagcttatcttttgctcagatgtaaccgtgaaggggggtcacttccagctacttgagattggctctgggacctgagttttgctgcagagctgctcccagccttagcacccccacatggaactggagccgggggccccgagagtgactgcactttccaacactccgtttcccgctgtgggatggccatgggggtggtgggggtgaggcatggggcagtggccccggggtcctgctgccccagcgacggcaccaacttgcaggacgctgagtcactctccgtggcagccatcggcaggtttcatcatcatcccacgtacacttgcagttggggaaactgaggctcggggcagttaaacctggctgccgcagggttggggtgcggtggcaccaggactcagccccacattcctgctctggccttgtggcttttggggtttgcggttggagtgcccggcggctctctggccctgagcctggccccgctgacctgccctggtgtccccctgtgctgagcaggaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtgagcccacccaggctctggagcaggttgcagtctgggcgtgcaccatccccactgtatccctgtgtggccagatctcacaatgcctgctccctacaggtggatgggagccccccagggctcgagggtctgctggggggcattggggagaaaggggtgcaccgacctgccccacgcaaccatgagcagcggctggagcacatcatgaggcgagcggcccgggaggaacaggtgtggaatgggcagctgtgggggtgggaccagggtacatacc

SEQ ID NO: 81750 - DNA, 1042 bp, Homo sapiens
cctttgcaaggctgcatgcgtttccgtgggtcaggcatagggctctgggtcactgctgtcgtggatgctgatggactggtgttagacctcagcagattctctacctcccaccatgttcttctgccctcatctcctctctgtgacactgaagagagacctgggttcacgcccaccagagtgcccacctggaacacaatgcatttcctcagcagagggtccccgcgagcgcaggggtgtcctcggcggagggtccccgcgaacaggcatgtcctcggcggagggtccctgtgagcgcgggcgtgtcctcggcagagggtccccacaagccacctgttctccgtggcagctgacaggcaggaggctgcatccaaagatgccactcttccttcttggggccatgcgccgttggcctcggaacacctgctgctccgtctcttgggcccaggattccatcacctcaagctcctcttcctgtgccggccttggggaccccctcgggcctcgcctccgctcccagccaccggccgggtcatctgtgggccgcacagccttgtgaggactccgccggcgggggcgagcacagatgggcagtgagaagactgatttccctctgaggagatggctcagtgatgctagaagaaaaacaaggaaggcgaggtcccccaggagcgctcaggccgtgcactctacgcggaactgcgttttcataacaaaacagccgaccagatggagggcgagagatgcaccagagcagctgaacggggcgcagctggggatgcctctgcatggagcagggccccgagccccgaagctttcttagaaacaggatctgatgcccagatctgtgctctctggagccctagttccctgaggctagagttccccactgagcccacagcaggatgacccaagggggctttggaaatacactcaggcagggcccaccctgacccaggcaggcaggtgctcagggctgggtgttcctcaaagctcctgatggttctggcatggccgagcatccgaacgggcactggctcaggct

SEQ ID NO: 81751 - DNA, 1037 bp, Homo sapiens
tgggctcaagtgatctgcctgccttggcctcccaaagtgctgggatcacaggcatgagccaccgtgcctggccttgatagttttgaattatggtgcagggcaagttcccacccttcctcctggctgggctgctgagtgggaccctaggtgtggggacttctctgtgccttggcctgggaggcttccaggtccccacagccaggtcttgcgcttagagccttgagctgggctcgggacccgggccccattcctgctggtccccaaccggcacgtccccacccacgtgtccatccccagggaaagggcatcctgagcctgaggggccgcctgtggaccccggctcttgggggttgcagcttggccgcctgtgggcagcaggcggcgcgttctccgactgcctgttctccgactgcctgtgttctcaagttgggcacggggtttacaggtgtcgtctctccttcagctggggtgtgtattctttgcttttagatggtaaagattttaagacaaaaatgaacactttgcttttgcttcaaaagctccctgaatgtctcttggcccctcttagcgtggcaggtgggctccacgtgtgcagggccaggcgggccggggggatcctgtgtgcagtaggagccggggtcagggggccagggacccacaagcctctccctagccccgccccccgagatcggccaggcacctcacggcccctcctgtccctgcagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggtgagcccgcgccgcccgccctgccccgtgtccacagagacgctggcccgtcgccctatttctggctgccccgctctctgggaggaccctggggcattacaggccccctttcttggggacagcctgtcctccccagccttcgtt

SEQ ID NO: 81752 - DNA, 1047 bp, Homo sapiens
actccagaacgagagtaattatcctaattgctttattgcatcagtgtgggggcagctcgggtagctcagaggaaaaggggcttctttcagggcccatcggcttcagggcgacatgctccacccggaaggggcagacctctgactccggcacggaggcgtcgtgggaatttttagaaaatgatatctatggcatcctgatctctggcccccagctgcagccccctgtgaggccgaggcccagaccggagtccctgaaagcgctttgtgcctccgacctccggcgtttttggcagagctggggcaggagccggggtgctcctcgcggctgaagcgcatcagcctccagggcgagggtgtctcagatccccgcacagcccgtcacacagcccctgggacaatcacacaggacagtgctctcctgtgatcttcaaaggatctcctgggttgtgggggtgcaaaataaaactctgctacaaagagcattagtaattcctcttcccaaccgcacagttcagctcaagcgatctcccggtaacagaaccagcccctgtgcttaccgtgaacacgcctttctgggttcacgccgaaggtttctattgaagtgcacgtcgtttgccaaaaaataaaaataaaaatacagtaagtccaaaatctgctctgtctgatttctaagttaaaaccgtgatcacagcaagaggaatttacatggtatggtgactagggcagcaacttctggaaggcaaaccaatcccgtcagagagataggcggctgagagtctacagcagacctgtgcttcggagatgaactgccctcctcttaattcccctcgcccgactaagctgccaaggcctggtgattcttggggtcttcatggtgtctggtgacctgacagcatgtgccccaaatcctggcccctacacggcctggctgccaccccttggctctgcccccacctgggctgctccaggccccagcagccaaggcctcaaggacacccagagccgggggaaggagcagttcaggtgttttcagacagacaagcctct

SEQ ID NO: 81753 - DNA, 2155 bp, Homo sapiens
acccgattaatttttttattttcttttttatagtgacagggtcttgctatgttgtccaggctggtcttgaactcctaggctcaaactgtcctcctctcttgacctcccaaagtgctttaggggattacaggcatgagccaccacgccctcccagaaaatagattttaaaggccattttgtctcattcacacgatcattaacattttgttggttttgaatttctcccatcacgttgttagccatttctgttttaaaaaattctctttactatgcagaattctaaactactgaagaagtgttttgttgctgtgattcatacttccagtgctgaatccacttgagtggctttaatctagaatcttcaacgtggctttttaattgtttttaactgtatggatgcaggatgtttggtggcatctgctcttcattcctagtggattagtgacagtgacagtgagcaaggggcttcctgtgtggctgaagagggcggtttcgtcaccacccattccgcagggggcagctcagcccagcaggcatttggggactcgcacccagcactctgcggacgggggtctgactgcacccgctcctcccctccaccccccgctgccggctggagggcacagtctgtgcggtggccttgccaccccctagcaggtctgcatccgttctcccgcctgggcctcaatacttgtttcctccttttcctcactctcccttgcctaaaccgccatagatcatcccctttatgggtcttttcaaagagctggttttatctatcagaattttaaaatatactctagctcattcgtttttgcctcttgtagttgcttgctttttctgggagaaagtggtttatcatttccagtgcctggagttggttcagctattttctgtctcttcttctctgctaatgaaagccaactggagggcggctacccacttctgggtatgtccctgccctaccctgtcatctgagacccccggctgcccctgacagtggccgatggtgtggttttataaccttcagcgctaatgcctctagaccaaggacagcctggagaaatgcttcgaaaatgccacatgctcagggttttacaggtggccttttgtttctcaactttgattttattacactgtggccagtgtggcctgaagattgttcttttaattattaaaaaaaaatgggcatgtgcatgaatagtcaaattgtattacacgacttataataaaaacagaagcccttgccgtaccacttctcagccacatgctgttctccagacaacccttttatcacttcctgcacttaactctggtatttgtctgtctttctgactgataggtttatatgggttattcttcgcataccacggttagacactgtgtatacatgtcctcttatgaacgacagggattgccctcacacaccctaatgttcttctcatcatcatcagtatagctgtgtcacaagtataatttttattagtttgattgtctttacattattttgactctgtaaatattgtgactgctgagccaaatagtgaactatagtaactttttttctaataactcttcatttttcctggagttcatagttgccttttctattttgattggcttcgtttttcatctctgatcatatctcactcatttgttccaactttaccagcacaactggtcaaccctttccaatactgttgtttttacagaatcaaacacattggacaatccatcagttttttctctccactttgtgaagatttccgctcaggacctcattgttactgcttggagcagatgctttgtaggcctctggatttggagattgtggggcaggttaactctgccagattgggggccactgatgagtttgtccctctgcccattccagggatcctaagatggttcccaggagcaggtgacctcattgtattgagggtaaggctcagagtccacagcccctcctccacgtccttctaaagcagtgctcttagggaggatttctcttttttagagctgggatcttgctctgttgctcaggctagtctcaacctactgggctcaagctgtgctgccacctcagcctcctgagtagccgggactattggcttccctgagaagcctgatgctttagtggggaaggtgtttagag

SEQ ID NO: 81754 - DNA, 1120 bp, Homo sapiens
gacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcggtgagtgccggcgccccgggggcggggttcgggaccttggccgcccctggtctcggactgcgagcgggggcctggagggcgcagagctcgcggaggtggtggccacacgcaggctccgggctctgcaccccgggcgggtgtcagggcgggtcccagtggaaaaacatcctctggccagccggggtccggcgccagctatgggagtcgggatccgcggagggcagcgcctggggtgtgcaccctcgtggcgggtgcgctctggagccagttctcctggcggggaacaccctgcggagggccatggctggcaccccgacgtgccctccagccgttgcgagtggccccagccccgggaggcacgcccggcacgacagcaagttgcatgcggctctctggaggtgctccctccttagaaagggctcagctcctctagctcctggaccacccatggggagggagtgcggcaggcggatgggtgggcagcaggtttgcctgcgagtaccctccccgcagtttctccctctcctggacaccctcggtccgaagcagggagggcaggagtggagatgacggggtgcgccgtgtgcacgccttggcgtggtggggccggtcagttttccagaaattaggactgcagagtgaagaacttgttgctcaggacaggccgcccccaccgagtgtcctctggttgggtttcaaatggt

SEQ ID NO: 81755 - DNA, 1075 bp, Homo sapiens
ccccgagggcccctgggagctcagatcctacccctggaggcagccctggggaggcccggtggagactctgctcttctgctgaagctgctgctgaagagtgacaggcctgcccagcgccgggggagacccgggactctcagagggagtgcaggacagggcagggcagggcagggccatgattcccggtgacggccaggctgccatgggccgaactgccatctctgggcctgcgggcaggcgctcagctccccaggcctcattttcctcacctaaggaatgggacacgcacaccttcgcccccagggtggtgcagagaacaggacggtgcctccgagcagtgccttcaacgccgtctggggcctgggaatgcaccaggacttgataaataaacaccagctctcaacacctcgccctctgcaaggagaaggccaggaacgtcccgtttagagagaaggcgagtccacgagcagcagacagtcggtgcttaacaggtgctcgctcttcttcagagccttagggtgccagctggccagagtgagcctcgctgaccagggagctgtggcagccggccgggggtcggcccctggggcaggtgggatgcctgtggggccggcgtaggctcaggctttgtctgggagtgccctgccccgagcactggcctggacacctgagctgagcctcagacaggcgtttcggggccgacccggcaggagcagccgctatccccgggcagctgagcccagcagcgagggctggtagaacgatctagacgaaacactgaacttaatagcaaaaccacttctttcgagggaaaacacgatccgcagccagccggcgcgtacacatggggcctggaaaagaagagaattccggagacacaaacggccctacgcgtcgccgcctcggcccggctgctaagttattaaactcctgcacagggaaaagcgataaagtaaacatccacctctcccgtcgctctcagaagtgaaaggttcctgagatgggaaatgcagacggcctgcagagtgctccatccaaataaaatcatcagatgcttgaagaccctgggagaaat

SEQ ID NO: 81756 - DNA, 1012 bp, Homo sapiens
ccctacctgcatccctggcggggcatctgcggtccagcctggcagggaccctgagtttgggtctgtgggggtgtggcctctgggggagggcaaaccccggtgggcactggtcaccggtgagccggcgtcgtggccacagccttcacactcccagccgctgcaggtccccgtttccgtacgtcacccagcgccacgcttctgcacccacgcagagccacgccccacctgtgcgttcatgctgacttattaccgactcttctcgagtgaggagttctcgccaaacgccattaggctttcagcttccagatgaaatgaaatggctgatgaatcactatatttcaacatattaggaaagatggacctatttgcatccgatgagcaaaatgcacttttttattgattgaaaagttgatgaggcaaacaaatcagggaaaatggctcccttttcatttccctctgagcagcaaattaagcgacttaaaagagctttgaatgagtcaacaacaaaatgcccctaaatgtggaaatgtgaagtgcaaacatttcagcctcactgtcagtgcccaccgaggacacagcctgcctcccgccctgggaagctgggggctgtggaggaccccggccacttggacatccagccacatcccaaagtctccaaggggagatggggtccccagcaagcctgtccggattagccaagatgaggggcttcaggagtcaacacagatggagctgccaggcgtggtggctcaagcctgccatcctaacactttgggaggccaaggcgagaggatcacttgagcccaagagttcaaggccagcctgggccacatagggagacctcccccatctctaaaaagatttttaaaaattagccaggtctgatggcacctgtagtcccagctactcgggaggctgaggtgggaggatcgcttgagcccaggcattagaggctccagtgagctatgatcacaccactgcactccagcgacaggtgagaccccgtctaaaa

SEQ ID NO: 81757 - DNA, 1045 bp, Homo sapiens
ggaggggccgcccgctgggcctcggctccttacctggtagacgagggcagcagcactgcagggcaggctctgaggggcttcagggagacgcaggtgctggcctcagactccaggatgctgcggccaggccaggcgccatctgggtgcaggggcggccacagggcagctgtcgccatatcgacagcagccgtccgtctgggctcccggggccacctgcccgccgctccttcctctcctggcttattttccaaacaatttgcttaacgtgattcccggccaagctaaacatgactaatcgtgtttacccggtgatcccgcgcctcctggcaggcggggctggggcccaggaggaaggaatgcctgcatgtgctggttcagggactcaccaccctggcgtcctcccttcttctcttgcagagcctgacgcaccccagggctgccgccatggagcccctgttcccagcctccacgcccagctggaacgcctcctccccgggggctgcctctggaggcggtgacaacaggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgtctctgtgcatgtcgctgccgctcctggtgttcgcggacgtgcaggagggcggtacctgcaacgccagctggccggagcccgtggggctgtggggcgccgtct

SEQ ID NO: 81758 - DNA, 1011 bp, Homo sapiens
cctgctgccttggtggcaacttcagggtgtcgccagacaagcctcgagggccactgggctccgcctggtcatcccgagcccgagatgccacgtggtcagacctgccgcagccagttccctgcctcggccagtcccctgcctccactcctgcccctccacaccccagccctccaaaagcagcagacctgctgccctgggatggttggaggtggagacctggcgccccgctggatgcacgtcagaccccagggtgtcagtgtccctggaggccggtggtggtaggaggggagtcccgatcacactaggggtgcgggaaaatcaccagggggtggcccgagtcagtgtgcagtgggcgtggacacccactgtgaacagtggacggggctcgggggtcccgggaggggctgcagccccgaggacactcctgcagggcttagcagtgccaatcctggccctgctgcccacaggcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggtgcccaggccccacccccgtgaggcccctgcccagatggccctgcccaccatgcagataacgcaccatgtggctccaccgccccacgtggctctgcccaccgtgcagtcacccgccccgccactgctgtccccgtcatggctccgtccaccatgctgtctcccgcccccaccccccatcatggctccgcccagctggcagtcaccgccccacatggctccgcccacggtgcagtcgctgcacatatgccccaccccccaccatggctccgcccaccgcgcagtcgctgcacatatgccccaccccccaccatggctctgcccaccacgcagtcgctgcacatatgccccacccccatcatggctccgcccaccgtgcggtcgc

SEQ ID NO: 81759 - DNA, 1050 bp, Homo sapiens
accgggggtgggggcaggcaccaggctccaactggggtgttctgagcgcctgctgtgtgcccgtctagcctggagctcagggtcagggtcggctggaggctaggcagccaggcaggccgggctttcacagtccagagaggctgaatgaggcaggtgtcccaggttccagttgccacccaaatccagagtggcttccctctgtctgtcccgcctctggtcttggttctctcgcctgtggaatggacactactgagttgtagggcaggaagtcccttttaagctagagagctcgggcgcccagggagggtaggaggccaggagagccaagacgggcagagccagtcctgcccctccctcctcccacccccctcccgctcccccaccttcttccgctcagcacacccctgcctccaccctcaacacgcccctgcccccaccctcagcatcctgggcatgcaccttttcggctgcaagttcagcctgaagacagacaccggagacaccgtgcctgacaggaagaacttcgactccctgctgtgggccatcgtcaccgtgttccaggtagtgcccggggtccccgcagcagtgttgggtgctgagtgtggtccccagagaggtggaggtgccgtcctgcgcatccatagctgcctctgccccaaggacttgccggcatttcggggctggggtgaccaccccaggccccctgctatcccccagatcctgacccaggaggactggaacgtggtcctgtacaacggcatggcctccacctcctcctgggccgccctctacttcgtggccctcatgaccttcggcaactatgtgctcttcaacctgctggtggccatcctcgtggagggcttccaggcggaggtgagggggcagggagaggggctgccaggaggagggcgatgagaagagagacgggcttcaggtcgaggggaggggtgtggggggcctgccaagaggtgagggatagagaagggaagctggctgccatgaggagaggggaggccaggagcccagcggagtgggcaggggtcggtcggg

SEQ ID NO: 81760 - DNA, 1053 bp, Homo sapiens
ccggtttagggagcatccacacttctcctcccgtcggtcatgctcgcattcggccttttgtacggggtcagctcattgggcggatgagaaggtgtccccgcctaccgccccgaactggccaattgcaaggggtttcacagggcgctgaactcgcgggagcgtcaccgtcctgcgacgcttcagaggatccttaggcctcagtggtctttgacccccggccccaggacctgaccccaaggaaacctccgggacctgtggctggagaggtgaccgccaggcatccggggagcctttggagatctcggcttcctttttcccccgctgcttgccggcgtgtcctcgggtggacgcgggcagcccgaaggggagtttacagacgctccctcacatcggggacgcggctcctttaagggcgtaggtgtccagggcgccgcctgactggaaagtcgccccccggccgggctcctggggcggacccggggcgcgggcgcgcggcggcggggcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggtgagcgcgtgcgggggccgggccggggccgcggggcgggggtcgggccgaggcctctactcctgttgggcccgggcccccgactgccccgcgccccgccccgccgagccgggccccgcgccgcggccgagctttccggggagcccgagaggccccgcgctcggcgccggctcggtccgcgctgctggcgccgctgggctgcggcccgagcggccgggccgccgcaggccttcggggccggggctcccccacttcgcccccgaggtgcgcctggcgcggggccgg

SEQ ID NO: 81761 - DNA, 1203 bp, Homo sapiens
cagggtggcagctaccccccagccgcagcggcccagcctctgaacatctgtctcctcaccttcgagcagaggccgcagcatgtgtcgcagaccagggctgggttggggccatggggaggggtcctacctgcccccgcctcccggtgatctgggcgccgctcacaaggcctcccctggtagacccccggggtcggacgacggcttgcaagaagagagtccctgctgggccaggccaccgtatgttaggagcaagcctgcctgctgcgggccacgtgcgcgtgctggggtggcaggagcccgctcgcctctcctgaccccgtgctctgcctcctgtgttccagggactttgaacatgtcggggatcgccctcagcagactcgcccaggagaggaaagcatggaggaaagaccacccatttgtaaggagggcttcatttctgtgtgcagtgccgcggacaggctccctcggctgaaaccgcgccctccctactgggagggagctggtcgcgtgcctgggctgggccggtgggactcgcaggccggttcttggtggttttgctcaaactagatgccgccacgctgatatgcttttgtggttgttttcttttctctcagggtttcgtggctgtcccaacaaaaaatcccgatggcacgatgaacctcatgaactgggagtgcgccattccaggaaagaaaggggtaaggggcgctgccggcctcctgcctgtcggggctcagcagatgcgtgcggcagtgccatggggatactccgctcagatccctgccgtccgtgacggccacccttgtcacaggccgcggtcaacagctcagatccccagctgtggcctggcccccgccccgtgaggacttgagctcagaaggtggtgctggcaaggttggggtgacagctgtgtccctaccgagggcatttctggttgagaaggaagcaggctgggcctggccgggcacagggctgagctgtggcagaggggaaggggctctgatgtgtgttgggagcaggcctgaggggcgggcagcctttgcgtgctggaacccgggattctgctgtgtccttccaggtgtggctcaggtcgcgggagctgggtttgcaggagagccaccccggcctaaaaccgtctactggagaacctcctggggcacagggactggcggcagccacctaggatgcctgcttggggccccg

SEQ ID NO: 81762 - DNA, 1020 bp, Homo sapiens
ccttcacattacggcgaggcaggtgcgcgcgcggccccaaggaagacgggagtggtgtcgggttgtggggtggcaaaggcgcctcatccaggcgggacctggggcaggggcttgcagaacaccctggggtgagggcacgggtgtgctcttggcgctgccggccccagtgtgcggcactcgttgccccccagcccagcccccgacccccgtctcctcctctcctttccaggagggcctttccgactcactctctgggcatggcagaggtcctgaccgcccccttggtggggctggtccaggcttcaggctggtatgggagccgcctctgtcgggcctctggcccccggtgtcctcgcagtcctggaggttgtgtcctagaagcgatccccttcctcctgggccggcctgcggcaggcaagcagcccatctcaccacggtttatttccccacagactccgtgggaaggaggcttgtttaaactacggatgcttttcaaagatgattatccatcttcgccaccaaaatgtaagtagctccctgttcagtgtcctggaagtcggcctgttcctgcggggattggagtcctctccaaagaggcccgtggctgtggccgtggcgccctggtccgggcgatccatggagctgggagggagtgagatcacagatttggaggtcggctttgatccctgatccccgcctcaggctgcagatgcgagtctgtttccagctccacgggtgggcggtgcacgtaatagacttagtctctcatcccagctaattggctgggaagctccagagtcctttgcagggagaggctgtgagatccaggctggagctcctgggctaggagtgcctggaccctcagtgattgttggcgatgaagacaggatttggtgcccacaagaccccagccctggatgggatggacgtgcagaagcgccaccactccgagtctcactggagggtttatcttgccccacctcactgctcttcctgtgggctctcgcagtctctcccacc

SEQ ID NO: 81763 - DNA, 1036 bp, Homo sapiens
cgtctcggctgcggccgtgtccccaaggctctgttccctgtgtgcaaaggtggatatgtcttcctttagtctcctcatggccacaatttaatttttttgaaaagtttttggccaaataacctggctaccaacccggggccccagtgttgggaggagggtgatgtggggaaggacgtgactctgggacagtgcctgcctccaaaaagtgcttcctttcttcctcttcctccaggtaaattcgaaccaccattatttcacccgaatgtgtacccttcggggacagtgtgcctgtccatcttagaggaggacaaggactggaggccagccatcacaatcaaacaggtacggggcctccgcctctggcaccggcagggctgccttagtctcccctccggacacgtgggtctgtggtcattctctgtggctgaggccgagtctcacggtgtctccctttcaaactgctcacacccgtcttgtgtttttgtctctggcacagatcctattaggaatacaggaacttctaaatgaaccaaatatccaagacccagctcaagcagaggcctacacgatttactggttagtagcagccctggccccgctggtggcagctcctccccgtcccagccaaggccgcctggcaggacgggagtggaggacacaggctcaccctacggacagccagggtccacgcctctgtggggaaggtcggggggcataaaccctgtgggcagcaggcaccgttgcacaccgtctgcggtgggcatggatggcgccggagccgtgtcccggggagggagcaggccaggtgacgggctgtcttgggccactgccccagtgagttgtggccagctaggaggggaaggaccctgggcgtgggtgccagaggaggccatgctgagaggcctctccaccggctcagcctcccatggaccccagcctcccgcgccgcccttgctgcttgtccccatcccctctacaacttggttccttctgtgggggggcccagcccagcagggctcagtgacgtgatgctgtc

SEQ ID NO: 81764 - DNA, 1043 bp, Homo sapiens
acagggtggaagcccagggtccgtgtgacagcatcacgtcactgagccctgctgggctgggcccccccacagaaggaaccaagttgtagaggggatggggacaagcagcaagggcggcgcgggaggctggggtccatgggaggctgagccggtggagaggcctctcagcatggcctcctctggcacccacgcccagggtccttcccctcctagctggccacaactcactggggcagtggcccaagacagcccgtcacctggcctgctccctccccgggacacggctccggcgccatccatgcccaccgcagacggtgtgcaacggtgcctgctgcccacagggtttatgccccccgaccttccccacagaggcgtggaccctggctgtccgtagggtgagcctgtgtcctccactcccgtcctgccaggcggccttggctgggacggggaggagctgccaccagcggggccagggctgctactaaccagtaaatcgtgtaggcctctgcttgagctgggtcttggatatttggttcatttagaagttcctgtattcctaataggatctgtgccagagacaaaaacacaagacgggtgtgagcagtttgaaagggagacaccgtgagactcggcctcagccacagagaatgaccacagacccacgtgtccggaggggagactaaggcagccctgccggtgccagaggcggaggccccgtacctgtttgattgtgatggctggcctccagtccttgtcctcctctaagatggacaggcacactgtccccgaagggtacacattcgggtgaaataatggtggttcgaatttacctggaggaagaggaagaaaggaagcactttttggaggcaggcactgtcccagagtcacgtccttccccacatcaccctcctcccaacactggggccccgggttggtagccaggttatttggccaaaaacttttcaaaaaaattaaattgtggccatgaggagactaaaggaagacatatccacctttgcacacagggaacagagccttgggga

SEQ ID NO: 81765 - DNA, 1002 bp, Homo sapiens
gcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagactgcggcctgccgggtgtgtcctttcctgccctgtccctggctcccctgggctttgggggtgggagcccactggggccacagggcgtcccccgaccccaaggccca

SEQ ID NO: 81766 - DNA, 1054 bp, Homo sapiens
cagacagctggtggcgcagtctggggtcgccgtcatcgactgctcctgggccaggctggacgagacaccgtttgggaagatgcgagggagccacttgcgcctgttgccctacctggtggccgccaaccccgtgaactatggccggccctacagactttcctgcgtggaagcgtttgctgccaccttctgcatcgtaggtgagtccaggggccccacagcagtgtgacccggcggcctgctgttcctgctatgctcccagcatcatgtttcctgccgacagaccccaggaggagcataagggacggacaggggaacagttcagacagaccacggttccagccccaactgtcacttcaggttttcggcctgtggagttgcagtagaggcagaatgggatcgctgttctatcagggccggtgtgtggggtgccattcattatcagggcaccactgcccagagaatcctccttatcctccacgtcctccttactgaattgctgatctaaagaggccctgatgaggcgtggggcagtcttggtgggaatgtttgtttcgcagcaaaggagggggacttggtcggttgcagaggtgtggactgtagcaagggaggtgcaggctgggggcagcacgggttctcaggactgtgagctgatgtttgctggggaccctgcggttacttgggagagcgccgccatccggcagcagggtgatcaggaggcacttgaggggaccgtcgacttctttgggtttcctgtttctcacaccgtcaggctttccagaccttgctgtcattttgctgcggaagtttaaatggggcaagggcttcttggacctgaaccgccagctcctggacaagtacgcggcctgcggcagcccggaggaggtgctgcaggcggagcaggagttcttggccaatgccaaggagagcccccaggaggaggagatcggtgagccttggcggggtgggaaccaaggccctccaaagcctggggggtgggaggcctggtcctgctctgagctcacttagaggccactttcctctctcggctcagatc

SEQ ID NO: 81767 - DNA, 1015 bp, Homo sapiens
gtgggccaggacggtgcagcagccgtctccccccttgatttctgggagtgagccctagatagcaccctaggggtggtggagcctccaggaccctctccggtgctctctttggatgaggggcacttggctttgaagcggggccggagtctctcgggggcacccacacgctccctgaacgtcccctctccaggcagcttcccgggcttcagcacaggtgacttggctgaggtaggtggtggctgacgccctctgagttgagtgcgagccgtagtttgtcgggtgagcattgaaggcagcttagcccctccacatgctgcgcactctgcagctggtgggtgaagcttctgccgacttagcacggagcctggtgggatcaccccactccaaggggagaaaaggcgcctccgttcctgtcccccaacttctttgcgtctttgattttcatgaggagtttctggatctctgccaggtgtgaggggcggtgagctctgaaggggctgccatatcctgatcctgggacttgggtgcagagggcaggtccaggttcccgagcctggctgacctgactatgggcaaaccgcttggccctgcccgtcatcaagcccccgtatgggagcatgagggggctgtgggcaggcctgcgggttggggggtcggtgcctgtcctcagtgagtctgtccagggccctgacatggttcaggctgacacctgcaaggatgtagtggggggcattccatgcagggcttggaggccgagcagctttctggggactggtgtggctgatcttactgaatggaaggcacagccaggctgagcctgcagtggcacagcaggttaggagcccggcaaaggacccattgggaagcggtgaccggcacgcgcaagggcacaagcttcctcctttcttgcaggtcaggattcaggatgcaatgaggcttttcttggtaggaaggttactattgcaatgcatgaaggcaggctgggcatgggcctcagggggtgtgggttgagcga

SEQ ID NO: 81768 - DNA, 1045 bp, Homo sapiens
aaagcaaacaaaatgaagtggttgggatttggatgaggactgcgggccaggacagcggagcgccacacactgagactccgtcctgaacccttcggcagcagcctctctgtgcagtggtgggaggggagcgtgccctccagtgacctcgtttcagctttggaggctccagatgcagagctgtgaccactgtgtcctcggcttgcagggagctgcaggcccaggaagccttgcagaacggccagctgggcggcggggaaggggtcccggatctgcagcctggggtcttggccagccaggccatgattgagaagatcctgagcgaggacccccggtggcaaggtaactccacggccgcagctgagggcggtggtggggggggcgggcacagcgcgagaacagctcgggccacttggttccctgtgcctttcagtttacgtgcaaggtgatcagatggggaaaccgaggctcgtggagtccaataccaagccctccccaacagggggtgggtgccgagtgggatttgggcccaggcgccttcccccgcacctgctctgaatctctgcggcaactggcatctcagtggggccagccattgaccaagtggccgaggaggtagcacaactcccaccggaactcgtgaggcgtcctgtcccagagccggggcgcccaccaggcacccaccaggatgctcagcagagcccccagcccaccaggcacccaccaggatgcccagcagagcccccagccctgcgcctctctggggtggtgctctagacagcagctttcaaatccctgagcttggccagaaacatatggaccagggggctgtccctcggggctgggggacctgcattcctggctggcacacagatgaggttatatgcaggggagattttgatttgaaaaaaaacgtggtaaggctgggagcactggctcacgcctgtaatctcagcactttgggaggccgaggcgggcagatcacttgaggtcaggagtttgaggccagcctggccaacatggtgaaaccatgtctctgctaaaaata

SEQ ID NO: 81769 - DNA, 1083 bp, Homo sapiens
tgactgcgacgggtaaggaaggtgacgcagcctgcgtgcagggcatgaactctcattcccacacaggtttaaaggtttatttggaacattaggaaggatgagctttgtggaaattcagcattgtgtttcctgctgtgtttggctgactgggggtttgcgatggtctgtgtttcttactgtgtttgactggttgactgggggtttgcggtggtctgtgtacctgggcggttccacatttggggacaggtgctgcgtccagtgtgtccgtccttctgattagaacaggaatctggaagaagggaagggaattcactgcttgccacgtgctgacagggcgtggacccagggagcttagggctgcctctgggtccatgataaccaggcattgcgtgcctctctgctccccaggtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcaggtgagtgggcatccacgagtgggcacttggcctgcctgctgctgtgggctctgctggatgagcaggaactcggcaagtggctcgcctccctgctgctgcaggctctgctggcccaaatctctctcctccagaatttctttctgagtctggatgttagtcctttttttgctttttttgagacggattctcgttctgtcacccaggctggagtgcagcggcgcgatctcagctcactgcaagccctgcctcctgggttcacaccattctcctgcctccgctgcccgagtagctgggactacaggtgaccaccaccacgcccagctaattttttttttttttgtatgtttagtagagatggggtttcaccatgttagtcaggatggtctcgatttcctgaccttgtgatccacccacgttggcttcccaaagtgctgggattacagtgagccactgcgcctggcctctggatgttatttctttcttttcttttcttttttt

SEQ ID NO: 81770 - DNA, 1031 bp, Homo sapiens
cccatggtctgggatggcacctggttccggggtccacgcgcctctggggagggaggaacgccccggggttgggggttgcgcctgggctcggggaccgggaccctctgctccggctgccgaccgtgaggtcacagcgggtcgcccagggtccggggtggcgcttgggcttggggaccagggtcagcgcctgggctacgaggtcgggtgagggtcgcgtctggagtcgggatgggggtgggcgcagcgcctggggcccgccgggaatgtgagtacgggtcgaccctgggttgaggctcctgaggccggtgggtcccgccgcccacgagtccgagtccctggaggtgctgccggaagcgagccgcggcgctgtctgtgtttgtaggtacctgaaggagttcaggacggagcagtgccccctgttttcacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtaagcggccgcgagggggcgccgctgcctgggcggaggtggggggcctccacccggggatgcggccgggaccctcagcggacgccttagtgtccatacctggcccctgcagagggagtcgtaattatacgctgaaattttctagtgaccagggatgctggggcggcatttcctattctcaggccagttcccgagggattatgtgtgttttaggggtaacccttgtgtgactcaaaccaattttgcttcacctcccacttttttttgtttgttttttgagacggagtttcactcttgttgctctggctggagtgcaatggcatgatctcggctcactgcagcctctacctcccaggttcaagtgattctcctgcctcagcctccggagtagctgggattacaggcatgtgccaccatgcccagctaattttttattttt

SEQ ID NO: 81771 - DNA, 1004 bp, Homo sapiens
aggctcataggctgggcttcccgaagccttcatccgttgcccggttcccgggatcgggcccaccctgccgccgaggaagaggacgaccctgaccgccccattgagttttcctccagcaaagccaaccctcaccgctggtcggtgggccataccatgggaaagggacatcagcggccctggtggaaggtgctgcccctcagctgcttcctcgtggcgctgatcatctggtgctacctgagggaggagagcgaggcggaccagtggttgagacaggtgtggggagaggtgccagagcccagtgatcgttctgaggagcctgagactccagctgcctacagagcgagaacttgacggggtgcccgctggggctggcaggaagggagccgacagccgcccttcggatttgatgtcacgtttgcccgtgactgtcctggctatgcgtgcgtcctcagcactgaaggacttggctggtggatggggcacttggctatgctgattcgcgtgaaggcggagcagaatctcagcagatcggaaactgctcctcgcctggctcttgatgtccaaggattccatcggcaagacttctcagatccttggggaaggtttcagttgcactgtatgctgttggatttgccaagtctttgtataacataatcatgtttccaaagcacttctggtgacacttgtcatccagtgttagtttgcaggtaatttgctttctgagatagaatatctggcagaagtgtgaaactgtattgcatgctgcggcctgtgcaaggaacacttccacatgtgagttttacacaacaacaaatgaaaataaattttaattttataatatgggattagatgattccctttttttgcatctagtttttaaaaagggggtatttgggcagctattgttttttattttaatctcttcttgtttaccagagcacgtaagttagttgcaccagcagctatttttaaaagtttccttttccggtcgggcgcggtggctg

SEQ ID NO: 81772 - DNA, 1086 bp, Homo sapiens
cctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccccgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtg

SEQ ID NO: 81773 - DNA, 1048 bp, Homo sapiens
aggccccgacatgtgtgctgagctccccttccctgaggccccgacgtgtgtgccgctctccccttccctggggccccgaagtgtgtgctgagctccccttccctggggccccgaagtgtgtgctgagctccccttccctgaggccccgacatgtgtgctgctctccccttccctggggccccgaagtgtgtgctgagctccccttccctgaggccccgacatgtgtgctgctctccccttccctgaggccccgacgcgtgtgctgctctccccttccctgatgccccgacgtgtgtgctgagctccccttccctggggccccgacgtgtgcgctgctctccccttccctggggccctgacgtgtgtgctgctcttcccttccctggggccccgacgtttgtgtgctgagctccccttccctgaggccccgacgtgtctgctgctctcctcagctcctggggctcctggggctgaggggctgcatctgtctcagcctggccgtgacccactcagccgtgcttcccctctttcagccggtggctgctggcagcggaatcccccagatcaagtgcttcctcaacggggtgaagatcccccacgtggtgcggctcaaggtgagggtgcggtggccctggctgggcagggtgggcgcccgctctttgctggttcaggagcagctctcttggctgcctgccttccagaactggcctcagccaccctgtgtactggtggcactgtgtgcagatgggctggctgggtgtgaaggggtcacctttttttctgaaagtggtaacaactggtatttgcacatattaaattacgtaagaaatgagtagtcatacagaaatgcttgcgtggtgcatgtgtgacacagctgtgcgacgcgtctgtgactgtgggctgcgtggtggtgactgattcaccgtggaagctgtcgtggtagtgggcgtgtagcagtttcccgctttcagtttgcctcatggtcatttacacttggtgttatcagagcatctggttctggaggtgctgggagtcctgacccagttcc

SEQ ID NO: 81774 - DNA, 1506 bp, Homo sapiens
atttttagtagcgacagggtttcatcttgttgtccaggctggtctcgaactcctgaccgcagctggtccacttgcctcggcctcccaaagtgctgggattgtaggtgtcagccaccgcgccccatgtgcagttctcttgctgtgtccttgtccttggtgtcgggatgataatggcctcgtgtgtgagctgagaggggcctctctccttgtggccttgtcaactgtgcttctctctttgcctttttctgccacaggatatggaccctccacatcccttccccaaggagatcccacacaacgagaagctcctgtccctcaagtatgaggtgggcgtccttctgtccccctgaccctgagacccggcctctgccccctgccagcccactcccggtcccctgtgcccgcacccagagcgtgggttcggtgctgagtgctgcccttgctgtcccggcctgcagagcttggactatgacaacagtgagaaccagctgttcctggaggaggagcggcggatcaatcacacggtgagctggacgccgctccctgcagggccccacggtgcggggcctggtgccggccgggcctggggctgctcttctgccggggtgaggtgacgcacctcctccctcctcctctgactccgcctctgaggcctgtggttcgtctggtttctagagacagtgggagggtcacggtcaccgtaaccaagaaggctgctcttacggccgccagatgcggtgcccagcataacaaccgctggctgtgaagttgttgggaattcacccacctccccgagtcaccctcgggccccgggtgcgcctcagatgttggccagaaactgtcctttgtgggactcagcgcaccgtgcacactgggcccttcataatcccggggcctgcaggcggtctgggcggtcctgctgctgccagagtgactgcgccagggccctgcctgaccctcgccctgaccgcgccctgcaggccttccggacggtggagatcaagcgctgggtcatctgcgccctcattgggatcctcacgggcctcgtggcctgcttcattgacatcgtggtggaaaacctggctggcctcaagtacagggtcatcaagggcagtatccttcccagtgcggccgctgcagcttgggaggggggcgtggcctgggccgagtcccgggcagaagtcctgagcccagcgtgttccagtgcaggtggaggcggcccggccaggctggctgtgtccctgtcatggttgggccgtgagacgtctctgggatgtccagtgaacatcatggctccacccagcagggtggcatctgccaggctggtctgtggggcagggctgaggtctgggctgggtggtcatgacggggaagcagccagccctccttgatgagccccagatatcgacaagttcacagagaagggcggactgtccttctccctgttgctgtgggccacgctgaacgccgccttcgtgctcgtgggctctgtgattgtggctttca

SEQ ID NO: 81775 - DNA, 2698 bp, Homo sapiens
ctcagcctggcagtgccgtggcgtctgactggcgggtggtggtggaggagcggatcagaagcaagacccagcggctctccaaggttagtggcgcctggtcagctcctcacgggcatggggaccgtgggtgggtgggaagggcggtcagacacctccaggcgctgtctgcagcgaggggcggccacattcgctggggatggtgcctttgccgggattcctgaaaggcagggtccatggtttgcaccgaggaactggattttggctgtaggagacccagactgggcttggggacatgataagtgacaggtgtcctggtggtgctctgtcctcagagcccatctaggccaggggtggtgttgctccacctgaggatgtttaggggcgtctggagatgtttttggttgtcactaggggtgggttggaggccacggaggcatcctgcagtgcccagggcggcctccccaggacgctcctccagccttgaatgtcctgcctgcaagttcgggaacgcctggtctgctgtccaggcattggccgcggagcctgagtcccgtcaccaaccccatggggcctgggagctgggcggggccggaagagtagcccggggaggcaaggcgaggctgaggtccacgctgctttgtgggatcctctcgggctaggggtgccgtgcccgctgcccaagcctgcacctccgtgatcgctgtagttgtgtctggcagggtggcccgaggcagggcccggcaggcagccccagcagattcaactccgtggccggccacttcttcttccccctccttcagcgctttgacaggtgagtgggttttccgtgggcctgtggacttgggggacagggaccctggacgtaccactgtggccaagaagttcgggctgggatctgagtgggtttgggtgtgaacagggtcgtgctttgctgtggctttttgtaagcctgtgttaaatggcagggagcgtcccgcaagattcctctgtggttgagctttgccatgaggcaccaggcatctgctccgatgctgggcttgtggcatggccggcagtgccgcccgcacgtgcccgacgccatcacctgctgggccctgctcgcctcctcctgcctcagccggcgctgcactggccccacgttcagggcgtgaggctctcgagatggcagagaagtgtggggcctgggttgtgctgcagcaggggtgggggtctcggcgttgggaactcctggcccaggtggacttgtgccagacagccctgcagggggagtaggcacccggaaatgtctgctcctacgatctcggtgcaggcaaggcggtgggcacgggaggaggggctgtgtggggctccctcggtctcccacggtggcccaggaggttggggacctggccctgaggcacccgctgcaccttgggctccatcctgtgctctaggcctctggtgaccttcgacctcttgggagaagaccagctggttctcggaaggctggcgcacaccttaggggccctgatgtgcctggctgttaacaccacggtgagccgggagaggtcgccgggcgccggcctgtgctaaccatggatcaggagcgctcctcagcctcacctgcgcccagggatgggtgtctgagggaggggctgcctgtgtgggcccccgggcagcgggagcatcccctcggctgtcaggcaggccctgtccctgctgctgcccagcagcggaagccgcccatgggtgctgggatgtggggacggcgtcgggaccccactgactgtccctctgctggtgtccaggtggctgtggccatgggcaaggccctgctggaattcgtgtgggcccttcgcttccacatcgatgcgtgagtggcctgtggggctgggccaggccaggggtgcaggcagacacaggggtcttattgtgggggccccgtggagcctcgaggtggctgacaggcagcctggcctggtacttcccaaataggaagtgtgccaggcagggccgcagcgtgggtggtctgccacactgaggggagtgggaggtctggggtgtggtccctgccgagctcagcccccgccttcttgccggcagctacgtgcgccaggggctgttgtcggccgtctcctccgtcctgctcagcctgcctgctgcgcgcctgctggaggacctgatggacgagctgctggaagcccggtcctggctggcgggtgagtgtcggcctgcggtgtgtgtgtgagatgtgtgtcggcccggggtgtgtgtgtatgtgtgtgtgtgtgtgtgagagatgtgtcggcccggggtgtgtgtgtgtgtgtgtgtgatgtgtgttggcccggggtgtgtgtgtgtgtgtgtgtgtgtgtgtgtgtgtgtgtgtgtgtgatgtgtgtcggcccggggtgtgtgtgtgtgtgtgggtgtgtgtgttgcagctcctgcaggccaggctgccatgactccttgggacccacacaggcagagtgtgcaggccggaggtgcagccaccccagcactggccgtttccctcctttggtcctgatcctagaccctgttggggtccctctgtgaccccgcccacccgcctccctgggcccctccggccggtgcagtcctggcaactttttgtttgtttgttttttagacagagtcttgctctgtcgcccaggctggagtgccgtggcacaatcttggctcactgcgacct

SEQ ID NO: 81776 - DNA, 1053 bp, Homo sapiens
gcagagcccccccaaggctccccggggccccaggctgcaggaggccttggtgagggtcccagcactgcgggcagccaagagctctggcagtgtgcggtcccagacacccaagaggcctccccacaggcgggtggcacgcccaccacccggattcctacggtcttccacctccgaccacagcccttgtctgccgtccagcaaggagcaggccctgctggtgttcccgggttccccggttgtgcgccccaccccaggcccctttcccatggctgcctgtcccgcggctcagggcagccctccatgtacagtgctgcctgcacagagcctgtggcatgcaggccccaaggccgtggggagagtccggggtcactgcagacccgagccccctttcttccatggagtcaggcctggcggggctggttcaggcagactgaagacaggaggagggagaatacgccctccacgctgcctcagctttgcttgtcactctcgtctggcagacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtg

SEQ ID NO: 81777 - DNA, 1163 bp, Homo sapiens
gagcagatagcagactgctgcatgcgccagggcagctaccacctggccaccaagaagtacacgcaggccggcaacaagctgaaggtgagcctctcccggccccagcccgcggctacctcacaggcagttaggctgcgggccccctgcacgcatctccatttgccttcgtgatgaccccaagctagggctgagcctttctggccaggaagagcacaaccactaagatctctctctaccgggcagccctgagccactcttcttgtgagagctcctgctcggggtcccttgtgcttgtcccggcccagcccctgcttgcctgagccccgctgtctctctgcctaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtgcaggccctccctggcatgccagcggggccccggggagggctgtggagcccggcaggtcttgacgggtttcatctgtacaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggtgtgcccccggggccagcggggacaggccagggcagatgtgactacagggccggggctgaccacgagaaaccccagccagcaaaagggcaggacagcagatgggagctcacttgggacagcactactgctgaagacacaccccacctcctcctgggagccctcagagcccgggcacagccttgggaaggtgttctggaaacaccagagacgctgagagagaaacctggtgggggagtgggaggaggaggcagatgtggagcaggagagggtgtgtctggggagccacagacctgctgagggtgtgcaggggccgggcaggggagtcctgagtgagtgccgctgtgtgacctggggtt

SEQ ID NO: 81778 - DNA, 1095 bp, Homo sapiens
aaaacccatcaccgcagagatcgctgagcagtgtgtcaaagtgaaggggcgggttcgcacccggccacattccagaatctcagcggacctggggaagccagtgggagccgcttcagggccctgcctccctccctgcaggagaacggcctggacgaccagctcatgaacttggccctgctgagctcccccgaggacatgatcgaggcggcccgatactacgaggagaagggcgtgcagatggacagggcggtcatgctgtaccacaaggtgagggctggccaccggtggggacctgggggaggggcagcaagccagggggcccttgcctgtgcgaggcctccgtgctcgggcccccaggcctcgggcagctgctcagagcccaccgtatccgcaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaaggtacggggccagcggggcctgggctcggctccacgcaggcaccacggctcaggtctcctgtccccagaggctgtgggaatggctgcttgcttggttatgagttctccaggaaggctgcggtgggtgccccctgccctaggtttcacatacggcacacccaggaggtccgcaagtgtagactcgccatccttcacgctggcatctgatcatacacagggaatggtgcactcacctatggtggggggtaaaaacacacagaacacaaaatttaccatcttagcctttttttttttttttttgagacagggtctcgctctgttgcccaggctggactgtggtggtgccatcttggttcactgcagcctcaacttcccaggctcaagcaatcctccttcctcctgagtagccgggaatacaggagtgtgccaccatccccagctaattttttaaattttttttcatagactcagggtcttgctgtgttgcccaggctggtcttgaactcctgggctcaagca

SEQ ID NO: 81779 - DNA, 1013 bp, Homo sapiens
ttttgttttttttcgttttttgtttttgagatggagtctcactctgtcgcccaggctggagtgcagtggcatgatctcggttcactgcaacctccgcctcctggcttcaaccctcaaataatctgcctgcctcaccctcccaaagtgctgggattacaggtgtgagccaccacgcctggcctagaacagcatttttaataagctacttgaacaagaggaaggggacgaagcactcatattcgtccttgttcgtaagagtacctgaggtggaagaactcaccctgtgttttgcgtttgccccacctcatggtgcacacgcgccacccagggtgagaagcagcctaagagctgtgcagcactcatccggtgaacagaggtttcagggtgggcggagaattgggaactgggcctctggcgggcactgaggtccctcttcctccctgcagagaggccaaagcacactgtagctgcaggagcctggcggagctggtccctggggtggggggcatcgcttctctgcggtgcagcagcagcgggagcaccatcagcatcctccccagcaaggtgaggccacccctcgtccactcgcccactccgcctcctcacctctgtcctcccaggccaggcctcctgcctgctcgtgcctctctcctcctgtgcaagtcttcctgtcctgtgttctgttcagccccactctccttcccctcgtctccccgggtctctccctcccaccttctccgggaacctccccagcatggtcctcacccagcctctgttcctccccgacctgccatcttctgtcccctgcctttctccaagtcctccttcatcgaaacagtcgattccttgttggagagttgctcgcttcctcttcatccctgccttcttcatcccactcagttttctttggcacgcgaggaggcacaggactgttggagagccctcaggcgtcccactcagagaggcagggtgatgttggtgtgcagagggccagcggcagccacatggaaggg

SEQ ID NO: 81780 - DNA, 1047 bp, Homo sapiens
ctgggaggctgaggcaggagaatcgcttgaacccaggaggtggaggttgctgtgagctgagatcgtgccactgcactccagcctggacgacagagtgagaccatgtctcaaaaaaaagaacataataataaaaaatatatacacctgccatgtacccttataaattaaaaaaaatgtcagttaaacaataaatttaaaaagtaaataaaggaaagagagggatactttctttgccattccccaaacctaaaaaaaaaagaaaaaaaaaaacagaaaagaatcataataaaacccatggatatcttatataacacggaaaacagcctcagcctgtccacagaggacccagtgatctcatagtcgtaggatgatggagcagcagtgttcagaagtgtttagaggaggctttcgaggtgtgcagtggggtgtacagttgcacctcacttttcccgccctttgcctcgaatgtccgtggttcttttcaggatgctgtcgcagtctggaacggaaggcaggtggcgatcttcgagctttctggagccgcgatacggagtgcaggtgggttcttttcacccggacagaggcactcccactacctggctttatttcctccctgcctaatgagagggccactgtggtgcagttgagggctggcacaggggctggggagacccttgtgctactgcctgcgcttccagagccagggctgcagctgtggccccgtgctgccagtgcatcctggggcctgctgtgtgggcgtaaacaaccaccgtgcttttgtggggttccttccagggaggaggtggctgcctcccatcttctgaaatgtttccagaccatgcacagcagtgagacctgtggtgtcttgacccaaggccagcctctgtctgaaacttcaaggtggctcctcagacatgctccgttaatctcaaacacccttctaggtccccaagatctctccagctctctgcggttagttttgccattgttgcccaggctggagtgcagtggtgcaatctcacctcactgcaccctccgcctcccggg

SEQ ID NO: 81781 - DNA, 1066 bp, Homo sapiens
ccgagtttgttttgcttgggtcccgggtggcctgcgggcggacaggtccctgggcagcggggttctcagcccgagacgaggtctttgggggtttaggtttcttgagtggaaagaggtgggttgagggggaagagtgggaagtcttgccacgaaatcccttaagttggggtgtttgtcgtgggtggttttgttctttggcagagttttttttaaaactagcatgaactcgagattccctagaccaattccgacaggagaaaacggccacggatccttgtgtgatctgcacctcagggtgggggcatcattgcgactttgaagccatttcccgatctctcggaaagagaggtcctcgcccgcgtccctgtatttcgtggttggtgttggtgcctcgatcgtgtgttcctttgaagtggaaatgcccccgttctcaacagttgagttgaacgcagggtcagtatctgctgaggaatctaatcttcagcgtttttgcttcctcacacgtgcccgtcccggactgtttctgggctgcagctcttgctgtgtacctgattgtctgagtttatttttgagtggctctgctttctgggctgcagcatttttagtcactgcactttgttgttgacattttacagggcggtgggtagcaaagttgatgcaataattttattaattgttgccaagagttttaacaccattgtcttctaccgcttcttgcacctggacccggacataactgggctgtcactttcccgggtggttccaacctgttccatgcaacaggctcctttgttgcaaaagcatttttaactagtaaatccccgcagcagctcacatttcccaccctgggaagaagattcccagagacccggagctgattattctttatgtgtgttttaaaataagcaggcgggccggcggcattgggccaccatggagttccccgtgcgggcaggcgagcccgcgcttctcccgtcccggggtggatccggcctcctctgtcctcctccagggccagctctgggggccggcgcgtggggcaggtgcgcggggcccgggagccccg

SEQ ID NO: 81782 - DNA, 1187 bp, Homo sapiens
gccccccaaagtgctgggattacaggcatgagccaccgctcctggccacaagcaaatatatctttaagcaaataataagctaagctgtgatggtggcttttaggagaggagtaggaagtgggtctcctttgcatcacagaacttctcggccactgtctgccttggagcttcccgggaaggaaggctgcctgtccgctgctctctgctttcaggttcctcagtgctttgggaggcacttcactgtgcccaggacatcctctgacaccagtctttggagagacctctgctcagtcgttgcttccattacccgtcagaaaagaaggccaggtggtggcagttgccccgcaacagtctttagctcaccttccagaaagatgctcagaggagaatcctcttacattctggagaaatctgcatctggagtggtgagcatctgtcagggaggaaacgatcaatacttcatgtttcaatttttcacttggaaatgatgtaacttctattatgcctaaggaatacttagctcaatcactggcagttcctttggttgattacttactgccctggccagtttcaatctcagtgggcctgagactcttacagtgaatttggaagaaaggacttgtggagaaaaggaaagtctgcttgtttggcttttctgcatgcaagtgtgttttctttctctgaagaagacactcttattgacttcaatgaaaaatgcttttttttctagttcagtttcaaatttaaatcttcttgcattgataaagcgatggtagctgggatttagtgcctgtttgccaggcatcttgcatgtctgtaattttgcttttaaatgagtgcagaacctgaagtagattgtttaagtcacatgctcaacctaaactcaaggtaagctgcagaccagaaatcccaaaacagacattcctgcagctctaatacaccacccacgtgaccctgggacgcactggagatttcggcttagagccgcagaaaccatctgaaagacataagtcaggagacagagtcctgatacctttccctatttggccagttcatgatccagctagccctgggcaaactagtccatcttttggataaaataaacacctgcctcagaatcgcttgaacccgggaggcggaggttgcagtgagccaagattgcgccattgcactccagcctgggcaac

SEQ ID NO: 81783 - DNA, 1034 bp, Homo sapiens
gtcatcgtattctaccaggtgtctctggtcccactttctatttcatttcgcttgagctgtactcagtgagccgaggtcaagcagtgaagccacttctgcatctgaaattttaggggtgaaccagaggccaccttcagtttctgctctgaagtttgtgattgttttttaaaaagcattccaagtttaggccgggcgcagtggcccatgcctgtaaccctagcactttgagaggctgaggcgggaggattatctgagttcaggagctcgtgaccagcctgagcaacatggtgaaaccccgtctctactaaagtacaaaaaaattagccattgtggtggtgtgcacccataatcccagctactcgagaggctgggtgccggaattgactgcctgggaggcagagcttgcagtaagccaggattgcaccactgcactccagcctgggtgacagagcaagactccttacacaacagcaaccaaaaaagcactccaagtctagaataatgggcaccaaatattagaaaaggttacttggggcgatttgctttcttgtctgttttttggggttttctgtctgttttgttttgtagagacaaggtctccctgtgtggcccaggctggtcttgaactcatggactcaagcagtcttcctacctcagccacccaagtagctgggactgcaggtgtgtgccaccacgcccggcagtctactttttttttttttttttttcttttttgagacagtctctcactctgtcacccaggctggagtgcagtggctagatctcagctcactgcaacctctgcctcccggtttcaagtgattcttctgtctcagtatctggagtagctgggactactggtgcacgccaccacatggggctaattttgtatatttagtagagacagggtttcaccacattggccagactgatctcgaattcctgacctcaagagatccgcctgcctcggcctcccaaagtagctgtgattacaggcgcccaccaccacgcccggttaatttttgtatttttag

SEQ ID NO: 81784 - DNA, 1951 bp, Homo sapiens
ggtcctgcagttccataaaaagagaaccctggttatcacagggatatgctgacagttcccgctccctctgcgaggaggaactgaaatgggtgggaggaatgtgttaggccatgaaaagtttttatctgtggtcttttgactcctgccacatctctgcctccggtctcggaggagcctggccagggttctcggtccacagctggggaatgaagcctcctcggggtcgtcttgggcttttccctccttggtctcagaggacttggcatgagattgggaactgatgctataataggatttgcaaggttatcaggtcattctcagaacactacgtttttttggtggacattgattgagggtaaggaattttaagactaaagattcttaggcgttggacagttcatattctgaagcactgattttatctaaaagaaggtggtgttttacacgtttgtttccttgagtttgaatctcaacctacttatttgaaaagatgttaagaatatttaaccaaaaacctcatttacaaaagaaatacgcatgaaatgtgatgtgaggcttcattttgcagagggaagggatctctgtctccattgtggacagggcgtcttaggctgcagcgtcattgtgctgttacatggttccacataaaatcttgctccttttctaactgtaaaaacatttgagggtcatttggccaggtaaagatcctggcagtcctaagcagcctcgctggtgccgtgggtcctgggtgctgcctgccagcatcctcggttgaggagtgtggagtgggacctcagggcagtgggcccttccctcccaccggccctctaccctgcccagcccgccagctttctggaacagatcactgtacggtgctttctctccaaggagctgaaggtggtggatcatcgtctggaaatgtgtctggggttgcccctgctgcccctgcagggggctcgcgctcctcctcccggaacttagggtcttctggtggcgagaaggaagaaggcaaaaaggtccggcggcagtgggagtcgtggagcacagaggacaagaacaccttcttcgaggggctgtacgaggtgagtaggctgtggaggcacggccaggcagcctgggcgtccctctcggatccctgccctccgttccccgtgcttcctctttgctgttagattctagaacgcagattcctgggcgacccccgcagtggcggaggctgatgtgggctctagccttgcccactgaccttggctgttttatctcctcattgagattttagaagctagtactggtgaggtgtctgtgaggaggtgtttttgtgtgtttccttcatttccttttggatattctcaccccttgtctctcaaagatgttcttgactgaaggccctcttgtttcagggctttccctttgtgctgagtgggctgatttaggcgggatggcctcttgaggggaggcacaaggcggtgcttgtctcgggggtcagtgtagctgagaaacctcacgagatgttgctgctgacttgggacaaaatggaaagtcctaaaaatagagagaagccactccctgaccccaccgcccagtgaatgcccgtgctccctgctggccagtttcacctgcattattgttttctaaatccttgtaattattgtgagcatactttttaattaacattgcttgcatttttcacggtgtttcatagctcttttgctctgtatttttttttaacgcctgtaaatattctccttgcctgtgtgctcactgtgtgcttttgtaaaaacatcatattggagcacagccatggccagggtcgatgtactgtctgcggctgatgccactgcagtggcatagttgaagagctgcaccagacagggtggcccttgaggccctggccagccactgctctgcttggccattcctgtgtggtcaaggatgactgagatccttccag

SEQ ID NO: 81785 - DNA, 1042 bp, Homo sapiens
ctactactgttgttttggggcagatggaataaaaaatggtgagtggaaacgtccatttgtttccagagcacttcattggaggagattattttagaattgacttgagccgggtacagtggctcacgcctgtaatcccagcactttgggaggccgcggctggcgaatcatttgaggttaggagttccagcctggccaacatggagaaaccccgtctctactaaaaatacaaaaaattagccaggggtggtggtgggcgcctgtagtcccagctacttgggaggctgcggcaggaggatcacttgagcccaggaggtggagcttgcagtgagccgagattgcaccgctgcactccaggctgggcaacacaatgagactctgtctcaaaaaaaaaaaaaaagaattgactccatgcttaatgactgcttttgaccaatgtttcccctggttccttctgctgccgccctactctgacatcattaatgttcataaaactgctgtggcacttagatctgtgtatttcagctgggttaaggtggtttaagaattttgtctcaggccgggcgcggtggctcacgcctgtaatcccaacactttgggaggccgaggcgggcggatcacgaggtcaggagatcgagaccatcctggctaacgtggtgaaaccctgtctccactaaaaatacaaaaaaattagctgggcgtggtggcaggcgcctgtagtcccagctacttgggatgctgaggtaggagaatggtgtgaacccggcaggcggagcttgcagtgagctgagatcatgccactgcagtccagcctgggcaatagagcaagactccatctaaaaaaaaaaaaaagaagtttgtctcagtacaacatgttgttctctggggactcatcctctctaaattatccctcaagacagaaaatctgtacagacagaaagggggtgagggcatggaagttttttttctaccgtcttgactctttggtcaggctttccaaggctcagctctgtcctttggtatcctgtgtttgattcccagcact

SEQ ID NO: 81786 - DNA, 1075 bp, Homo sapiens
acacagaggtaacctagaggtggactgagaggtcacggagaggtggactgaggtcacacagaggtcacctagaggtggattgaggtcacacagaggtcatagagaggtggactgaggtcacacaggtcacagagaggtggactgagaggtcacacagaggtcacagaaaggtggattgaggtcacacagaggtcacagaaaggtggactgaggtcacacaggtcatctagagatggattgaggtcacatggaggtcacggggaggtgaactgaggtcacagagaggtcacgtagaagtggattgaggtcacacagaggtcatggggaggtggactgaggtcacaggtcatgtagagctggatttaggtcacacagaggtcacagggaggtggactgagaggtcacggagaggtagactgagaggtcatggggaggaggactgagagcttctgctctgagggcccaaagtgggaggactgcacagagctggggcagtggagagaggggtggccatctgaggggaccccaggatagtggcttttccagggatgggacatcagcttgtgccaggccagtcaccaaggcaggagggcacagcacattttctgtaaacagcaggtgtcccttggagtgtgaggtgtggtcaggaaagtagcaggatgtgcagagtcaccacttcttgtttgtcactgtgtcctcccactgtcctacgcgggctcgagaggctggggtggatgcttggccaggccccacctggcctggctcagcgcctctccgtgtgctggcccttccgtccttctgttcactcacaggcctcagcgttccttcaaaactcttttcccagggccaccactgtacgttacaaagggcggaacctgcggatcaaagcgcccatgtgccgggccctgaagaagctgtgcgatccagatggtaagtgaatggggcgctcccgggaccagaggcggtgcccatggtgtcccattcaatgatgggcaggctgagctaccgggttgctgccacagttgctttgtgtctgaccctgcttaatcccagggctgcacatggaccactcttg

SEQ ID NO: 81787 - DNA, 1065 bp, Homo sapiens
atggtttccttcctgttctgcgaacctcacttcctcctgtctgtcgtctccgtaggatgatcgtggagctacatcgaaaggtctccagcctcatcgaattcttgaagcagaagtgggcgctccatgaggtgcgagttgtatccttttccagctaaagcaaaccatccaggctgcgctgcctctgctgcccagagatggaccacgcctccctgtgcctgtcatcgtcatggtccccgtgggcagaacagccatgctgtgacatggtgtacatctggaaccataacctggagccccttattccctgggtgtggagccccctctgtggccttgcagtgctagaactcagtcacagccagccctccacgatgtcagtggcctgtgtctggcccacggggtgtggccaaagcattcctaccagcaggttgagcaaaacgaccaagggtcagcccagccttcttcacatccatggctggctcccggccctgcctgctccccacataggcgtggtgcgtgtcaggtgtgaatttcctgaaggtactaagtgcccgggtcagcattgttgggtagtggtgtgaggaaagccacgggtggtggcatgatttataccctgggggatgccagtggggagcgtggctcgtgtctgtacccatgtgcctggtcagcatcccgacctcagtgctagccagtgtgggccttccttgacgggcactcagcggaagacactcgaggagcggcagctgcaggactcatgctccgcaccgatgcaggagaaggtgacactgcacttgttcccaggcgagaactgtacactgacaccgctgccgggcgtggctcgcgtggtgcactccaaggccttctgcacagtgcactggcaggagggcggccggtgcaagcagagtgccaaggacgcccacgtgctgcccccagcccagatcctgggcatccagagtgggcagggcacggcccggggccaggtgaaatgcccgcggagcggagctgagggcaagggtgtggggcggccccctcctgcggctgacgccttgcagagctccggagagagttccc

SEQ ID NO: 81788 - DNA, 1044 bp, Homo sapiens
cggctaattttttgtatttttagtagagacagcgtttcaccgtgttagccaggatggtctcgatctcctgacctcatgatccgctcgtctcggcctcccaaagtgctgggattacaggcgtgagccaccgcacctggccgaccagtaacttttaaaactggcaagctgccaagcgactctggggacactgaggttgggcgtctctggccctggcctttgccgtcatgacactgtgctttctgagctcgatgattttcttgtgcctcctactccagggcacgcaagagccatttctcatgtgctgagtttggacattgtttggcccatttctgtcctaggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtgaggctgtggcagccacactccttgtgcctgggctgccctgatggcacctcaggcttcaggggccgtgccgaagctgagagcacaggtgtgcctgaggccggaccccactggccagctcgccactatccagatgacagggtgaaggtgcagaatcactgcctcctcatggggagggtgatgccagggcttgtcgtgaaggactttggggtcccagggcgtagaagctggtgagaagccagcctttgccagtctggtgactttggggtctgcttcatggggccagcaaaagccttgctaatgtgctgagttggtggttcaaagtccctgagaaggttgttttttttctgtttttctttacatgtaaaacctcagaatagagaatccttcagttaggggaggtgccagtaggttaacacaagtcccggaaagaatgatggagcaatctccaagtccacagtctaccccagctgcgtataggaaataatttaaattcagggatcataaattgtgttcctggtacataaa

SEQ ID NO: 81789 - DNA, 1032 bp, Homo sapiens
ttcctgtctcctcttcctgcaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctgggg

SEQ ID NO: 81790 - DNA, 1943 bp, Homo sapiens
ggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttg

SEQ ID NO: 81791 - DNA, 1080 bp, Homo sapiens
tcaggatggcaggtttcccttgaatagggcatgttattaaattcagaactcttatctgtgtgacttaaacatttagctgtttatttttaatctactgaagaacttttcatgggttttgtgagcagacacttcaacaggaaagcatgaaatgttcagggttaaagaaattctagagggaaaatctgcagtttgatgccatctcacctctagaggccagcctagatcagctcagttctagacataagggctgcaggcaggcccctgatccagccatggttttcaggggtttcatggatcttcaggggtttcagtctgagcatcctgccctgttggcctggagctcagggctggcactcggggttcctatgagaggaggtctccaaagcactgcgggggtggggtggggtggggtccggtggacgtctggttgctcagtgttctgtgatcgtttctgcagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggtatggactgcattcagacgtgacagcgcagcagcgggtatgccaggtgctctttccaaaaaggctccaaggcagatgcgacatgtttttagggagaatcatggtgggtgccgtagattatcctggatgcaagcattagtcatcgagtttggaagttcccctgagtcacccaggaaacagtccagccttgtgctgactgaagccgtgggggaagctcttctgtgctggtggcggacgcccactgcagacgggctgtggcggctcctcactgcagtgctgcggggcgcggagaagcggtggggagcggaacgtgccgcagacgagctgggcccttgtccgtcttccactcttcctgtttcaccttgcagaggaaaagtgacagttcttttctgatgggcttttccccgcacagtcaaggtcctcggctggttacctgtggagattgtcagcacttgactgaagcgtagctgacgcctctga

SEQ ID NO: 81792 - DNA, 1069 bp, Homo sapiens
gtgatctccagaatggaagcggttctgctaagaggtcaatatactgttagtgtttctgcttacgcctcctccatcccacagcagcagtggacaggctgttttggtttctttcagtcattcctagacatccaatcagctggcgggctgttgatccaaggaccatgccctgccccacctccccaccctcaccccccttccagttcctctcaaacctggactacacatgagtgatggccaggggtgccccatttcatccccacagaggcatctcccagccatctggaaggcacgggtctccaagcagctgtcatgacggccaggagacgctgagcagccaggctcacataagactaaccctcttcccaccccgctcatttgggcaaaaggaaatgaaaacatggctaccctatctcttgagtttctggtctggctccgggtggagcagtggcttctcttagtagaaggagatgctggatttgcctcccggtgggttcaggaccttgttgtgagagcgaggccgcggccccagccggggctcatggctgtcgactgtgggcatgggctcctgctccttggcggggcctgcttttctggcgctgcctttctcacctggctctgctccagccgggatgctccttgcagctgtgggacacaaagttagaacaacatcccattagaggcaacccatgaccctgacaggcaggctgtggaaataaaaagtgtgtcatagagcaacctgcaagaaattcatgctgtaactgggaaagagaagacaatatagacaggcttttcatctggtaccaaaacaactcactgtaattagcagatgcagttttgaaatgggcataaagttggggcttgctactgtaaatactccttgatttcttcctaagtgaattgtttctttatattgcttgttagacaccactcccatttcttccatctcaagtatagaaagcaagcccctgagagtgaccatgaggcggcgagggaatgcatcctaggtgagggcttagcaaggcaaaggcaggctctgttgctgttaccctgggcttttcaaaggtgaatg

SEQ ID NO: 81793 - DNA, 1042 bp, Homo sapiens
gactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaag

SEQ ID NO: 81794 - DNA, 1062 bp, Homo sapiens
taggctggtctcaaactcctgagctcaagtgatcctcccaccctggcctcccaaagacccaaagactacagacctgagccaccatgcccacctgttttcttgacaggacttgcatatgacaagctctctgcttctcctcacctatgcattgcaagccaggtcagaggcaggttaaacaccttaaggacatgttaggacaagtggcatacaagggaaaaaaacccgttcatttaagttacagaaacagaaaaaaaaaaactggcttattcccacacttactctactcaaagctttgagaagactaattttggcatcctctggctaaatacaaaacaacaaaacaaaacaaggcaaactctttcagcaagagctgtgggggaagggactataagggacacacacaactgacaggcaaaagctctgagcacgtgattgctaagtttaattcaactgttacaccccattctgccttgtaaaaataacaaaacgctcctatcaaaatgacattgtgatgtgagtacaggctttttgttttggtacagctctaaaaaatgttggcaccgaatgcacttaagaaaagtgttaaggcttaatacaaatacagagacgagtcatttctcaatgcagcttagagggtgagaacaggatgctaggtttttaaatcttccaaatacaggcagtccccaacgtacagacatacaggacacctcccaaatgtaaacgacagccacacagcagggcttgcatgcgcaggaactcttcttctcccagtgagcagactaagcactctgaatcccaccccactgcctcgcagagggaaagaaggcaggacagatgcaagaagagtaatgtcaggggctccatcacagctgcccaggggcttctgctgtagttcatattttcctcattcccatctctggtttctcccataacccagaagtccctgccaggggcggaagtaaagagcttttcctctcacctagcggactgcaagggctgggagaatcacagggcccagtaccgtcacgtcctatttcttcctggcaatctgatttggaattc

SEQ ID NO: 81795 - DNA, 1020 bp, Homo sapiens
tcatcagggcggccgggattgaggcgcaggcgctgagccttcacctaagtccgccgaagtgtgcagagcctggagacgggatcgaggtcaccggaagcccacggttgcggggacatgatcaagctacagcgcgctgggggaagcgaccactgccgccccgcggatcccaccggcctggccgggagctccctctgcccggctcacccgcgcttccggcccgaagcccggcttcctctgacgtcacggcccctgcgccccctggcggcgcggctgcggcgggacgcgcgggcaccgccccctccggctggagggcgggacttccggtgagtgagtgacgggcgcagcctcggcagcggcggcggcggagccctgaggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggaggtgcgtgggccgcgggacccgcccgcatccccgtcccggacccccagccagccccgggccccggacccaacacccgtcccgaccccagaccccgctccggcaccccggaccgcgggacccctggacccccagaccccgccccgagacccgcctggaccccatatcccccgccccgggacttccccaccccctctgcccgccgtgagacacctccc

SEQ ID NO: 81796 - DNA, 1443 bp, Homo sapiens
cgtgtttataaaaatcataacagtatgttgtatcattcctcctttcctgtggtttctattgcgtttgggcttcgtgtctgtcgcgaggtggttatgcattgattggaatgccccggttccagcaaagctgagttaaagctctcaacctaagggaacgcaaaggttcatggattttggagctcagggtgactataggcattttactgggaaggaaacttgtcctgagaagtggaggggctgaaccaaggtcacccaccccagaagtgcccagccaggatgcagagtgaacccgacaccggcctgggcacttgcttccatgtcaggcagctgcaggcaccggagggctgctccccagaagcctggagtgccagggctgccctcgctcagctgtggagctgtggctgccccctgtgctgggcaccgccctccactgctctcccacactcagtggcctgacctggatttcaggtgggtttctttttttcaccttgtacctgtgtggtcagtatagtggacgagaaggaactgaaaggagaaaatcaagatggacaacgttaaggctaggaattataaccttgccgcttaaaaatgagctgtgcacaggataggcgctgcccagctctgtgcggttcacatgcaagctgctgtgagtgcatctgccctcccccagggctcctgctgaaccaagctggcgggtgtgcgtgtggtttgcaaagctatcacctttagtctgagacccaccattgccccagcgctttagagaagctgcaccgagagcttcgggagccgagccccgaagccagccaatgcttggccagcatggaggctatgattaaacgctaacggggcgcccttggaaagacctcagggctttacaactaaggaagagggctcgatgctgtcaacatttggcatgcctactcctctactgaatcaagcagaccttcatttccaactttgtagaccattgtgccctgtgggtcggcgtcttttctaggcagggacttgtgatcacatagacgtgtgtctgataagaggggagcgggacgtcacacgctgcaggcgtgtcttgttgcagaggagctcctgggtgagctgtcagcagaagctccgtccccagccactctgctcaagaaggcttagtcagagatgggtaacctgagccactgcagcttctgagcagacagaatccgcagggttttataaaaacctgagcagagcagacatccctgttcccatcttcttgccggtcattaccacagtgactcccaatgtgctctgataacaggcagctgagtgtatgagagtgacaggagctagagagggtggggtctcccgagagactgacccaagccgtggagtctgcagaccccagcctgagtgtcagcccggccctcaggagccacacaccctgggtccatcctcttcccctcgctgggctgc

SEQ ID NO: 81797 - DNA, 1034 bp, Homo sapiens
taggcatgactcatggaactgaggaactggatttttagttgtatttacttgtttcggagatgaggtctcgccacgttgcccaggctggtctcaaacttctggaccgaagcaatcctcccatctcagcctcccgaatagctgggactacaggctcgtgccaccatgcccggctgtgttttattttaattaatgtaaacatgtggccagggcttccatactggacagtgtggctgtgggcagtctagctgagctgcctggaagcaagggcagatggtgagttactcagcttcatgcaagaaaggaagatgcttaaagggtgggtttgtttcctgtttaatgaacattttccagaaagaggggagatcccgtagcagtgggtttcagatacaggagaccagacaggagaaaatattgtgagatgggaaagtggatgccagcaacaggaaacagcagagaggggctgaagttctcgaaaggccaagaagagcctggtgggaaaccgctcgcacctcaggactgcctgtgctcagggcacaggatcgactttttcgccttgggctgctttttgttttctttctgtgggtaacaattttattgcagtatcattgacatacactgaactgtacatacttaaagagtacaatttgatgagttttgaaatacgtataaacaccagaagccatccctgcagtccaagcagcgtagacgcccggaccccagagttccctgtgtcctatgtaatccccctccgacccctccttgccccacctgtccccaggtaaccactgacctgccttcagtcactgtaggttaatttgcatcttctagagctttgcataatggcctcctgcagtgcgtacgtggtttcctctgacatcttccactcggtacagtgattcggggactcacccaggctgtgtgtgtccttcccccatggccaagcagggtcccagcagtgccgtttgtccatccgcctgcctgcaggggagctgggcggcttgtttttacgtaaccttcacgcatgagcggtttgt

SEQ ID NO: 81798 - DNA, 1054 bp, Homo sapiens
tgtgaccgtccgtgtaagcgtgtgaccgtccgtgtgagcgtgtgcacacgctgctgcccacaccctctaacacctgtctccttatcgtcacatgctgaccgtccgtgtgagcatctgtgtgaccgtccatatgagcgtgtgcgcacgctgtggcccacgccctctaacacctgtctccttgtctcgccctctgtgccatcaccacatgctgaccatccatgtggcgtgtgcgcattctgctgcccacgccttctaacgcctgtctccttgtcttgccctctgtgctgtcgctgccgtgtgctgccgtgtctgtcgctgccctgcagtcctcgtcagtcgtggaggaaaaggtaaaacccaagaggtgtgtccactgtggtgctgggggacgaccagcaggcacattagggcatcagttaccagcccagggcggctgcttggtctgctgtgaggtgtttcctgtggcagatgtgagaggtcggaagggccatctggccacattcacgagactgacactgagaaggtggcgaccactgggtcccctgcacagccatgcagctgggcagcgccgtccaggtcgcccacactctgccctcgctccacaagcactgccttggtcacagacgaaggcacggcgccgactcctgctaaggaggggtgtgcatcaggtggggctggtgctgactcggggggcgacgggccaaggaagggcccctctctgcatcagtcggacctggactcatagcccagctccctcactcaccagcctgtgtcagagccggtgacacacccatgacccccaagggcagcgtgacccccgagggtggcgtgacccctgggggtggtggtctctgaactagggagcatctgcatcccctgagggagctgcgaggacaaatcgggaggacggggtcagtcggcaaacgctcacgagcctgaggccagggcctgggggccggtggggaggagcaaaggaaagagtgaaggcagctcctgatcctgggtgatttctgtcggaggtggtggcctggctgagccgtggcccagcatggag

SEQ ID NO: 81799 - DNA, 1040 bp, Homo sapiens
gctgctcgagctgggctgctggctggcatggagcggccccatcactcgaggtctgcttgccctgggagggcttgggaaatcttcacggccaccctctaaccatcgcttcctctcctctcgccccccatttcagcaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccaggttttgtagccgtgccgtggagtgagaggctcctccctgttgctggtgttccccgttcactggggcgggagcctcgtctgcaggcagcccttcacggctctctgggccactcgccctctcccttcgtgtgtggcaggatggagaaacccagccagggtgtcaggggctcaggctgcccagcaggccctgtgtggctgtggctgttccacgcggcctcgtgtcggcacctgctagtccaggctagacctccctgcccttggatagaccgctctgtagccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtg

SEQ ID NO: 81800 - DNA, 1329 bp, Homo sapiens
tgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcatt

SEQ ID NO: 81801 - DNA, 1011 bp, Homo sapiens
tccgagggcagccgtgagcagggcagaggctgccagaccctctcctgaccccaggtgcccctgtgctctcccctaggcatgggcagcagtgacgagtggtctgatgttcaagacattattgactccacgccagagctggacatgtgtccagagacccgcctggaccgcacaggaagcaggtactggctcagcccaggccctggggtcctgggggctcagtatttatccaagtcggtgtctttggtgaagtcttcctctgccaccactgggagaaccatcaaggctgtggcctaccgcctccatccacgaccggcctgcagggcagtgtgggcattgaatggccacggtgggaggtgttggaagagtctgcagacgcagccactccgggctgcccactgactctgctctctctcccgacctgtggatcccaacagcccaacccagggcatcgtgaacaaagctttcggcatcaacaccgactccctgtaccatgagctgtcgacggcagggtctgaggtcatcggggatgtggacgaaggggccgacctcctaggtaagcgcaagccttcccccgcaccgctgtgcctgcacaatgctggggctttctgctgttggttttgtttgtaatgaaaggaaagtcctctgtcagctgtgagctaggaacctttttttttccagctttgttgagttgcgtttcacatggaattgtccctccatctccacaggggattggtttctggactgccccaaggatgccaaaatctgaggcttctcaagtccctgctctgaagtggtgtagtgtttgcaccctcccgtgtactctaaatcacctctaggttatgttgtagatgctgtgtaagtagttgctgttatgctgtgtcgtttagggaataatgacaggaaaaaagtgtacacgtcagtacagacacggccaccacaggcctgtacattttctgtgaggctggttgaatccacacatgcagaactcgtgggtattgagggtcgactgta

SEQ ID NO: 81802 - DNA, 1060 bp, Homo sapiens
tggccacatgccaggggccgtgacctctccctgcacactgcctgcccctccctgcagcggggagctgggctgctttggctccacggtatttggttcaggatgtcccttggcagaggctgtgcccaccaacagtcagggggctgtgctgggctccacggtggcctctgcagcaaggagccgtttcaggcgtctgtccagcagggagtcgctggtcatgcctgtgccccggcggcactccaggtcccggtctgtggaaccctcagtgactgtggcagcagagcagcctctgggtcgagcaggggccagctgtggcctccaagcccaggggcatagccggtgccaggaaagccacccttcccagctgggcacccagtgccgggaaagccacccttcccagctgggcacccggtggccgggaaaaggcgaggatgggcccaggcgggcctccctgccgtgacctcccccaggacaagcctggggcactgtgggggccgctcaccctggacagagacatcacccatcattcttccactcagcgactgcacgtcctccgcccgtcgagagcagaagcgcgagcagtaccgccaggtgcgtgagcacgtgcgtaacgacgacggccgtctgcaggcctgcggctggagcctgcccgccaagtacaagcaggtgcgggcgggcgctgcggggaccgggcggggccccgcagaggcggggcgggggtaaggggcggggcgctgtggggcggggagagggcggggcagtgctagggggtgggagaggacggcgggtggggcggggcctggcaggttcctagtgagcctcctgggcaggggtctggagggtcggagaaggagccccgcggctcccacgcccccacctgcctccagtcttgaagtggctgtgccgccagaagctggcagccctacctgtctcagatttctggagggatgggtaggagccagggttcgtgcccacggcgcctccctgctccctgcagctgagtcccaacgggggccaggaggacacgcggatgaagaacgtgccggtgccggtgtactgccgc

SEQ ID NO: 81803 - DNA, 1101 bp, Homo sapiens
tcggcctcttctccctacctactcaggaccccacgcttacctggttagagggtgacgggtgggcacggcctgcagcttgaagcatcactcggagaccacaggaaaacatttcctcatgctgaatgtgaaacctccagttgggccgaaggggctatgggggtgtgggtgaggagcttcgtgtcacccctgtgggcagtagccttggtgatgttctgggccagccccaacactgggaggacgaaggggtgccgagggctctgccaggtctctggtgtgaaaccacagggccgtctggggtcctgagggtctgccacaggatcacaggttgtttgctcccagaaccagagtcttactactcagctccccttggcccaggggcctacccaacagagcaggcttgctggagtcccagacctccaggcagagggtcgtgggtgggctgtgggtggagcatgtgtggaagctgggtctgctgggaaagtggaaggccagccccggcttcctctgcccctgtgtaagtgctgggcacgcccttgcagtagtgggttcccccgcacaggctgacgggccgtccctctccccagcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggtgagtcctgggcgagtttcccccatcccctcattcccacgtttctgcccagcccaagctcacctctcctaacacaggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcaggtgagctcttgggctggggcaggagcagagggaaggcttgcagaggtgggaagggcctcggggtctt

SEQ ID NO: 81804 - DNA, 1102 bp, Homo sapiens
gcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccaggtgaggctgggcccctcctgccatccacatcccctgcatgccagtggccgccgcctcccccaggaggccgctgtcctgaatcgcttctgccatcccagggaacgtgctggccaccctgaatgggagtgtgctggacagcccagccgagggccctgggccagctgcccctgcctcggaggtcgagggccagaagctgcggaacgtgctggtgctgagcggcggggagggctacatcgacttccgcattggtgagcggggcccagggacagggctgaggttgggcgcggggggagcctggccgtcactctgctgctttgcccgcaggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggaacttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggc

SEQ ID NO: 81805 - DNA, 1076 bp, Homo sapiens
ccccgactgggaggcgggcccggccccaggcccctcggcacgcgcgccccgcccagtcggacagagggcgccgcctggcggagaaaggcctttcctaccccgagtatcgcccgtgccctccgccgcacctgtgtccacgcacaccgcgaggcgcttcaggacctgctccggccgcagcagccgcaacgcctcggcagccgccctgcgctcacccgctgggtcccgggctctcgcggcggcctccgagccggcggagtcctcagcgtcggagtctgagatctcccaggttggaggtcgccgctgaccgctcccgccccgtccccggccccggccctggcaagagacccccgccctcccgggtccaacccgcgccatggccggaccgacctcttcctcgcttccggccgcgaccgaacactttagcctgggacaccggcctcttccggtgacttccggccggaccgctgaggacgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcaggtgcgtgcaccccgtccgcaccccgcccctgcagccgcctggtctccccgcctcccctcctccctgcaggtttgcgtggctgaggctcccacctcctgacctcgggggccgagagctttgcgagctgaccccgcttccttctggctttgcagaacttggaccacgggaaggcctggggcatcctgaccttcaaaggtaaggctcgggagagcgggtgcccggcagttcgatgccgaccgccgacggcacagcaagtgtgtgcagacgcctct

SEQ ID NO: 81806 - DNA, 1013 bp, Homo sapiens
taccgctcactctcatgcccacagcagggctggctgggacgggggttcaggggaggtgggcacacttctggggttgctgtggcacagctgatcccacttctccaggtgggctctggcagaggccaagctcgggcagggcaggccccatggggagcggggaggaatggtcacctctgctcaggtctcgccagcacgtttcccgggggacacagcagccagagagcccgaaggtggccggtgccgaggtggccgtcagctggccggaggtggaagaggtgagggcctgtctgagctgggtgagtcaggtggcctgggtcccagtgattgggctgctggctgggtttggttcccagcgtggtacatggggcagctatcagctgtgtgtcccgggtagccttcctctggctcgtgcccatcagcttgcctcctccccaggccctggtactcctgcagctctgggcaaacctggacgtgctactggtggcctcttggcaggagctgagtcggcacgtgtgcgccgttaccaaggctctcgcccagtatcccctcaagtgcgtgatgccaaggctgaaggggggcaggatcacctcaaggtagtggtgcctccccggccttttgggagctgctcacatgaggttctaaaaggcttctctctgtccccaggcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggtgggcccctgcctcctccaagccctccaggtgcagaagccccgtccccaggcgccctctcatgcctttgcctgctcctaggcgctggaggcctgcagcacggagcgggagcgcatgggcctcctggccgaccttcctgtgccgcccagtgaaggcgggc

SEQ ID NO: 81807 - DNA, 1063 bp, Homo sapiens
gggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatggtaagttgcttcggcccagggtgcttctggggaacctggctccggcagcccagccccgcgccctctgcctggcccctgttcctagatggtgggcatcgggacgtcggatgtggacctggacaaataccgccacacgttctgcagcctgctgggcagggatgaggacagctggggcctctcctacacgggtgcgtgaggcccagggtggggcggggccgagcctggagctcccgggctcactgcgaccctggctgcccccaggcctcctccaccacaagggcgacaagaccagcttctcatcgcggttcggccagggctccatcattggcgtgcacctggacacctggcacggcacactcacctttttcaagaacaggaagtgtataggtgaggccgtcacaggacttgagctcctctcagctgtcaccccgagggaggcagccaccccgccccagcccaggggacactgaggttttctgaaagggttcctcccagaagcctgaggccccagggtcccagggggtgggacagtgaggccaggctggagtggcagggccagcgcgtgcaccctgccttgcctcagctgtgccagctgcccacccgggtgactgtagcgtgaggtctgaggggctgcgcccagtagctggccccttccctgcctggggttcaggctgggcccctcccttccaggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctc

SEQ ID NO: 81808 - DNA, 1039 bp, Homo sapiens
gaagggtgggaggggcagagggcagcggccaccactccaccctgttatcttggggcccagtggtgccaaggcaggcggtttctggtgtggttgctggagtcttcatgggaggcacacgaaggagtctgtgatatcatgtgagacccgggaagggccccttcaaccgcccctttctgaactgcgggtcaggcaggctcccctggggaaacctgggcgcgtaggaggcacctccacctgctggagctggcccaggctggcctcccctgcagacaggccgcgtctagggccagctgctcatcccagacgcacccaggtgattcccatgctgaacagtttgatctcctgccagagtgtcgggccacaaactgggcagcacatcaggatcacctgggggccttcaaaaatcaaaaatccacccccaggccatgccctggacccactgcaccaggacaagaaatccaccccaggcctctccccagacccactgcaccaggacaagaaatccacccccaggccacgccccagacccactgccctaggatgtgggggtgggaaccaggtggtgctttgtaaagacgtgcaggtggtaaccccaggcccccacgctcggaaccctggccacaggatcatccaggtgtctgtgatttgcttcctcggtttcctttgtgagtggaaaataagtgttgcgtttgactagggtttaagagcagcaggcagcccctcagctcagcaggcagccccctcagctcagcaggcagccccctcagctcagcaggcagcccaggtctcctgtttgacttctagggaccatgctggcgggaatgagaaactggtcaagctggagtcgggactgaaggtgtacgggggtgacgaccgtatcggggccctgactcacaagatcactcacctgtccacactgcaggtaaggagtgagccctggaggtgctccagcgtggccctgtcaggagcgtgggggaggggggtccctccccgcattctctctgctcccttaccccagtgacccgggagtgctctcagt

SEQ ID NO: 81809 - DNA, 1024 bp, Homo sapiens
atcgagaccatcctggctaacaccatgaaacccgtctctactaaaaaatacaaaaaattagccgggtatggtggcgggcgtctgtagtcccagctactcaggaggctgagacaggagaacggcgtgaacctgggaggcggagcttgcagtgagccgagatcgcgccactgcactccagcctgggcgacagagcgagactccgtctcaaaaaaaaaagaaaaaaaaaaagacaaggtcttgctatgttgcccaggctggtctcaaactcctgccctcaagcagtcctcccatctcagtctcttaaagcgctgggattcccggcaagaaccaccatacctggccagaatattccttttcaaaggaacctagaaaggctgggaagcactgcagcttgcgcgtcctgtcgtggagggcctggcgcggctgcccgctgagttgtgctctgtgtctgcaggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtgcgcatggctgtgcctggctctccctgccctggtcacccagctcggagtcctcacccccgatgggtttcctaaccgcagtgtccttgcaactttgcctaagctaaatggaaattagtctccggccactctgttaacagggctccaagaagggtggaggcgagaggcagtgacacagaaagcgctgtgcagtacaatcctgggcacttgagtcttcttgggggctttctgcccctgcatgctgcctctgggggtggtgccctcagagctggaggggcttggagcggtcgtaggtggttgcaagagtgtcaggctgagcaggaaggagaaggtgctttcactggctctcctggagcagggcaagctggcagggtcaggacgggccatgtcagcggcc

SEQ ID NO: 81810 - DNA, 1544 bp, Homo sapiens
gcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctggtcagtatgacatttaaagtggaaaagccagaatattgagttatttcttaacaagtttcgagagagaagggagcaagacaagagcaagcaacggctattaaatgtcacaatcctttaattagaaaccatttattggccggacgcggtggctcacgcctgtaatcgcagcactttgggaggccgaggcgggcggctcacgacgtcaggagatccagaccatcttggctaacagggtgaaaccccgtctctactaaaaatacaaaaaattagccgggcgtggtggcgggcgcctgtagtcccagctactctggaggctgaggcaggagaatcaattgaacccgggaggcggagcttacagtgagctgagattgcgccactgtactcctgggcaacagcgagactccgtctcaaaaaaaaaaaaaaaaaaagaaaccatttattttaaaaatgattagattgctatgcctcaactcatagaagatgaacccttcaagaaaacgtgaagtagaacgggtgggccagaaatgaaaacaggcaagtaaagtatttcttcggaaaacattttatcaaaccaaatgttaaaaagactttccttttgtaaaactggattagagaagacttttcagtgggttatctctaggatgatcagtagttcagcacttaaaaactgcagagaaaactgaaagttatgttccagataactttccgttgtttaccaaattttcttagatttggtcatcatcaggaagcatttgtaaaaataaaaatctccacaaattactggcccatctcggacttgctgaatcaatttgataggattaatctccagtgaagctgtgtttacagggcattccaagtgattcttatcaggaaatgtgaaaaacactcctgtacataatcggttaatttaaaattttacttaataagtgaacaagtaatgaagatttcacctgtttacttagggtatctacccagacccatcgattctgagttcgggagatgattttgaaatta

SEQ ID NO: 81811 - DNA, 1001 bp, Homo sapiens
gaagcctgtggctatggagaccccatcccaaagacgctgccccttggtgaaccttcctctcccctcctgtaggcagacaggggaggtgctgagcacaggcctcagtctgaagcctgtagtccatttctccaggtatgggttctgggaccatccagctctaccaccagggacaccccaggtctgacctccttccttcctgccccccagtcccaccggaagttttccgcccctcggcacggacacctgggcttcctgccccataagaggagccaccggcaccggggcaaggtgaagacgtggccgcgggatgaccccagccagcccgtgcacctcacggccttcctgggctacaaggcgggcatgacccacaccctgcgggaggtgcaccggccggggctcagtgagtcacagttgggacccttgggggagggggagggctgaaccttccagatgctcggagccagaactcacgcttttggtccagacagggccacagtcccagggagcaccaggcctcgcccccgggaattggggtggacgctgagcacaggcagggcttccgggcgggttctgtcatggccccagctcgcagatgaggacattgaggcacaaagcagtgaggaacctggtccagtcaccggggcggtaagcgcaggagctaggattcaaaggccagcgccccaagccctcggttcaaaccacctgccaggacatctgcactttttggccatttcgggtctatttcatgtaccattatttcatatgtacgcctatgtatatagttagtttttgttgttttaatcgtagattcacaagtagttgtaagaaataatgcaggccgggcatggtggctcacgcctgtaatcccagcactttgggaggccgaggcaggaggatcatttgaggccaggagttgcagaccaacctggacggcatcgtgaaaccctatctctacaaaaaatacaaaaattagctgggcgttgtggcgagtgcctgtagtc

SEQ ID NO: 81812 - DNA, 1034 bp, Homo sapiens
agtccatgaggggcccttgtagagagcggggcccagagaagtctgtagggactaggcaatccaggaaagcttcctggaggagtagggtgtttggaatcgcgtgctatttgttcactttgtcgtgtgcgctctaacggcctgtgttctccatcacagtttatcttattccctgctgcactcagcacagtgcctggcgcgcagtgggaaccgaatgaccccctcctattccttatgtcagttgccttttgtctgtttctttcatcgtaagcaggaatctgtccggttcgcggctgcttcccaggcgcccagaccagcgaccagcaccgcgtaggcgctcggcacagaccgagaacggaggccccacgcgggggcgccctgcggcgaggcgggtcccggccgcgcccggcggagccggggaactacaagtcccatggtgcatcgcggcgccagcgcgcagacgcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagaggtacgaagccccagcccggggctccctcgccggcctctggggacccctggatcccacaccctgcctggatcctccaatgcctccggggtcccgtctgcctgagaccgccccccgctgcaccccggggacaactccccacccccggagacctccgagctccgtcgcctcctttggcctcccactgcaccccggacctcacctcccaggatcccttactctcccctgcaccccgggatgccccgcttcttcccaggactcttccctccctgccgcacccagcgcccactgccccaggaccccgcactgctctccgccccccgccgccccgggcacccc

SEQ ID NO: 81813 - DNA, 1035 bp, Homo sapiens
gtagcagttgtagagcatgtctgtcctatgtgtctggatgttcgagctctccttttagctcgttcatttcccagtgaggaagctgaggccgtaaggtggtaagttctgcttgctggaggctccctgttggagcctctttgcgcacccagcagggtccctgtgcagctgggggaggtgcactggcagagctgcgtcccagtccttgccatctgtgagaagcagctgcctgtaggcttgtgtgggggacagagtaaggtaatgcatgtggaactctgaggatgatgcctggtactcgggagctctccatcagctgtagcctaggccttcacaggcctgcctggctggccacatcccttagagagacgaattgctgttttctaaacgctggaacactcaggaagttctcctctctcccctccaaagggcttatgagaaataagaaagctaaaagcctgtccaaaccgatgaggcatttgagtctgtggctttgtctttgcagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactagtacgtgagccatgctgggagtgtggagatctgcaccgtgtgctgctgggacactagtccctgggatgccacagggtggcatgcccagattttaggggtgacatgggaggagccagaccccagggctcttgctttcaattgttctcacagggtacaggaaaaggattccttgtgattagcctctcttgctccttttctccaccagcaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctgtgcgtgccccacccacccccaaccccccaccatcctcctgaggcctggggg

SEQ ID NO: 81814 - DNA, 1914 bp, Homo sapiens
gcggttacacagtttcgccctatcgcctaggctggcgtgatctcggctcactgcaacctccacctcccaggttcaagcgattctcctgcctcagcctcctgaatagctggggttacaggcgcactccaccatgcccggctaattttttgtgtctttaatagaggtggggtttcaccatgtggccaggctggtatcggactcctgaccttgtgatccgcccacctcagtctcccaaagtgctgggattacaggcttgagccaccgcccccggccgtgactttggttcttgaatatcataatggtattaagtttttttttaatgctctccctacaattttcttgtttgtttcaggaatcagagatcattgatttcttcctgggggcctctctcaaggatgaggttttgaagattatgccagtgcagaagcagacccgtgccggccagcgcaccaggttcaaggtacccggctgtcctggagggggctgcgctgggcttgccgggactctctcggctctgcatagttgcacttggcttcacccgtgtgactttcgtaacggggagagagagaaaagatctcctcaggacctcggatgggccttactgtggcctctctttccttgaggggtgcaacaggccctgggcggtgggcagtgattgggtgtagggccaccagctgcctcacacacatcttttcgcaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtaggctggtggcaggtgatgggcctgccgtggggcaggctccctcgggcccccgtctcctgactccttccctcaccaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcggtaggtggtccacacatggggcatagccatggtctctcagctccgcttaaccacacgggtccagtgtgtgcttggcgtgttttcagggaggcagagaaaggctctcctaatgcacgacagacccgcccagaatggcctctctgttcctaggagtgcgacaatttttgggttgggggacttgcctcaagcacaccactgaccctcctggggttcttttgttttgcagccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgttactgtttttttcccgtgtcctgcatggttagtggtggtttgaatctggggcgtggggccaatagatcacaccagacacacaggcaggttgcagggctttatatttcagcaacagtcatacagagccacacagcaggggcacccacagctgcctcaggaggtggcagcggcggcctcttttgcagcttttctctcttgcagcatcctctgcctctgtttggccaggcacttcctggcagaactgtaggcccccaggtcctgatctggggaagcaatggaaacaagctgggaaccgaggcctctgctacatgcaaagggggcaaagtcaagtgagcacaagggaggggagggaagatttgcaatgg

SEQ ID NO: 81815 - DNA, 1096 bp, Homo sapiens
ccgggggctctgggcgccgaatctcacccgcggccacggccaaagccgggggcgattttcaaccaacgccggtctcgaagaccaccagcgagacgccagtggtcaacgcggcaggacctacctaagtgaagaggagagcgcaatggaggcgcggacgtttatagccactcttcgggtggattcccgagccgcggctggggacggaggcgccggcgtttatagtcgcttttcgggtgacgtagattcccgggccgcggctggggccggacgggcaagagcactcagagcccggtgagggcggggcaccgcggagccaatcacaggttgtcttataggagctcggcccgctcccgcttggggcggggctgcggagatctcgcggcgcttggcgtgctataaaagctgcttcccagtaggtctcgttcttcttttccgacaaaacacgtgagtcctgttggtcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggaggtaggtatcagccacgctcggggtcgggcccctgggcggcgccggagagcggtcctggtcactggcgccttttctccctttagtggatgcccgtcaccaagttgggccgcttggtcaaggacatgaagatcaagtccctggaggagatctatctcttctccctgcctattaaggtacgcgtcggtcgttggggcgttgagcaagtgcgaccccggagtcatttgggctggggttggaggattagcatctgccattgactcgcattaaagggcccagcgtctcgcgtgagaggtt

SEQ ID NO: 81816 - DNA, 1060 bp, Homo sapiens
tgtgattggctccgcggtgccccgccctcaccgggctctgagtgctcttgcccgtccggccccagccgcggcccgggaatctacgtcacccgaaaagcgactataaacgccggcgcctccgtccccagccgcggctcgggaatccacccgaagagtggctataaacgtccgcgcctccattgcgctctcctcttcacttaggtaggtcctgccgcgttgaccactggcgtctcgctggtggtcttcgagaccggcgttggttgaaaatcgcccccggctttggccgtggccgcgggtgagattcggcgcccagagcccccgggggcctcagctcaccgcgcgctgccccatgtgcggcggtgaaacccaggccccgacaggcgctgccgcctcccccccgggtgcggtcgctcgcgaggtctggcccctgactcctgaccccgactgcagacccctaaccttgttctttctccgcaggacactggtcctcccacgcctgacaccgacgtcgccaggaccgcggggttgggggaacttggctgtcccacgtctttcaaataaagctgttttgtctaactcactgcatgcgggtgttcttggggccccgactcgcctatcagcctggcggcaagtgcatatgttcacgctgtggcggggagaaccctagcgagatgcctcctcttctttcctggctttggacacaagggtaggatatgggaggttggcaggtgatgtgtaaggtccgacgcctcttaagtggaggagccagactacgaacagtcttgtggccatgcgcatctcaagtgaactacactggcaggtaaaatgccttggtccaaagggctccaggtggagccagcagagcactagcaaggatgggaagctcagaggcttccagtggcttccttgtgagaccaggtgagattctaaaggatttgaccaactaggcctagatgaactcagcgcccccgtggtgctaggctggagtggatcagacacctggtttgggaggctgggccccctgctctggggcggcaggttacccgggagtttagttgtc

SEQ ID NO: 81817 - DNA, 1028 bp, Homo sapiens
tcatttacctacgttatttatcaagagccacactgcgagcccaggggcagggtcaggttgacggctctacgcacggaccgcacccgacagctggtacccccacatcccagaacgccgaaaagcaggagtaaacgctggctacaaatgcctttttatactggtatcaaagagccaggccaccagcgatgccacatccgccggtctacccccaccgacccgcgaagcaccctcacagctcacggccctccctccaggccggaaacgtctccgcccgcttccgcttcccgatgcagccgccactgcccgaagcaaagatggcgccaagtgcgcggcgccggcggggacgtcacagtggtcgcgcgcggtgacgccatcgcagcgcgccgggagtgtggcgttctgtgaagagttcggtgctaacctccctcacgcggcggtggctgccgggaccctagcaggtttcagctggagcggcggcggcggcaacatggcagagaccgcggccggagtgggccgcttcaagaccaagtgagcccggagctctggggccgtgcggggagggagctgggtttgcagccggcatagcggaggcgcgcgtggggtgggcacgcattggggtccgtggaggcgagaggctgtgtgtgcgccggcccgcggggtcgcggaggctgcggtgatactaggcgggagagccggccccggctgctctcggggaggacggcgatcggagcccggccgccgggagcagcagcgtgggctcatcgagaagccggctatggggtggagtggggaccagaagtcccgatgaggggaggagagggctgagcctaggtcggggctggtcccgggaggcggcgggggcgaagaaccacctctgagcagtcggcctggggacctttcatccgcgatccgtcttctccagggagcagggagaatgcaggagaggggcgggtccgcagaagcccaggaggccctgagtgctgtgccccgtcactccccaagcctttgccgaacagcagtgctggtgc

SEQ ID NO: 81818 - DNA, 1537 bp, Homo sapiens
ggggcacgagtgaggtcacagaaatgacagctgctcgtgggacccgggctctgggcaagcctggggatggagagaggagtcagggaggggaagaggtatgccagacctcagggatgaagacactgggaggatgtgctctgggctggctacccaggcctggccacccaccgccggcaggggtgttcccaaggagccccctggctctcactggggaatccctggaagccctgggctgttgggctgactccacctgacacaggcccaccccctactgcctcagggatcaccagccagctgcgggtctctacttctcagtgacgacggtagctacagccccctgcagtactgctggttccaccccatgccctgtccctgctgttgcccagaaactcaagggcaggggccattggggtcacttggagaggagcacctagcacagggcggggccctggggactgagggggtgggtggtgctcattcgcctcccgctctccttccagctatgctgtggagcgcaaaattgagcctttctacaagggcggaaaagcacaggtaccagcctggggaagggcagtggggcgggcagccagaggccgcggggggtgctgaatgttgcctggctgagacctctctgtccccagctggaccagactggccagcacctcttctgcgtctgtggcaccagagtcaacattctggaagtggcctcgggggccgtgctgcggagtctggagcaggtgagggcagcctgggtgggtgaggggcaagtggagagggcagcccactcacaccgtgctcggcacaccactctttctcctaggaggaccaggaggacatcactgcctttgacctcagccctgacaacgaggtatgtggggcggggcctggaggggacccgctccagcgcctccctcccagactgagtccaggaagatgtgagcagggtattgctgcccctctgctgacctgtaccctcccccaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtagggccctgccgtgcaggtgggtcgtgggcacagatgcaggggctttgggcattccaccccctcaccttgcttccccgcaggtggctgtgatggggccgtgcgcgtctgggacatcgtgcggcactacgggacacaccacttccgaggctcgcccggtgtcgtgcagtgagttggaaggtggagggggagggcagaggcaccacccaggctgcacagctcacccatcctgtcccgtccgcccacagcctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccat

SEQ ID NO: 81819 - DNA, 1035 bp, Homo sapiens
gggggtggcggggggacctgcctgacgctgagcctctccccaccccaaacccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggttgtgggccccaagggcagggaagagtcggggtggagtggaggccccatctgaccctagtctaaccccaggatgtgaccgaggcggagcaggcagaggagcaggccaggcaagaggagcaggtggtcaggtaaggccagggcagtggcgcccctccccgcatcagccctgctctgtgctgtagggaaaacgaggctgagtgccaggctccctgcctgctgactccgatggctctgcctgcagccccagccagcggccctcagtggcctctcctcccctccccacaggcagcaagagctggacaacctgctgcatgagaagcggtacctgcgggcgctgggcctggccatctccctggatcggccccacaccgtgctgactgtcatccagggtcagtgcccaccccggggggcgaggggctgggtcttcggaccactgggctctgctttccccagctcagccttcccttctcccacagccatccggagggaccctgaggcctgcgagaagctggaagccaccatgctccgactgcggcgcgaccagaaaggttggcggccagtcagggtgggtggcccggtgggcaagggccagtcatggcagattggctgggcaagacgatgagggtcctgttgcccacagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactggtatgtgggcacagcctggggtt

SEQ ID NO: 81820 - DNA, 2490 bp, Homo sapiens
aagcgggacggccgccacggacggcgcaacccctgcgtgcgccgcggatcgacgcctgagggcgccagcagggtccgaccctcctgctccgtccccgcccctgtcctcgggcccggccagcgccgcggcctctggctccgcctccacacgggcccgcaagcaggcaccgcccccgactctgcccccagccccggctcgggcccggcccccgcgagcacggcgcgcgcctccggctcctgtggccgcgcgctggcctggaggctgacctggaggctcatctggaggccgagctgacccggcaggccttgcgcgggcaacatggcggcgcccggcgagcggggccgcttccacggcgggaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaaggtgcagttccctgcccgatttctcccagccccgcgcagcccctgtccccgcccccgcccaggtaccccggcagagcttcccagggttgcctgtccctgaaccttgccccccgggtaggcccggccttacagccttcatccgcgcgtgggttggatcgtctgcaggactttggccggagtccagtgggccaccggctgggccgtacagtggggagctttgggcgcctttgttcggagaatgaactcactctcggtcggcctgcttccgcagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggtaagatgtgtttgcacgcagcagagctttgcactggagcctgggcctggggctcctggctgacgttatagcggggaacgtagagaaacggatgcagaggtggcagaagtttgctgaggagcagggacctccaacaggtgaggactggggctatctgagcctcctcctctcgtctcagaagccaagctgtcgggatctgctgctgggtactgctcctgccacagccacagggcttccaggaagggattccctgccttgtctggcactgaaggcggtttcccgcaagttagggaagactccactttgcctgacttctagagtaggacttctggttttaaaatcttggaaatccactgcttttgctcccaagagccatctcttcctcactgagggatccaagagccagcactggcccttgcaggtgtttctaggccagatgtatagggtagagccgccattgttgctataaggctggtcagttagaatgaagtctcttgctgaactgacgcaccagggcctgccctcagatgctaagaaacaagtccagttttcagttacaaggctgtgcccagccccacccaggccacactctgcctgaggccagggacactggatgccgcttcctgggtgttaggagcttataaaattgccaggtctgtgctgtaatgtgttgccttgaggcctcgttggagtttgccaagctgtccaggtgggtgtttgcgcagccctgggagttcatcacacccggggagctgcagggtcagccctgttctgggagtgcctgtaccttggagcataagggcactcccaggtgtagttcacagcagtgccccagctctccttccttgacagcagacagggaactggcaggggcagtggagccgctgcgtcctctcattctttacctgctctccctacacaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagccagagcctgttgtgtctcagttgggtggtccccaggacactgcctgtggggacctgccctgcccctcttaggtttggagcagaagtggaggtgcccacagcaggtacccactggccccctcctcagtggagaccccaaggagctgcagctgaactgcaggggagggaaggaggagcagcctgggctgccccttgacattcaggatgtagcttcctgcccaccgcataccctggcgcctcactcctcacacgggaagacagcgggcctggctgggcatccc

SEQ ID NO: 81821 - DNA, 1048 bp, Homo sapiens
tagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcatgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgcatagctggtgttctgagcttctctgtcttctgagtataccctgaagccaaatttagaaacagggtggaggggacatctgaaatactgcagcgaaataatttgagcgtaattatctggatctggtgtttttggagggagaccagacacatacggtaatcactttctgcttccagcacatagaagtaggaaaaatgctctaaacacagccacattcaaataaggccaagaatatgtcctcagatcagagaaagtggggaaatttctctaaagcaagcagaaaggggctcccatggtgatgaagagccaaggtcagtggctgcagaggggctgggtcagccatgtggcggcattggcactgcccccctgtagctgaggacttggacactgggactcaactgtgtcccctgggtgatggccatgctggggctggctaggagatgagaggctgggtaggggccacctgcattc

SEQ ID NO: 81822 - DNA, 1758 bp, Homo sapiens
gcctgcccccacgcctggcttgtttttctatttttagtagagatggggtttcaccatgttggccaggctggtctcaaactcctgacctcaggtgatccgcccacctcagcctcccagagtgctgggattataggtgtaagccacgatgtccagcttagtggccagctcttgatgggcacggtgcctgggacgctccaggccttcacctgggaggttgaagagcaccctgcactgccagtccccagagggcctgtccccacaccctgacctgacctgggggccttgtgttcttcataggccccaaggaaacctcgacaaatggtcctgtaagccaagaagccttctcggtgacaggcccagccgccccagggtgtgtgggggtgccagggtgagagtatgggcgcccaggggtgaatggtgcatggtgggcgggtgcgggcagccacaggtgggtgccgggagggcaggtatggagccacggggcctgatagctgttgaccagctgtgcttccctgcacccagcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacatggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggtacgcgtgctggctcaggcctgctccctgggtgtcgggaggggccggggtcaggctggagccgcaggcacagtctgcatctgggtggtggggacccctgtgtgatgccatcggccacccacatgacctccagcctcccgttaaccaccctgtgttccttgcctctgtgagaccggccctcatggcgcctcccaggtctgagggtgcgtgagcttgtgtgggctgggcctgccacaccagcagcagtggtgtgggtgctggccctgcacctgccctgcagggaaggggtggctgtagacagaagctggccctggaggccaggcagcccgcagtcagcgagggtcctctctgggtcttgtcctgccacccctcaggcttcagcgctgtggtgctcctgaagggcacgcctcccccacccccgccgggcctggtgcccccaatcagcaagccgccccctggcttctctggccttctg

SEQ ID NO: 81823 - DNA, 1772 bp, Homo sapiens
ctctcggtgtcttcctaggcagctgctgcagcacgagtgcccgcggtgccccgagctgccacctttcagcctcttcggggacctggagcagcacatgcggaggcagcatgagctcttctgctgccgtctgtgcctccagcacctccaggtgtgcccccccagcgaccccggagagagcctaggcggtgggtggtgcaagggatgtggccacacggctgggaggggcttgtccacctgctgcttctggccccggatggccccctgagggtcaggctgcacgtggcagggaggcctctggctgctggcggggccctctcccgccccttgctgctccgccactggcctgtgggaagaggcaggaggcttggggtcccccagcctgtgcccagcctcctgtgccttgtagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacaggtgggccgggcagcagacagacagatgaccctccctccccgagggcgtggggctaaccgggctgcagccctcctaccgacaccccatctcctgccagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggtgagcaggcacctggcctggatgcccccaggtggggccgcatgaccatgccctgctctggagcctgagatgagaccgagctgtgggtgcaggagctgacctcccaccctccggccaggctggagcgcccgagcaccccttgtgtgccaggagctcttgctccctcagggtctcgggtctgctgccctgggtgcccggggcccttccctggaccaggaggcttttactgagcatctgctgtatgcagatcccacctggggctcggggaccctcctcctctcccttcccactgctcctgtggcttggcacccaggtcgtagaggcccgtggctggcgtggaccctgcgaggctcctgtgccactcccgggctcatgtgcactgtgggtaggaaagcctctgccatccaggcctgagcattggccgggtgtggccttgacggcaggcctgttcctcctattgtcgtcccggggtcccgggaagtgacgggctgtctgctggccgcaggggtcgttggtggcgaagactacgaggaggtggacaggtacagccgccagggccgagtggcccgggctggcactcgcggagcccagcagagccgccgaggaagctggaggtacaaaaggtgggggaccttgcgtgccgctgacattctcctgtggtgaccgtggccagtggccaagctgggagtggggatggggtcagggattgtggccagagttcctggggtcctgagtggcagtagggtctgttgagggtccttggtgggcacaagtttctctctcttttctccagttctagccacagccacagatcccagggttggggtgggtgaaagggg

SEQ ID NO: 81824 - DNA, 1765 bp, Homo sapiens
ttgtttgcttccagcattgtgaaattcccccggtttgttcatagaaggcttcggctggtgacatctgccaggaatctaactttcttctccccagaagtgatgcagagcagtattgaggtgtaggttctttctttttttccttttctttctttaagtagacgtttacatcaaaggagttgaagagatgctgcaattctctgagcaatttgtgggcttatagtctgtgccctttttggaaaaagacatttggagattctatcagtctgtcatgtgacaggaggaggccgacccagaccccggggagatctggggtgcaggaacagtcacagaggaccttggcccgtggcttcctcagggcgcttcctggctttgccagggcctgccttgccagccagtcctgcatagcatgacctcactctccaacagctaggtttcccagcacacctgtagcttccttccggaaagaagacgctaaggagttcttggcacgtgaggtcccgacccaggctgcaggtctgatgcaagacatgagtgaacatctgcgtatgcttactgtggcagcctctgcccgctctcattccttgtaggccccacgccctccaggagctctgtggctgggggctgcggacatgagctgtcagccggggtgtggtttggcactgggtgcccccagccggcttcctctagggcctaccccgccttactgggctgaaggaggggctcctggaaagtttgctgtttgctggtctcctctcctttgcattcgttctattttcttcccatcttgagcttgccgcctcactctagtctcctttttccttactgagttcagcaccatcccctgaatatattctgtgtcccatgcgtgctcaggaattcccactgcaaccctcaactcctgaaccctggcgttgccttggcctcccttatgggactaaggttttgcgaaaattgtgaggaaagtgtccaggatgccgtgtggaatcggctggctccatgtgcttgttagttccacacacctggacccaggccttccctgtggaggctgcagctgctgctcaggccaggagccagatgggcctgacccctggcaggtgctcagggtggaagccgaggcaggctcccctccgtgggaggtgggggcgctggtcttggccatggctgacagaggtcctggggtggtggagccccacgttctgggcctctttcctggctgcgtctttctcaagggccggttcctgctgtttgcatcttgctctccagcttgctctggtccctggtgttactgcaggagtcctgatgaggctgcaagccccccagggcagcccacctgcaccttacaggcaggcagtgggagggggcgcagagggccagcccacagttacccaaggtcccaggtcaggagggtgacatgctggcttgggtcatgctttcctactcctactgctccccctccgccctgctcccgtcccccgtggccctggccctatctgtaaaatgctccctgcttctgctgtccccccaccccgctcccgtcccccatggccctggccctctgtaagatgctccctgctgctgctgtccccatctgggctccttggaggtctagactctctagatggccctgggagccaaccccagggtccccctccccacgtgtgggcaggccctcaccgctgtccttttgtgtgcccatgacatgctggggagtgtagagcagcaaggccccaggcagacaccacacctgtccctgtggggggtcttg

SEQ ID NO: 81825 - DNA, 1680 bp, Homo sapiens
ccctgctcactgcattccatctgtgctggtcttggctgaccctgaacacccaggcctcttggtgttcctgcctcccctggtcggccacttctactccttcatgtcccagctgctcagaagggccgtccactctcacaggctctcctgggtttcccccactcaggccttgtcctcagtctctgagcacaaggctgtctgccctgcaccgagtgcaggggtcgggcaggagctgtgtcatcccctgctctgcgccacccgctgtgccaggtcccgacacacagcagttgctccccatacgccgctctgcggtcggccggtgcatccggccccctgccctgtacaatgctgatgctgcagacctgtctcttgcagggcgcctctgtgggaaggagaggggtccagggctggagtccgggtgcccctgcacttcagggacttcttggcagccgtgtgggcgacgctggcaggctctgctgatcctgtggcttttgtctttagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctgggtgggtgccaccttgggttggaggtttctctggccttgacgatcaagtgtaacctggatgggaaggacctggggctggggaggggctgccgttctcagggatggcctgcagcgggtatgcccaccctgcttcatgcacctgggctcacctgcgtggccggagtgcccctgaggcacgtgttaaaaatgcagagtcctggccttcaccccagacctgctgactgtgagtctctggggcttggggcctccgaacacctctgcaacggcaggagctgggcgagttctgtcactgggaggtggtgctgctgacttggtctcaaccggagcgtactggtcccgtcttcctcctcctttctccactttgtggaccttcctcctgccatcctgtggtgggaggtttccattagtcttgggtctctgtgtcatgattctgggaagtagagaaagaggaggaagagatcggtctgactctggctttgctgttctgtcgcccagaaaagggcctcagtggctgggctgcctgcaggacaggtgccggccaggtgcctaccgtcaggtttcctgtctgaggtgacgtggccggcagccaagtgtgcacacgtctcctccgagccactctctgctgggggtggggaacgcccaggagtctggtgatgtcggcgtctcccagcctcgggttgggccctgagtgtacggcatacacacttctgctgccgcctcggcacagaccctctgtgcagccccaggggcggtagatcctagtgtccgtgcgtagccggcctgccctgggctcccctgagcctcttcgggcccagtgcgtggtctgtctgttgctgccgggggactgatgatggggtttctggcagtgacgggtttggacacactgtcctgcggcgggagggggaggtgagtgggagatgtagattcggcgtcctcgcaaactgccgccgcttctcccccagctgactttgtcctgcagtggatggatgttggcttgtcctcggaattccttctggtgctggtgaacttggtcaaatt

SEQ ID NO: 81826 - DNA, 1050 bp, Homo sapiens
gggtggggcgatcacgtcgtcctggttttatagtgatgagctgcggtgtgggtcacagggctctcctgatcctctgctcttcctgctacccccctccccgtaggggcggtggggggatgttgtctttgtgcacagcttgcagccgaactcagggcagctttcagttgctgctgggctggcccaccgggtgcccaggattcagttgctggtctgtccgagtcagggactttgcaggcaggcatgggggtggggcccgtctgggtcctgactgtgctggagcatgtagaaacccctcctgggcgccccacctgctgtttctgcggcccctgataaacgtgtggtgggcactgcgcgctcaggcgtgctactctcggtcccaagggtgactgggagggcgtcccacagcaagcaagcagctctgaccctgtgtgctggccgggctcgtgttccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccaggtggggtgggggcaggagctccggggagcaccgggaacccagacaggcaggctcggcccactcagaagatggtaccttgggccccatctctgggggtcccgcagagactgccagaaccgtgttctctggtgattcgcagtggcgctcatccaccttccaccggagacaggtctgatttttccagacgtggtgcatcgtttaggccccagacaggaatatgcagtaggtgagccggggctgggccagtgctgtccacagtccgcagagtgacctgcaggccgccttcgtggcctgagtgggccccggcacagttcccagagggatgccagtgtggcttccgcatgactttggaggaccgcattagtcgagtctgttaaccacagctttaaggaggactccacggccacacgggctcatcagcataggggccctggggaggcgaggctagtatcca

SEQ ID NO: 81827 - DNA, 1022 bp, Homo sapiens
ctccctgggaagcagagctctgtgccctgtgtgcctggccgcgggaggacccagagtcgggctggcctgcgccaggcagacgggctggtgtggggctgtggccgggcactccccacccgccccagcaggctgccgtcccgcaggagcgagtcccgaggcgccgtgcgcatcaaggtgctggacgtgctgtcctttgtgctgctcatcaacaggcagttctatgaggtgcgtgtccaggcggccgcagctgggggctcagggctatttctccgtgggcgggctgtctctgttgtgcacgtgctcccgcagagccgggctctgcctgggacttcggtcctgccggaccctctgcagcccccagcgtggtctgtttacccctgttcattcactggcttgctcgtcctgggtgcctctgccaggccttgacacgtggccaagtagcaaggaaggcacagtgcctgccctcagggagctccggccggttttcacccaacacaggagcctcttaaaaattctgtgtgagttcgtttcagccagtcttgcatggggacattgtcttccgtttcagtcctgacgttcaccctgtgcacctgcgtgatcgccagccctgcctggtctctcctctgcgggctctccctctccactccctcctctgggagctctgtggccccaggcccaccttccttgagagacatttgtgtgcctgccagtcatacccctttcccaggaggcgcagcttaggctctgaggctgtcccttcccaccgaactcctccctgcagcctcgcagtcctgccctcctgagagctgcccactctgctcctctccccagcgtccactgtccttgaattgccctttgctgggcattgcgatcccgcattctgtctgagggagctaagggcctcctggaagttcctctgggtcctctggcttctcccatcagggctggtcttgtcctggtctctgttcctgtggaactttttacctgcttctgtgaaaactcacgctgtcctcagcacagca

SEQ ID NO: 81828 - DNA, 1014 bp, Homo sapiens
cttctccagaactgacttgcacctggccgtggttccagtgctgacagcattaatctcttaccataactacctggacaaaaccaaacaggtaggaggtcagagcaggacaggcgagcttgatggggcctgggattcgagggcctggcccaggtaggccccacatttttctcataaacgagtttctgccaggccagggatgagtgagttggctctgcttccctgggtggctgccagatgcccagagtggggacatccgattccctggtgcttctagctctctttggggcctgggagccatccagtgttccctgtccaccccggacagcatctctgctctctgtagagcgttgcctggcttgttcctgctgtcccaagggggaggtggccatgccggttggtggagctgggctggttctgaggcgcagggtgggcaggccagagagtctggcttctgcctccctccacgccccatcaggtgccggaaactgtcccttcacctgcgatctgcctcgcccccgtcccagtcgcattcttccacacctctctttgacatggccctccgggacgaggagctggtgtcctagagattctggcctccgctcagggccatgcccgccaggagatgctgactctgaggcttggcccatctgtgccccgggcctcagcttctgatggtggccctgtagggagctgttgttgggttcccatccctcaggctcagccccaccctgttgggccccttcagcccctctgagaggctcactgggtcctcatgggtcttgcctcaaagcatagccagccttgctgggctgcaggttctgaggccttactggcccacagtgtatccgaggggtgaggccggctttgggaaatggaagctgttcccgggacactgcctggcaggccatctggccccgggctctgcctgagctccgctcatcttctgctgtcctcatggaagacactgcccagggttggtgtgggatctggtggcttggccacttcaggcagcac

SEQ ID NO: 81829 - DNA, 1557 bp, Homo sapiens
cttgccccaggccgagcgggctggggtggggtcctcgcctgtgccctagggctggctggaacccctgggagggcggtggagtgggagatggccaggctctgtgttcctccctgtgggctgtggctgccctggccaggccctcacctgggtgcccaccatcccctccctgtgcagtttcgtgttcctgcagctctaccattcccccttctttggcgacgagtcaaacaagccaatcctgctgcccaatgaggtaggcgtggcctccctctcctgcatccgctggagctgtgtggctcgggtgaatggtggggggcccagctctgctgctgggagctcaggcttgcagagggctctggcctaagctccctgtggcagcctgccgtgaccggcctgggtggggcggcctcctgtggacgggcgtctggggctcaggcagggctctgtgtgccacagtcacagtcctttgagcggtcggtgcagctcctcgaccagatcccatcatacgacacccacaagatcgccgtcctgtatgttggagaaggccaggtgaggctgcggggccggcctaggtgcctggacagggccagctgggcctcagcctgcagtgggtagggagtctgggcccccaacgccccacagagctcaacactgccgggtcccctacagcatgaagtgctcattgagctctgtgccaggtgctgctctgagtgctggggaccccggtgcgagtgacaggttagcgtgggagcacccggcacaccaaggagtgggaaggactgggcgggtggcaccggtcgcagggctggggagggcgctgttggtcagtgagctgacagctgagtggtgagggagcgggcagggggagcctgcataaggggtgggggcatcccacacaccagcagcgggggccgggcgcaccctgcccagcttgagcactggtgctgggcgagcacgggagccgacaggatgggcagcctcagcgccctataggctgcaccttcatcccaagggaaagggcagggcctgggctgcttctgagcagagggcacatggcctgactccgcccagtctcagtgagtccctcctgctgtgtggctcgaggaggtgggtggtgatggttcccgtgggagtggggtaggcccctgggggcaggctgctgaggggccagggccccgggtgtgctttgagtgtggagctccctgattttgccggccaggcacacacggggctgagggaagagagggagtcaaggatgacacccgatgtctggcctgggtggctgctggaatggatggtcttgtctgcctcagggatcagagtggggctcccggcagagcctgctgggcacccccaccctctgcggggcagggcccggcccgggagtgatgccaccctgcctctcccctctccccacagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggt

SEQ ID NO: 81830 - DNA, 1050 bp, Homo sapiens
gcctatctgccctgcctgggccatgccagctctccccgccatgctggggctcacccggaccgtgctgtgacactggccgacccagcccacctccaggaagagggtgacgctggttgctgcctagtggtgcgtggcgataaccaactgagcagcctgacagctgccactggggagatggtgggggcccaagggccgcgccggacagacaggaagcaccaactacactgtgcccacccagcacacccagtctgcacttgccagttactcctgacagacactcagcagcaggcgccacaggcttcagggcacagaggacacaacgcaggctcggggtgaagctcgtgcccacggggccctgagcactgcggcctctcctcctgctcctcgtgaccgaagctcagggaggaggacctgccaccaacccgggacacagcagtgggcacctgcctggggcccagcctcactgacggcccctcactcaccttgatggtgccaagcttgaagtcctcaccggagtcattgtagacaatggacacaaagtcgttgcccaggtggcgcttcttgtcgcagcggtgcttgtccacgtccttggtgggcatcagggtggcgatgtggaagacggctgagggtgagcagggccggatgggtttgtggggccagtgctgaggccctctgtgccttgcactggggcacctcctgattactccaggggctctgggggcctgcggggaccacgtcctctggtgcctggccagtggtcctcggctctccccaggggcagggctttgggacgcaaagccaccagccccatcactgcctccatgcccacgctgttaggctcggaacctgaggcgtggggagctggagcaggtgggggtgccagggccatgccccagggcgtggggtagcaggactggatgggagccgtgccctgaggcctggggcagcaggagcgggtaggcgccaggccgtaccttgcatgatgtcatcgtgccagcagtaggtgaactggccgtcctcaccacacacgtccaggcctcccaggtacac

SEQ ID NO: 81831 - DNA, 1862 bp, Homo sapiens
ctccctctacctccctgtctctgcactgacctcacgcatgtctgcaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggtgcgtgcagcgggtggggcacacgcggccccctggccttgttcttggggggaaggcgtttctcgtagggcttccatgggtgtctctggtgaaatttgctttctgtttcatgggctgctgggggcctggccagagaggagctgggggccacggagaagcaggtgccagctctggtgcagaggctcctatggcctttcaggcccgtggcagagggtgggctcaggagggccatcgtgggtgtcccccgggtggttgagcttcccggcaggcgtgtgacctgcgcgttctgccccaggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggtgagctctgcgggccagcctggcagggcagggcagggcatcatgggtcagcattgcctgggttactggccccatggggacggcaggcagcgaggggactggaccgggtatgggctctgagactgcgacatccaacctggcggagcctgggctcacgtccgctaccccttccctgcccaggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgtgagtgaccctgtgctcctgggagcctctgcagagtcgaggagggcctgggtgggctcggctctatcctgagaaggcacagcttgcacgtgacctcctgggcccggcggctgtgtcctcacaggagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagac

SEQ ID NO: 81832 - DNA, 1046 bp, Homo sapiens
ttgcagagggctcatcccgggccccagagataaatcccagtgaccctgaagcagcaccccgaccttccgctcccagcagccacacccaccgggccctctccggcgtctgctttccacaatgcagcccccgcccaggagggcccatgtgcttaccctgttttgcccatgaagaaacagctcagtgttgtgggtcagtgcccgcatcacacagcgtctagcacgtaactgcaccccgggagtcgtgggcatctgctggcctcctgccggcctcctgcgctgctgacagcttgctgtgccccctgcctgccccagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggtaggatggccccacctgctcaccctgccccgcatgcctgccagggcactgggttcagccccccagggcagacgggcagcttggccgaggagctgagcctccagcctgggctccttcctgccatggcgttcctcggtctctgacctgcttcagtagcctcagccgttctgtcctgtgtgaacgcagggtgcctctcgggggacccagggtgtaaagaggggcccagatgtggggagggactaagaagatgctgctctgtgccctccactctcccctcccctcccctcccccttccctcccctagcccctcccctcctcccctcccctagcccttcccctcctcccctcccctagccctttcccttcttcccccccagcccttcccctcctcccctcccctttttctccactcccctctcctctctcccctcctcctccgctctcatgtgaagaggtgccttgtgtggtcggtgggctgcatcacgtggtccccaggtggaggccctgggtcatgcagagccacagaaaatgcttagtgaggaggctgtgggggtccagtcaagtgggctctccagctgcag

SEQ ID NO: 81833 - DNA, 2473 bp, Homo sapiens
ccacctgggctcactgacgcctgtccctgcagctgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtgagtgactcgggggccggtttggggtgggcaccaggctcttgtcccagccccagcctcagccgagggacccccacatcacggggttgcttttctgagcctcggtttccctgtctgttgggaggtaactgggtgcacaggagccctgaggctgcacgggagccgggagaggcctcagcacagccgggtgggccctgaatggaggcccggggcgtgactgcagagtggagcctcggctgggtcccaagcaccccctgccccgccaccgcccacccctgtcccggttcactcactgcgtcccaccgccccggcaggtggacctttggggatggggagcaggccctccaccagttccagcctccgtacaacgagtccttcccggttccagacccctcggtggcccaggtgctggtggagcacaatgtcatgcacacctacgctgccccaggtgagggatgagggggtgagggggccactgcctttcaggctctgagcacggggtccccccagctccccagtcaagctgccccccttcctccccaacagccctcactgtgacctcacctgggctgatggcttaggcccctactggggtgagggaggggccaggcgtggggggagtggacagggaagctgggcccctgaactgcgccccccgccctccccgggcctggctcttgctgctctgctgccccgagtgcagctgcacttggaggcggtgccgtcctcgccaggcagccctcagtgctgctacacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccactcgggcctgtccccacaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtg

SEQ ID NO: 81834 - DNA, 1009 bp, Homo sapiens
acagcgccagccgggccaacctcagcctgcgggtgacggcggaggagcccatctgtggcctccgcgccacgcccagccccgaggcccgtgtactgcagggagtcctagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcgggctacctggtgggctttaaattcctggaaagtcacggctctgacagtggctccgctaactcattccactgtctcatttcacaaaatgaatttaaaactctgctccctgacctcacacgagcccccgtgagtctctcacgccctctgctgtgttctcgcctggctaaagcgagtggcttttgaggtggagtctgaacccctgatgggaaactgcgggctgcccgcggtgccaccatgctgggtacatgggggacagggctgtctccatcttgcgggtacctgcctcttcaccaggggccttgggaggggccatcagaaatggcgtgacctgtgcagcctgtcctgggttctgtaagccagtgtaggtgcctcccctcactgctccgagctctctgggtgaggagctggggcaagagcgccgggagggtctgagaagactcagagagaggtggactctttgtagctggtactaggtttgctttacagatggggaaactgaggcacagagaggttgaggcattagtagtactacatggctggctggagagccggacagtgagtgtcccagcccgggcttggctcccatggcatgcagagccccgggcacctcctctcctctgtgccccgcgtgggactctccagcccgacgggaggtgtgtccaggaggcgacaggctaagggcagagtcctccacagagcccaggctgacaccattccccccgcagaggtacagccccgtggtggagg

SEQ ID NO: 81835 - DNA, 1063 bp, Homo sapiens
gggcctggctccctggctggccagcctctgcttggcatccccttgctggacagtggctgtggtgagtgccggtgggtggggccagctctgtccttcccagccaggtgggacctgggccctgcagacactgggcagggctcaggaaggcctctctggggggggcctccgggccaagggaacagcatgggagcctgtgagtgcggcgggcggatgtgggggcgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctcca

SEQ ID NO: 81836 - DNA, 1041 bp, Homo sapiens
acacacctgggacttccttctccacccagtggtgccccagcagccgctaaggagcccgctgggtcccacgctaggatggtcctaactcctcccgccttccagatcggacgctcggcgctggggaccccttgtgtcccggggctggggcaccgtcctgccccccatgggggtgtactcctcccgacaagcttggcttcagcttccctgggagcacatcctggccctcgggcacccatcaggctgtccctgtgcacctggctcccacccttccagctcatagcaggaactggggtgaggagtgcgtggggcagcaagggcctgggaccccagaggaccctgcactctgctctgtgctcttgcctgggcttagggccgctcggtggtcctgctgccagatgcctgggccctgctgtgtcccccatccttgcagggaaccagaacgtgggggcagggcatcagacagcggcgatgatgtcacctggcgggtgcagaggaagcccgaggggcggggtgggggggctggcgcgaggctgcctggctaggccttggcgttcccccagaacggcgatggcaaaagcagatggagacgtgaaaaagtacgggagcaagcgaggtgaggactccacggggacccctgtgctgttccctgtccctgaagcccacacctgagtcctgcccagggcagatgcttccacacccagggggcacctgagtcctacccagggcagacgcttccacaccctgggggctgggggactgcacctggctcctgtctgggccccagcttcattccactgccctgggccctgggagctcggccgagcggggtccccaagaccttgctgcatttctgggccttgggctggggtgagggccgggagaaggagccagcctggagcctggcacgcagggagtgcatggccagaaccggtgacaggcagggctgcctgctggcgtggaagaagtgtccatggcacccccaggcctggttcacagtgggatgggcggggagccggggggctctggggtcctcggctgacc

SEQ ID NO: 81837 - DNA, 2606 bp, Homo sapiens
gccgcgggacgggcgggcgtgggcgcgttccctggcccgggacgggaagcaggacgcgggccaggacgctcccagggcgaggctccggcgcggcacggcggccctgctaaataaggaacgcctggagccgcggttggcacggccccggggagccgaaaaaccccgggtctggagacagacgtcccacccgggggctctgcagacgccagcgggggcggggcgcggaggccgcgctcagctgggaggacaaacagtcgctaattggagaggaattgggatgcggcctggggctgcggggtacccggagaggtggggatggctgtagggggcggcagggaagagttccaggaggtgtctggaaaaggatttgatggatgtgcaagaattgggctgatgcttaggaaggggcgatgaggtgggtccagaagaaggggggtgaacggtgtgagcaaagaccgtgaggctggaggctggccacgggaggtgtgaggggtaggggcagggtgggaggtgggctcgcgggtgggctggggtcatgaagggcctcaggcgctctgctattgggttccaaggctatcctgagaacaggggtgaggggggattgccgtggggggttaaagccttgtcatgttcgctttcgggagataaaaacaacaggtggcctttatggagacgctgcccagagccaggtctgtgccaggctcctgttgggggtcgtcatgcggaatcctgactctgaccatccgaggcatagggaccgtggagatttgcatttcacagatgaggaaacaggtttggagaggtgacacgacctgtcccaggcatcacagccgggatgtgcatagcaggggtttggaactatgaggtgcccaggacccagggttggattgaaaagggcggaggggactaagataagcagacagttgtccccagcgctggggagagtcttgggaccagtctgatgccttgtatttcccaggctccaggctcctcgccgggacagtgtctccttgggtgcgtgctggatccctgggggacgtggcacatccccaggcttgctaaacattgggtgggttctggcatttggttttgtaacgtttctgggtcactcccgcctgtggccacccttccttaggggagccgtgtgtccttggggctttgctgggtggtctcgagggtgggagaagaatgggttctcctggaccaatggagcccgtgcccctcggggccacattgctcctgcgctccctgactgcggacgcgtgtgtctcgcggctgtctctgtggagatggcctcctcctgcctggcaacagcacccacagaattgcatcagacctaccccacccgttgtttgtgatgctgtagctgagggctcctctgtctgccaggccggtcactggggactctgtccagggcctggtggttcctgcttcccagcacctgatggtgtccatgagagcagcccctcaggagctgtccgggagagaagggcgctggtggctgctgagcggagagcaaggcccgtgttctccaggcccttggcacagcagtggagcccccgcccctgccttgtgttgtcctcttaggctctggtcctggggtttggaggagggggaccctgggagttggtggcctgtcccagcctgagctggcaagattccgaatgccaggccccccaagtgtgcaacagggcacagggtgacctcatgtgggcaggtgggtgctgttctgtacacacctggggccgccgctgggagagttctggaaggtggggtgaggggacccatggcaaactagggccttaggaaggatgtgaaggccctggctggccccccaggccaccctctgtgctgtggggcagcccagccattttgctgtctaccctgcaaactcctcctcggggagacggctgggttttccccagggaagaggggtcaagctgggagaggtgaaggacacagatcacagctgctggcaggtgttcaagggtccaagagcgttgctgtctgggtgtcaccagtagccttcctggggggctcacgcaggtgcctctccacttgtggctccctggctgctgaagctcagcagggacagctgtgtccagttccaggtggaggacagccggggcttctgaggccacagcctgccttgggttaatgatgctgccgagaggtggtggcttttggaaaagatggcgtactgcaaaacgtgctgctctgcgtggctcgaagcttcgtggggagacgtgggcagagccgtggctgactcacagaccccccaccccagagcctgccctgccctccctgccccgacccttctccctcctgacccatgtgttttttttttttttttttttttttgagacagagttcactcttgttgccaaggctggagtgcaatggcacgatctcggctcatggcaacctccgcctcctgggttcaagcgctttttcctgcctcagcctcccgagtagctgggattacaggcgtgcaccaccatgcctggctaattttgtatttttagtagagacagggtttctccatattggtcaggctggtcttgaactcctgacctcagatgatccgcccgcctcggcctcccaaa

SEQ ID NO: 81838 - DNA, 1050 bp, Homo sapiens
agatccacgagtacgcccagcacgacgtggcgctcatgctgctggggaacaaggtgggaggcccggctgtcctcacctgggccacagggcagggcaggtgagggggcaggggccaaccatgggccagctttcaccaagaccctgtgcctgggccaggtggactctgcccatgagcgtgtggtgaagagggaggacggggagaagctggccaaggtgagtcagggcaggggggtggtgagggggtgcccctggaggctgcgagcctaggctgtccccgccaggccaccacctggctggcagcagctgtttacaggagtatggactgcccttcatggagaccagcgccaagacgggcctcaacgtggacttggccttcacagccatagcaaagtaagtcctgccagtcaccaggactcccccagcccagggcctgaatcctcattagagtccaggccatcgtgtccccttgtcacccccactccgcagggagttgaagcagcgctccatgaaggctcccagcgagccgcgcttccggctgcatgattacgttaagagggagggtcgaggggcctcctgctgccgcccttgaacctggctgagctcagtcctctggaggaagccgtccagtccctagaaggctggacagagggtctccaggcccttctgactttgttgcccagtggccaacgcccgagtgtctgttttcaggagccccaggtcaagccttgtcccttcctcctcccagcaacagtcccaacaagcaggcttctgagagcccgtggccgcacactggccgccacggaaaagcagtcttctgcacgggacggggagcggcaagtggacagactttgccacggtgctctgctgccccctcctgggcacgtccaggtgagggagggctggggctggcaccacgcacagtgcctaaccctagaaaagccatgtcttcagccgcacatgctcaggcagctaagggaggacgcctgcccacgcctgggacagaaggcttcactgctaatcacatcgtgcatctgtgtgtcctgggagctg

SEQ ID NO: 81839 - DNA, 2207 bp, Homo sapiens
ccgggaaagggactagacgcgcgagccggaagcgccaggccgctgcgcccgccgggacgtgtagttccccgcctctccgggcccggacggctgcctcacgcgccgcacttccgaaactacgacttccggcggcctcgtcgtcgcggggcgggaatggcagcttcagaatcactctatgttgcagatcgaagtctgattggctttgttcatccgtcactcaccgttaggcttcacggactctgcataagggaggagcttcgggtctgggtctgagagaccgtctccaaaagaaatgccacggtacgattggtggaaacaacgcggcagggagcggagcgtaccagcggcgggggaaggcgggcacttccgccaggatagcccaatgacagaggtgggacagtttctataaaagcttgagcctcgcccgcccctgtcttttcggggtcgagtccgagggggaagaggtttgttaatacgttcgccatgtgctacgatcttgggacgaactgagccacgagcgtggctttgagggccgtccgaacgctgcaggccggccaggtccctgggcgtccaggcctggcctacgcaccactttgtcccttagcgtttaaaggtttcttcccgaatctcaggccctcagctacctgcaggtaagactgggccgggcttgggttcccttattctcccagtctgtgatgaattgctttgacttctgacacctcgtatgaaaactgcacgtgcagtctgattatttagcaagactgaggcttgagggtgcgcactcctgacggggagctgagagtggaaacaggtgttgcccgaaacgaaggagtggggacttaatgtctgtattttggcgctgactttcaggtttcgtcgcgagccggctgcaagttttgaacctaagtaaacctcaatccggagggcctagcggtaaggtgggcgctgtgtctattgaagtgcttagcaataaagaaaggtagtgagttgattcggttttctctcaagtgtctttattttcctattctggcaccccagaggtctggctgatccacaggcaatcttggaaaagggtacagacatgaaaacggaagctcgttaccagtgacttttcatctcttgggattgccttctccatttctgcccgtgattttttttttttttttttgagacggagttttgctcgtttcccaggcgggagtgcgatggcacaacctccacctcaagcgattttcctgcctgagcctcccaaatggctggaattacaggcgcccaccaccacgcccggctaattttgtatttttagtagagacggggtttctccgtgttaggctggtctcaaactcctgacctcaggtgatctgcccacctcagcctcccaaagtgctgggatcacaggtgtgagccaccacgcccagtcaaatactgtttttcatgccttttgccccagggtgagtccaaaaaggcttttgagatttgtggagggaagttgacaccacctagggttcccatgtgcctccttagggaggcagccatgggccatggaggaatggtagccacacacctgctgagggttctgggccttgctgagtctctcaaactccagcatcctgctctagaagtggatttttttcaacagatgagacagacgctccagaaaacacaactttattcactaggactgaaaacaaaggcttgtgcaatcaaaaggccaagttgagtgcaaggtggagcgtgctcggaaatcacagacctcacctgtggccaggccgggctggcagttgttgtttctggtgttttctgtgatttcccacattttatcacaaggccacaggcatcctccaaggtcagtgaggaagaccctattgctgtttgagccagagcctcctagagggtgggccgggagcaggcagctcccaggacacacagatgcacgatgtgattagcagtgaagccttctgtcccaggcgtgggcaggcgtcctcccttagctgcctgagcatgtgcggctgaagacatggcttttctagggttaggcactgtgcgtggtgccagccccagccctccctcacctggacgtgcccaggagggggcagcagagcaccgtggcaaagtctgtccacttgccgctccccgtcccgtgcagaagactgcttttccgtggcggccagtgtgcggccacgggctctcagaagcctgcttgttgg

SEQ ID NO: 81840 - DNA, 1794 bp, Homo sapiens
gcaggtgaaaggggaaagcgggcactggaggctggggctggtcacgtgtagacccggacaccctcacccggctggaggaagccggctgcctggaaactcggggtggaggtgacccaaccccagaagcacccaggtgggaagtagggggcagcgacgcagagggccaggactgagggccgtgggacggtgtgggaaaggaggtggcagtgcggtggcacgctggcatgagggcgctgggtgactgagggggtcagtggtctctgccctcacattcctgttgcctcttcgggcccatgtatggccagtgtttatgtcagctccctgctgctgcagggcagaaggaaggagggagcccgggagaccgagccacacaggaagcaaatgagaacacagcgtgggactgggaagcgtgggctcggcgggggggggggggacactgccacccttggctcttgggcaaagctcacgacctgtttctgagagtctgaggcccacttgacttgggtgagagccaggaacgcactccccagcccagagctgtgaagctggggtctcttcctgtgccccaggatactctccccactctggatcccagcagcctcatcctccaggaagccctctggacttcccctcgactgggccaggtccccacacaatagacagccatgagatacaggggaaaaaaggactgagagatgttgccagcccccaaggggtcggaggggcagcaaaaggcatccttactgtgaagttggggtaaagccttggccgagctgtggggaccccctccctggagcagagggagatacggacgctggagaggcttggccagggcaagacaggcctggaggctgagtggatgcagtaggagcagagctgggggaggagttcagaggcctctgcagagctggggctgtgggtgttgggggcagggacaggcaagggggttcgccgtgctaggagggaagcggggccaagccggcctcagaccagggcctgctggggttctgaggggatcctaaggaccaaggctggcagaggccggggcaccccaggagccttcgacgtcacaccctgcctatttgggatggaaaaaacgttctaagggacgtcagggaacagcggcggaagtgcgtgtggctttgctatggcaaccaggcctgtttctatagaatttagcggcctgggcttgggccagggggctgaggcaggggctgggctggggcgggcagtctgtgggtgccctgggcaggctctgtgatgccaggggccacgctcggagctctggccgcagtccagccagccggccacacacagccctgtggcaggcggggcggaggcttctggagccgtcccaggctcctcccagggcagttgcaggcctcacaggcacacccacccatggcttgcgccccacacatgttcaggggacccccacaccccacctgctccgggttgctggaggagctgctttaaggccgggcctggcccgagcagggagctgcatctggaagcccccatctcccccactcagcagggccccccaggctgctgccaagtgggcggggacccctgacccagaccccctccaggtgtgtctccagggaaaggggtgggtgtccgcatcccacatgcccccagggcgatgccccagcagagccctctaagcccagcttgtgggagctagggaggggctcctgagggatttgccgaagaggggctggggtggaggcagcgaggcgctgaggaagacttccacttccttattgcacagtgggtgcccccagggccccg

SEQ ID NO: 81841 - DNA, 1049 bp, Homo sapiens
caacctcagcttccccctctgtgagtggaggctgtcagggaactcacctggcagaggtgcctcaagaggcaaataaaatggcacccccagctgctgccaggcggccttcagagtgatggctgcgtgctggccatgagcctcagctggctcaattggggtgctggggagcttgtagaggccctgaaagaagaccctgcctggggtaggcagggctggggcaggggctaccgggctcagcgctgggactgtccagatgtagaccgagcccagcgtccatgctcctggcactggtttgaccttgagagggaacccaagcttcccccgtgccatccctgcatgctttcctgcctgcctggccctggggagggctgtgagctacaggggacccacagggtcgggtatccagcatgggccccacctcccccacatctgctgagggagcccccactgagacgccagccctcttgccttgcagctgacgggaccagcacctacaagcagcactgcaggacaccctcctcctccagcacccttgcctactccccgcgggacgaggaggacagcatggtaggtccctacccccaggagcccgtgtgagcctcagcctccccccatcctccctcctgggggaaccaggtcccaggaggagttgacagtgagctggtgaggcacaggagaagaagagcacctgtggataccctgaggcctcggcagacatggcaagtctgtgagaaaggaggctcctgtggctggactgtgggtggcagggggcagccagtgagggcagctgggtcagagggcctggcacctgcaggccaggatgaggcatatttggctccatcttaagggaggtggaaaccacagaaagttcagtcaggaggatagcacaataaaatacatgctttgaaagcttcctttgctgctgggtagggaatgagcggggttgctgggtccaggcagggtttgaggaggggtcctgatgaggcggggggaaaggtgtgtggacctaagctgtggggacaccagaggcaatggggtgggggttgcgg

SEQ ID NO: 81842 - DNA, 4118 bp, Homo sapiens
tggggctccctctgctgctgtggggccttgtgactcactttctctgactcccttctgttccccatgtgctgcttccatgcagacgggcccttgggacccaaagggaggtgggtacatggcacacaatgccccccgccggccttgggactggtttgcctctgtgctctgtgggtttcatacccaggctgccgggaagggggccagaggctcggcagagcagcagctgggcccctctgcagtcaaagcaccaggagagaagccttgggcagtgtggctcttggaaacttctggaggtttccaggccagaggggaggaagggacagtgtctgcccctcccccaggctcccttgtcggtggctcagccagaggcaggcacctgtggccctcactcctgccctcgggaagctcagccgaggttctctgggggcctggccctgccttccctctgagcctcccagctgggcctggtgtcccccaccagcaaggccagacaagcagccaggcccggggggcacctggagcccagccgtcgctccctgccagcattcctggcccttccatcctgcggtcacggcctcggctgtccaggattggctggtggaggtgccccctcacggcccacattcccccacgggaagcaggaagcagcccgggtatatggaattgaatagcaggaagtctctccatttacacaaagagaggtggcaggcgtgagcgggcagcccagcaccccggcccaggccgcccaggcgggcaggcagggacctgggttgcatcagctccccacgcccacccacggcccccgtggacgaggagagtacccgcagggaccggggtggccccaggggtgctgctgccctcgcgcttccgccgggctgggtcctgtcctccccgaggctctgaccccgtgcggagccccccgacaggcgcctctccctccacacagccccccatcagcactccccgccgctccgactccgccatctctgtccgctccctgcactcagagtccagcatgtctctgcgctccacattctcactgcccgaggaggaggaggagccggtaggtgtgggggactcggcgcagagcggcttccagggctgtcaccgcagccgtggcacggaggcaccttcccctccgccatgcccgcccagctcacagggagagggcggctggggcctgacgggaactgcagtgcttgctggtccgtggtggggactcgagggaccaggccgggtcccctgggcatgttcccccactcccccttctcagggctgcccgggaactggcagcgggaagcacagggctccagcagggccctttctagtctcaccccaggaaggaggcgggcgagggcggccaaggctgggcggctgaactcatcctccggggttgggccctgcctctggggccacagacctcgctctccctcctgggccccgatcaagccccccagctctaagcaggcctctctcaggacgtgaccctgtcctcagaggacagccaggcctggagcaagagcgcctgggtgcctgggtggtggcggggctgagggtggcctcccgccatcgcctgcctttcccgcttggttccaggagccactggtgtttgcggagcagccctcggtgaagctgtgctgtcagctctgctgcagcgtcttcaaagaccccgtgatcaccacgtgtggggtgagcccgccgcccttcccagcccccctgctgccagaggcccccacaggaccccagggctctcgggggccggggctgtggcgccctggccttggtcaaggcctgtcctggctgcactgggcttggggtacagcgaggcctgtggctgccatggccatggactagggaaaaagaggaccctgcgccaccctcaagcccgccctttgcctccacagcacacgttctgtaggagatgcgccttgaagtcaggtaggtttgtgccccggcccaggcctgacgccgaccgtgcccatggctgccgagcagaggcgggcggcttctcccttgtcccctgcacagcgtccggccctgtttggcctctgctggggttgggatggggctgcagccgtcctagggacgctcaggctgaggctcgggacctccatgagcagagtggggacaccccaaattccagtgtgtccagactcagagaccccacagtgggtgtgggccgaggctccccatgccagggttggcaccctctggggaggcctttctcactggcgaggctgtcgtcctcccgcacggcgcccgctcctgcctgcctctccgcactctgccctctgccctcttggccccaccccacacttttccgggcacagctgagtgtcacaggtgacactccctcagcacctgctgctccttcttggtggcccacctgtgcccccgttcccatgttgcgtgcctcagaggcgcagatggacagatctggcccccattagaggctcatgcccacccgggtgagggagcgtgtgccaggcaggccgtgagggtcagcacgccctcctctcccagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaagtaagtgcccctccctgggcacctctgcctccctgggggctgcttctcagggctctggctgaggcctccccgcatcccgccctggcacagggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgagtggggggcgggcgggggtgggccggggtgggcgcaggccctccacaggctccgctgagagctgcccgcttgctggtcccggggaggtaggccggagctggggccacaccggggtctgtaatcctctctgaggcccaaggccctggaaacccagagggggagccgagggcgtccaggaaggcgggcgtggacgctcccgcagccggcccagcatgggcggatttgagcaaatgctggggttgagagctttggagagggaggtgggggtgggaggagaggcaggagcccagttcttcagggcagggaggtgggcagggaggctgccaagcagcgtgggttttatcctcaggaagggaggaccccttgaagagctctgcgggggtgacgtgatgggatctcacttgtgaagcagactgggggtagctggatggggaggaggggcaggacggcaggtgtgggtgggggcagctggacctggggtgcagcggccacagggctggagcatttgagggggattcttggggatggggaggcaccggcagggacccgccaggcaggcagctgtcctgtccccgcaggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttggtgagggtgggcaccggggcaggcaggggcctggccactgctccgggcaccagtgacaccccctctcctcctgctactcagacgtcctggacgaaaaccagagcaagctcagcgaggacctcatggagttccggcgggacgcatccatgttaaatgtgagcgggcggggctggaggggctgggttgtgagacccggggaggccggcggccccggcagggaggcctcccctggccttgcctacactagtcaagatcaggggtcttgtgtgtggcaggggctgctgtcacccctgcccacccctggcccagggcagcaggggcagagaggctgcactggccccacagcagccctgcccacctgccctctgccctgcccttggccctgc

SEQ ID NO: 81843 - DNA, 1026 bp, Homo sapiens
gagcatctctcacgcacacgcttacttgctcgctcccacaaagcctcacgataggagacaggaggcaggcgggccacctggaggcaagaaagtggccaaggtagttgctccgtagtctctatgccctgggctttggctgcaggcaggggagagctgagctcctgccttcaccccctaaggtcccccctatcttctggttgcgcaaggtgcacctgggccaggacaaggttctgctgggaggctggctgcgccaggtattgggaacacacaactttggagatggtgtaggccacacaagggcccacacactgctacccaggaaacagtgctgctccgggtggagggtgccctataggtggggcacacacatagctacacaggctcgagctcatggctcacggcccacggggtggcagcgccacgtctcctgtcctgggaatcactgatcacacatgtgcctggactcacccctggatgcagagagccagcacgatgccatcatggccctccagtgtcttctgacacttgtaggtggtacatgtgtcccacacctgcagagaccagggccacagtgggtcccagcaaggtcagcccagtgtcaaggggcagcatgacaggaatgagtgagggagccccgcccatgggagagggccctgcccagaaggtcccacccataggcaggctggcagtgccaggcatgtggcagtgcccagcccagccaggctgcagagactgaggtaggaccctgcccaccttgatggtcttgtcagaggagccactgaagagcaggtcacccatggagtagacgcagagacaccacacagggccctggtggcccacaaaggtccctttgcacttgaagatctgctgagggtcgtaggctgcagagatgggagcagtgggtgaaggcccagttggggcccgggggggagggtgggcgggagccacggcgggtccatactcacagcctaggatgcccatgttcagccgcgcgttgatgtgggacagctcgtcctgcagggccaa

SEQ ID NO: 81844 - DNA, 1072 bp, Homo sapiens
ggctcccgcccaccctcccccccgggccccaactgggccttcacccactgctcccatctctgcagcctacgaccctcagcagatcttcaagtgcaaagggacctttgtgggccaccagggccctgtgtggtgtctctgcgtctactccatgggtgacctgctcttcagtggctcctctgacaagaccatcaaggtgggcagggtcctacctcagtctctgcagcctggctgggctgggcactgccacatgcctggcactgccagcctgcctatgggtgggaccttctgggcagggccctctcccatgggcggggctccctcactcattcctgtcatgctgccccttgacactgggctgaccttgctgggacccactgtggccctggtctctgcaggtgtgggacacatgtaccacctacaagtgtcagaagacactggagggccatgatggcatcgtgctggctctctgcatccaggggtgagtccaggcacatgtgtgatcagtgattcccaggacaggagacgtggcgctgccaccccgtgggccgtgagccatgagctcgagcctgtgtagctatgtgtgtgccccacctatagggcaccctccacccggagcagcactgtttcctgggtagcagtgtgtgggcccttgtgtggcctacaccatctccaaagttgtgtgttcccaatacctggcgcagccagcctcccagcagaaccttgtcctggcccaggtgcaccttgcgcaaccagaagataggggggaccttagggggtgaaggcaggagctcagctctcccctgcctgcagccaaagcccagggcatagagactacggagcaactaccttggccactttcttgcctccaggtggcccgcctgcctcctgtctcctatcgtgaggctttgtgggagcgagcaagtaagcgtgtgcgtgagagatgctcgctttcaggaggcggcagcttgactgccagcagccggccctgggactgactcagggctgacgggtgggtaattacctcccagctcgctgtcaaatgctttccaggcaggcatcaggggctggcccg

SEQ ID NO: 81845 - DNA, 1043 bp, Homo sapiens
tgaagcacctggcctgggaccaactggcccacgattactcatagatctgggacatccgaacccttgactgcatccacgtcctgcagacgtctggtggcagcgtctactccattgctgtgacaaatcaccacattgtctgtggcacctacgagaacctcatccacgtaaggcctgggcatctgggtgcaaggccagactgtggccccgtctcccccgccttgctcagtgtctttgacctgcctgtgcccacccctcccaggtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtgcgtgctggcccagcggtggcaggaggctcagagggctggcagctgagctccggcgggccctcacgtcccatgtgcccccaggtctggagtatggacaacatgatctgcacgcagaccctgctgcgtcaccagggcagtgtcaccgcgctggctgtgtcccggggccgactcttctcaggggctgtggatagcactgtgaaggtcagtgcccgtggctcaggccattcaaaggggctgcacaggatggagcgggggtggggacgaggagctggcagccccagcacaaagtggtggagggcaggtacgtgtggcaggtgtggctggggcagggcagccggccgcaggacatcctggtgaagcagccctttctctgcaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatcc

SEQ ID NO: 81846 - DNA, 1048 bp, Homo sapiens
aaacaaaaaggtataactttaacaaatatatatttaaagaaagaaatattattgattctatagaaaaccatttaccaactgaaaggacacgaagtctagctccggacaaaagctgttagaggcccaggctgtctgcctgcggtccttcctccggccagagtggaggccccaggctgctagcacaggtggaaggctggggcccgggggcgggtgctctgccgggggctcctccgtgcttctctcctaagttctctgcgccccaagaactcgaggttgtgccttgctctcggcggccgtgtcctcctcctggcgtggctgcgtcccagggcgcgggtgggtttggtgaatgtgggtgtgtcagcgtggcagccacgtggaagcagggcatgtagcaggccaggccacgggcttgcagctcctctgagggtgtgcctggccccctctccaggggctgtgcaggcagcccatccaccccagtggagttcccacggacgcttctgctcatggtccaaggctgtgttgtgtggtcattctcgccctcccttttcctctctcctcctgccccctccaagaagtactgactggtctcctctatcgtgtttgctgatccacagtgttgggcacaactttgacgtttcttaaaaaaaaaatttaaaaaatgccgaaaaccagcgattgtggtgtggggcgggtggaggcggctggcggaggtggcgtcccggcgtgcagggccccttcctgctgtctcaccccgtgtttccctgcgagtggacgtgcccagctgtccccccaggcctctcctcagagggcggcacaggctgggctccagcaggtgggcaggggaggtctgggcaaggcgctgccgtcggctgtcaataaacagcaggaaacagaggtgcctggctcactttttgggggcacatgtgttgggggagatgggactggaggccagcagcttgggtgtgacgagttgcctcctagcagggaggggaggccccggagtgggccgaagtcctggggtccaccaaaggaaactgccccatgcccc

SEQ ID NO: 81847 - DNA, 1040 bp, Homo sapiens
ttgtggctgtgtggcatgtgtgtggccctgtgatgtgggtgagaggtcagagtgtgaaacgggatggggtgctggtgcctgtgcacggctgggagcgcagcgtgcaaatcatgtgcgtgttcctgtaccaggtgtggccccatgcgtctgtgtccatgactcgggtgtgtctccccatggtgctgtactcgtggctgcctggccgggtgggaaagtgccttcttctgcccccccgacaagggtgtcctgtggatgtgggcagccgtgcgtgtgtgcgcatgtgtgcgatatgcggcatgcagtgtccggtgcctgagccgaggctctgcctacatttctggtgccaatacctcggcctatccgtttgtcctcctgtctgtctgtgccctgctggcccggtgacccttcctcctccagctccaggtagatgggcagggtgcgggcagccagcccaggtggctcctctgtgtgtctgctctgtaggctaacctggccgtgtggctgtccatgatcggcctggcccagtactacaaggtgttggtggacaatggctacgagaacattgatttcatcaccgacatcacctgggaggacctgcaggagatcggcatcaccaagctgggtgaggccccagccccagccctcgtccccagcccaaccctcagcccaagccccagccaccagccaccagcccagccccagccccgccccagccccaagctgggccccaagcccagcccagccccgcccctagcccggcccctgcccctccgcctcctggtccacctgacctgccccctgcgccccactcagggcaccagaagaagctgatgctcgctgtgaggaagctggcagagctgcagaaggctgaatacgccaagtatgaggggggccccctgcgccggaaggcgccccagtctcttgaagtgatggccatcgagtcgccgcccccgcctgagcccacaccggccgactgccagtcccctaaaatgaccaccttccaggacagcgagctcagtgacgagctgcaggctgccatg

SEQ ID NO: 81848 - DNA, 1053 bp, Homo sapiens
ggcagcgggggtcacgccctacacgcgggctctgaaggcgtcaaggtaggtggggtagtggccagggccagggtggccagggctgggagcaggtgacaagccggggtttctgggttgcagctcctggcaacggtgctttcccagaagtccgtctctgagtccggcccgggggacagccccgccaagcctccggaaggctctgcaggtaagagcaagggtgctgccacgcagcccgatggaggaaagcagcccgacagcccttgtcccccacccactctcgtcctcaggtgtggcccggtcccagcctccagtggcccacgccgggcaggtctatggggagcagccgcccaagaagctggagccagcatcggagggcaaggtacagggcttgggggtgttctcagcgtgggctccggggagaggctgtaaggccgatgggctgatgggtgcttacacggcctgcctggcctggcagcggcggggtcgggggcattgccaggccagaccctctcctctgtctgtcagtctgtgtgttgtgtgtgtgtctgcctgtgtgtacgggtgtcgtcattgtgcaggctgtgcgtgtgggccaacctgtgcctctgtgtgtgcgtgtgtgtgtgtgatggtgggactgcgagctgggcacgcgtgtctgtgtacaggtggaaggggatgggtatgagatggtgcagcgtgtgcatgggcacggcgtatggtgtgtgagtgcactcgtgtgccggagagctgtaagctgctggctgagtcctgcacggtggaggaggcaaggtgcccctgcctgtgggcacagagcccaccttccggtccagcccgaggcccctttcccagagccccctcccaaggggccataccacctgcatccccaagatggcgtggggcgtccctggtgcaggagcaggggacagtcagggaggcgtgtggcggacagtagcagcccccccgcccccctccccccaccggtggagatcccagaagaaggcggaagggtggaggatgctccaggaggcgcctccgggaccgcggactgag

SEQ ID NO: 81849 - DNA, 1016 bp, Homo sapiens
agcctggcccgtccccaatccagtgggctggccaggccacctgcaccagggaggacagctgctggcagggactaataaacccttccacctggccatggtggtggtgttctctatggaccgaggccctgaaacgcgggcagggaggggcagagaacacactagcttgggggtgggcaccagcctcagacccctcagcagctttgggccctcggccgactttcccaggcagtgcaggctagcccagtccaggagtgtgcagcctggcttgggtcgagctctgtcacatctggataagcaactgggggctgagagtcccagggcagcctggcccagcaggtcaaggcgccacagggggccatcaggtccagctggcgcaggccggcaggggagggtctgctctgacctgggtgctgcatgggtccctccagctgccaccacctgcaccaggcagtcccgaggggtcacaggctagcccagcacactgtcattgaaggccaggcagacaacagccttctggtggccgccatactctctcttgatctctccagtctccacacaccagagccgggccaggttgtccgaggaagctggagggggagattgtgcagggctaagagcgcaggtgcaggccaagcaggcggccccagcagaggggaagctgcagccgaggtgggctggctctggaggccagcgccgggggccagggatgggggaggccagggcggggctcaccagtgacgatgtactgggagtcccccgagaaggcgcagccccacatccagccgcgggaggactccccggggttgccgctcttgatgctcagctccgtcatcagggagaagttggacgtcctccagatcttgcacgtctgatcagccgagcaggtggcgaggagcctagtgggtgggcatggggcgtgtccagcagcagccactccatccagcagcccctcccctctccagcccccagcccaggcaggtcccctcccgggccagcaggccctgcacgcacgtgga

SEQ ID NO: 81850 - DNA, 1329 bp, Homo sapiens
actggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcagatgttgctcgggaagcagatgtcgatgcagagataaatcagccgctgtctccggggccctgtggcgagggtgccgtgaatctccaagggctccgcccccagctcctcaaaccatcccgagggcctggccttcccccacagcggtcctgactcaccctctgctcgccgggcccagtagatgggggtcctcatgcacaggcgctgcaccaaagcccccgcctgggcggggtccacttcgaggctcccctgcactgccagcagctcctgggtgtggtgggtgtcctggctggggacccaagcctcttggacctgttgagaaggctctggtgggcggtgggacagggctgctccctgctcctggcttggcagggccgggtaccctccaacccccagtgatgtccccaccctcagctcttgtcagcagcctgggcttagggcggagagagcttcctgttccctgaaaccacagctccagcctgtcccgtactgggctgcacacaggaccctttgtctagcccctggcccgggcctgcgcccagcaggacggctcaccttggaggtatccaccagcagccgcagggtctcccgatcactgtcctccatcaggcggaggaagcagacctggtgctcctcagggcggtaacagatgcagccctggggaggcaggggggtgaggcggggccccccagaccgacacctgccagggtgacccctccctgcccactcac

SEQ ID NO: 81851 - DNA, 1050 bp, Homo sapiens
cgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtccgtgcgccctggggcgggaggctggggggcgggcggcgggccccctccctgccctttgacccggtcccctgtgccccgcaggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcttggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattca

SEQ ID NO: 81852 - DNA, 1050 bp, Homo sapiens
tgaaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagaggtgggggcgacggggggccccggagggctgctctgtcttctgcctgctcggtgccagtctttgttctgggcactggctccaggggtctgagccaggcaggcgagggctgggcttcccacagggagagcagggccagtgggagcgccatgggggtctgagggtttgcacaaggctcctggcgtgcgtctgccccatggggtgggtgctggatgccaggctgcctggccagcctcctctctctgcctcccctgcagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacagtaggtgccagcaccacctgcgggctcctcccagggctggatcccaggggctgtccccacgctggccttcgcctccctgaagtggctttctgcagtgactttgtccattgatctgtttactgccttccctggggccacaagggagcctgccagggtggggcccatggttgtgttcttggtactgccagggcacagcctgccccgggtgctggagaccttcctgtggttccccagcaggtggccagcgaggcctcagcggtgcccaggacccacccatgtcctcagtgcagtgagaccttcccgacagcagccaccctggaggcccacaagaggggccacaccggtaggtgatgggtgggtgtgtggcccatggcagtggatgggctataggtggccggggtgcttctg

SEQ ID NO: 81853 - DNA, 1033 bp, Homo sapiens
tcggggtctgggtacaggtaggtgtccacgaccgacaccgcgtctttcctaggagatggggaggacccgctgagcccccgacctgcggccccgcgcgcccctccctgcggcccgcccctcacctgtacacgaacaggtacatctccttgtactggtcccggcccaggggctggctgctcacaaagctgtactcgtgctcggacacgctgcggagacaggggcccgctcagggtcggggcgccgcgccggggcgagatcccggcggggggtcgcgacgaggggccctgcccaccacacctgttgatctgctccatgagcgcggacacggcgctgaggtctgggtctcgcacctcctgcaccagcgcgaggtcatagccagccaggatctggggaggagcggcgggtgcgggggtcagcgcggtcagcacccctaaacgccgccccgccccggcccgggccccaccttcgcgatgatgctgccgcaagcggggtccgacactttgctgtcaccgaagctctgaatgttgaaggctccgatgcgaagcgcggcggtcccggcggcttccagcgcccagagtgcggccagcagagcccggggcccgcccatggcgcggagcgagaggctgggagggacagacgctgccgcctacgcagacccgctgtcagacccaccgacccaccccttccctccgcggccgccccttgacggccagtgcgacgcggaatccgcccctgcgttctgcaggctcccagggcactgctgggctctcagggaccgctgccttctcactgcgcgggaagctgcagccggaatggagggtccggcccatccagccccagctcagggcagccgagagactcaccttggatgtgggtgcagaggcccgaggctcagagatcctagggggatggggatcccgggtccaggctgcgggcgtgtccgacacaggactgcactgactccctctggcagtagctctggcaccaaggcaggggccggtatttgaggtcctgggccagggaggggccgggc

SEQ ID NO: 81854 - DNA, 1068 bp, Homo sapiens
gaacaccttttttttgtagctccagtttaaaggaacactattcttgggggaaaaaaattagcaaatatgcgtagattaacattttagagagtttccaatctgttaaaagcttaaggatcaaattcagttttcttacatagaatacatttggctttttatatgggaatatttcctttaatcatttctgagaaccagaagtttcccagtatttcagcatttttagtttattttgctgagtgactggatttactgaatctatacagtttatttcttaaacacttgtatctcataaccactcatgacgtttatagctatttgtatctggcagaatggttttaaaagcacatggacccttgtgaatagtttcgggtggcattttgtcctcagtgcagcattttgaggcatgtggagtcatctctgctccactccctgctgctgtgactgaggccgctggcactgagaacacagcccacagtgctgtctgggctgccaggcctggtggggagtggagtgtgcgtgccccagaactttccgtcttccgaggccctgttacaaactgtataagtagcttagctggtttttttcagtaattgcccttcaggcattaggaaagtttccttgatatttggctaacttttctttcaagtttcttaagtcctgaaatgggttaggagctctgtgcgctcacatcagctgttggccttgtaagtcacacctttgctgtggagtctgctgattatctgctgtttgacagtctgagtgcttgctgagctaaaaacccaggggacccgggtaccttctgggtgggcgtgattacagacattccaacttttcgtaagattctggtaggattttttttgtgtgtctccccttctgtctttgaatggagtgagtccatgctgtctccataggagatgagaaggggttggcctttactggcagctacacagaagatggatttttcttcattattatagagtcagtgctgtgaaatccctaatttgggctaacttaggctgagtttactgaagttaaacctcttaagtatgttctgaatacatagccaca

SEQ ID NO: 81855 - DNA, 1013 bp, Homo sapiens
caagttagaagtgagagttcagataagtgaggccgccattgctgctttgaacacctcagaaggggagaatggatttatcaggagtgaaaaagaagagcttgctaggagtcaaagaaaataataaaaagtccagcactaggtaatccttctgtaagatttttctagtgctacttgggggtgcttactgctagggacccgcagaaaggggaaagttgagaatgttctgcattctacagtgagtgttctgagccacagaccactttgctctgtggtcacctcgggtctctgtggccctgctgatgctgatcccccgttttgggttgtgctgtttgggtttggtcagaggagcacgcaatctcacactcttcctcaccatccagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtggggcgggctggcctggagcctggagaggacctgtgccacagctacacccccactccccacagatggctcggttttcttgattatttacaaagaaaacacatcctctgattgttagtagagaccctaatttatggcagactggctaggtgcagtggtggctcatgcctataatcccagcactttgggaggccgaggcaggaggattgcttggggcctggagttcaagaccagcatgggcaacaaaacaagagctcgtctctacaaaaaaaaaaaaaaaagagtaatttgtaaaattagctgagcgtggtggcatgcatctgtagtcccagctacttgggagggctgaggcaagaggatggcttgagcccaggagtttgaggaaaataaacaaaactagccgggtgtggtggtacacgcctgtactcccagctactcgggaggctgagtcaggaggatggcttgattccagggggt

SEQ ID NO: 81856 - DNA, 1795 bp, Homo sapiens
agatgtaagttggggcggaatccgactgcatccgtgtttcgggggctgcccggcaggcccggcaggacgcctcgtgaagccggtccactcctcagccccgcagtgcggcggtggcctggcagcgcggtgcgggctccgagaagaaagagtgtggcccggggcgggcggagtgggaggtgtcgaggccgtggcccggaagtggtcggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgtgagtgaacgcggacgggtagcggcgaggtcggcgtgtcgggccggtgtcggcgggcgcggagtttctttgtgggatgcggtggaaggtcggccgatccccccttcggagtcattaattcaaacgtgtactccgcgaacgtttcccggactcccgtgtgcaattatcggcgctaggccgtggggatacggcccactatggaccgagcacggtggccgagctcagtttgatgggttaccccagaggggcggatacgggaaggttaagtttgttggaggagaaacgtggagtaggctttttgtcttgattccgcatgaactgtgcctgaaatgtacttttaaatggggaaggtgctctgaagatttgtgccgaaacgccctctcctcgagatttaactaattgttctctcctctctctggctgttggacgcgcacctttccggaggatgggggaggtaaccgaggtcctgagccggtacctgaacttgggtgaacagagaacctcaacttttgctttctagcactcgaccgcacccagcaaggcgtccgcttactcagtggttcttagtgtttggagtgcttaagaataactggtggtgtttgatttcaccaagtacattcgggcagatcttagttcttgggggggtggggctggaatctgcgggtgtgacctccactctaggtctgtgctgtccagccaagtagccattggccacatgtggctgctaagcatgtgaaatacagctaatcaagactgaaatattaaaacacacaccagttttagaagactaggaaaaaagcaaacttttattagatgtttatgttgattatatgttggaaagataatattttggatgtgtcaaacgttaaaaattaatttcacccatttttgtgacgtggctactaaggaatttcaggtgatgcttgtggctcctcacacggtttctattggacagtgctgctgcaggtgattcgaaggcgggtgggtgcaggaacccagctgagagttcagaaattagtgtaactttggagacaagtgtctgtgggggaaggagcctccggacgtggagatacaactcttgctcctaacatttatcgagtctttaattaatgccctgggtaactataaggttggaactgtaattgtcaccatattgatgatgagaaacttgagaaaggataagtgacttgtctaaaatcacacagtaaaacctcaaatcaaacccaggccctctggctccagactctaaattatactctgaatgatactcactgattgtccgaggacacaaagagtgtcgaggcactatctgctgggtgtctgcagaaccttactgttctaaagcaaaacattttacccctggacaagagcagcaaaggtggcgttcggccctccttgg

SEQ ID NO: 81857 - DNA, 1029 bp, Homo sapiens
gactcagggaggacagctggaatcccctggcggctgccccctcgcctcctccctgcaccctcagcctttaccctccatgcatgggcagcacccggagcagccatcctggttacagctccgggtgcaaggggacgaggggaaactgggacagagagggtcctggggctgaaagccaccgcgggggccagacgtggcctgtggggctgatggacatgggccagctgaccgggaggggtctgaggacctccaaatgctcctctcaccccttccctacccgtgagctcctctcagcttggcatgcacagcagcgcctccctgtgccgccgcaggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccaggtgggcacctggagaccacccgcagcccccatggccatccacggagccactccgcccagacagggaggcaccagccacagccgaggcgggactcaggcaatgggcccagttcatgctcaccagcccctctgccccagctggccctgcccggctagccatgactggtgggcaggcgtctgcggcgtccttgccctgtgcagagccggcaggggcgtccctgggaggtgccccctcactccacacagcacggataaggccctgtgcccgccctgaccaggcccgtcctggaggtgggtgtggtgtgccctccagcgcagactgatcttacctccccaacgcagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgc

SEQ ID NO: 81858 - DNA, 1057 bp, Homo sapiens
cagccccaactccctgtgacagcagatcagctgtgggccatcccatgcactgcggtcctcacggggacccatgaaggctcggcaggcagccctgccttctcctcctaaatctacctggctcctgtcagccactgtcctcgctccacactgctctctccagcagtgtgacctgctgggcacatgagctgaggtgatggagggtgagcagagcaggacttggcaagaactgccgtccctgttcctcagatggccgcacgtcgggagcctgccatgccattgtgtgggcagggctaccccctatgccggccacagagcccccagagctcctggaaccacccagaggaggccaaaaattctgttaatttcagaatagccactcctcctcagggcagtgtcgtctccacccacattccaggctaggcctaggcctggcgatggctgcgtcccagcttctggctccatccctgccccaagagcagaaaagcaacagccctcgatctgctctccttgccatcaactcaggatcctagaatgacacacagaggccaggagaggctttccctttgccacactccaggaggaggtggggctcgggacctccacacctgggcaaggtcgccggcagccgtggggctgagggctgggagcggggtgatgagggagagtgacgctgccattgtcacatggtcagcataggaattccagaggaaccgttctccggtgggggcagatgttcccggtatggaaccatggtgcttgtgctctcccataagcccctttagtggttgggctgctgccctgcatgccttgggcggtcataaccgagaacccgacctctcctgccacccagacgtgctgtgctccgtccctgaccttctctgtcccccgcaggggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgg

SEQ ID NO: 81859 - DNA, 1020 bp, Homo sapiens
cagcggcgaagcccgaacccatgcggccgggaggggacgcccacaaacccctgcccgccggccgggaagcgctcctacgggaccccagccccgttggggaggcggggcggccacgcgggttccaccaatcagcggccaatgttcgaattcgcgtcctggcgcggccaatggcgggtcccggagcaggcggggagggcgtggagggcggtaaatgaggcgagcacagggcgggacatgggcggggccggcggcggcccccccgggcaggccaatgggagggccgggtgcgtttgaaaactggggtgggcggcggggcggggtctgcgcctgcgcgagggctacgcgcgctccggccggggcgcgggcgcgctctcaggcgggctccggcggcagcgacgcgagcgcggcgatggggagcggcggcggtgagtgcggggcgatgtccgctggtttctgccccacaccccttctgcctgccctgcggggcggacggtgggtcccgcgggaggggaggccctggcggcctgaagagggctggctcgagctctttaacccggggcggatgtcgcgtcccgcgcagggagccccggcggccgggcgcgcggtttaaatgcccggcgggcgcccgagcccctcggagccttcccccgcggcgacgttttccggccctttcctggggcaacgatcgggtcccggggcagcgatccggcgatcgggtcccggggcggcgatcgggtctcggggagccaaacaccagcgcctcctggtcggggaaagggctgcggagcgcgtgggggcgaagcgatcccgcagcccggccgggccctgaccgagcctcagtccagcggggccgtggacctagctctgtggaaagcagcgttcggccccgcgcgcgttgaggcacaggaaacacgaactgtggtttcagctattatcatagtatctgtcctggagccggagaatgaggaatattttatggagaggtctatagaatctttgagaattcgtcgccctggaata

SEQ ID NO: 81860 - DNA, 1014 bp, Homo sapiens
aatcccagcactttatgaggccaaggcaggaggatcacttgggtctggaattcaagactagcctgggcaacatagcaagaccctgtctctagaaaagaaaatatttttttttgactagctgagcatggtggcacatgcctgtagtcctagctacttgggatgccggggtgggagaatggcttaagcccaggaggttgaggctgcagtgagctgtgatcgcaccactgcactccagcctgggcaacagagcaagaccctgtctcagagagagagagatatatatatatatatgcacacacacacacacatatatatgcacacacatatatatatgcacacacacacatatatatatatatatatatatatatatatatatatattcaattcagggaacaagtattctgacttcttcaagtgctgtagtagttcataacgtttgtggcataaaatattgtgatgctttatgttcttaatgtttcagggctgctgaaaaggggaatttcgaagctgctgtgaagctgggcatagcctacctctacaatgaaggccgtaagtcctcaccccacctgcatgttggcgcttcagataagtgtgagcctttggccctatgaagaagtggtccccgtgttagcagttcagttgctgtccttgctctatccgatggcctgcctccccattccctctcaggagctcgtgcccagatgtaccctgctgagggacctgctaatgatactctgactttgcaggttacgaaagtcgcctcttgttttagcaaaccctttaatttcagttggcaaagagtgactgagccagagcctcagcacgggggctgtttgggctccctgccctgtgcgccatgagcacgcagacctgcctgtggatgctggccctctccttggccatcctcttagaactctcgagacagagttcagcgtgccctgtaacacagagccaggcttctaaacgggaagcaggtacaggcaggttagaactggcctggtgcctggatcc

SEQ ID NO: 81861 - DNA, 1917 bp, Homo sapiens
agaagcagcagcaggcccatgacctgtttgaggaggctgctcatcagggatgtctgaccagctcctacctcctctgggaaagcgacaggaggacagatgtgagtggtgcctgctctgggtcggggggagttatgctggacaaaggcgtagttgatgctggtccttggatgcgtttctgtccacaaaagggaggtggctcttgctgctcccggtctctcagcctccgggaaccactggtcagtcggctattcttggtacccccaaaaatgactccaccatttgagagagaagaggtgggaagttagcgtagtgtcggcccttctgggtcttggttctgagttcctcccaagacacagttgtacaaaggctcggtgatctcccattgacaggtgtcagatcctgggcgatgcctccacagcttccgaaaactcagggactacgctgccaaaggctgctgggaagcgcaggtgaggtgcggggctgggatgacgtggggagctggcctttctccctccagccttggggcaggactatctgggctcccacattggggggcaggactatctgggctcccacatgggaggccaggattgagggacaccctaagatcggttcagcactggaactggtcctaaaggacaggtacactgtgagaagagctgggaaatgcgttattcatctctgcctatccactcttgcctctcagccagccaacctcttaattttcaaatgcttgtgagctatagctgctgtcaaaatttgtgccattcttgaaagttgtcccataggtagaactgatcttgacaacaaaacttgaggctacttgagagcagaggggcgtggagagtcccttcctgcttcctcttcctgttagcgccttgcttgtcatgtcacctggtcaccaagtcatccagggctacaggcaggaaatcaagcattggtagactctcccctcacagctataaataagttgttagggccaggtgcggtggctcacgcctgaaatcccagcactctgggaggccaaggtgggcggatgacctgaggtcaggagttcgagaccagcctggccaacatggtgaaaccatcgctactaaaaatacaaaaattagctgggcgtggtggcaggcacctgatactcaggaagttgaggcaggagaatcgcttgaacccgggaggcagaggttgcagtaccactacactccagcctgggcgacagagcaagactctgtctgaaggaaaaaaaaagttgtcaggacgaatcaaagaaagctcctatttgccaaatggatagaagcttgttcttgtcaccccaccaagtgggtggcagagtgatctgcgctcaaatgctagggacaaaattacaaattgataatggcccagcccgaggtgtcatagcacattgtggtgttcacgtccaaaaagccagtctacagatttacaagaaggccagacgtgatggctcacgcctgcaatcccagcgctgtaggaggttgagttgggaggatcgcttgagcccaggagttcaagaccagctctggcaacatagtgagactccatctcgacaaaaaattttaaaattagctggatgggctgggtgcaagtggctcatgcctgtaatgccagcactttgggaggctgaggcgggcggatcacgaggtcaagaggtcgagaccaccctggccaatgtggtgaaaccccgtctttactaaaaatacaaaaaaattagctgggcctggtggcatgtgcctagagtcccagctacgcgggaggctgaggcaggagaattgcttgaacccaggaggaggaagttgcagtgagccgagattgtgccactgcactccagcctggcaacagagcgatactccatctcaaaaaaaaaaaaaattagctggatgtggtggcgtgtgccttgta

SEQ ID NO: 81862 - DNA, 1025 bp, Homo sapiens
atatataatatatatatatttctctgtttttgggtggctagctggtaacttctgaaaatagctgtttttaataatcacagtgtttgctgggatgaagctgtgatgaggcaggtgctcctattcctgggtgtaaacattggcagaagcctttcggagagcactggggcgtatggccagagacttaacacagcttccccaggcattagccatgtaagaaactgagacctgagccacggtggaaaggccactgacatttcattatatatcttttctcatgtcatctattacttatacaaaaaggaataataattaaaacctgagccatccttgttcccgaagcttgtgaaggtttaagttaagtagggcagtgtgtccacatgcatttggtgcctgaatgggcctttgcttcagaaatggaaaactgcaacatggctgctgtctcacgctcatgtttgtcttttcttcctcagctgtctttagccaaagcctgtgcaaatgcaaaccagcttggactggaggtgagagcttccagtgagatcgtctgccagctatttcaggcttcccaggctgtcagtaaacaacaagtcttctccgtgcagaagggactcaatgacacaatgaggtgaggcattcaggccggggcttctaatcagagcggcgcggaagccagcctccaggggaagggagccctttccacttaaccccagttacctgtgacagggcggcatagagttcccttatcaccctttttttttttttgaagtggagtctcgctctgtcgcccaggctggagtgcagtggcgcgatctcagctcactgcaagctccgcctcctgggttcgagcaattctcctgcctcagcctcccgagtagctgggactacaggcacccaccaccatgcccggctaattttttgtatttttagtagagatggggtttcaccatgttagccaggatggtctcaatctcctgacctcgtgatccgcccgctttggcctcccaaagtgctgggattacaggcgtgag

SEQ ID NO: 81863 - DNA, 1058 bp, Homo sapiens
gcctttctcctgcctcagtcccccaagtaggactacaagtgtctccactctattcagaaaggcatttaccatattggggcatcatttaccgtattggggcattcccttgcgactgtccaccttctcccgctccctgcacgccccgagggtcagggttcatccactgtgggcagaccaacggctgtgggctgacttttcactttgcgtcaggtcgaggtctcaaagcgcttgtgtttgggagcaccaggaacacagtcgaaggatgtggggcctgctttggggctgggacccacggagcctcccgggcttcctgtgacatggcctctccagccttggttccagggtaaacccatgattccagagctagccagcttatttggtcgggcccaacaggtggggttgaaatcgcagacagggacacatggagaacgcccccaccagttcccacgtgcttctctttccgcaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtgagaagcccccttggcccagctggcagggacgtgctggcctttcccgggttcagggtcacctgcccttcatgtgctcctcactggtttggttttgttttgtgttgtttttttttttttcccgagaccaagtctcgctctgtcacccaggctggagtgcagtggtgcgatcttggctcaccgcaacctctgcctcccaggttcaagtgattcttctgcctcagcctccagagtagctgggactgcaggcgtgcgccaccatgcccgactaatttttttgtatttttagtagagacggggtttcatcatgttggtcaggctggtctcaaactcttgatttcaaatgatccgcccgcctcaacctcccaaaatgctgggattacaggcacaagccactgcgcctggccctcactggttcttgactcat

SEQ ID NO: 81864 - DNA, 1169 bp, Homo sapiens
ttgggttctaaagtctgttgccagagtttcctacactcttggagttagagagtttttcgtcccccactggtgccctgcagagcccactccagccacgtgggtgtctctcagcagcagcgtgcgtccttacacggcagcctgtccttttcaaatcagaccactgctttcctttaactaatgctggatcccctagttccgcctttggaaataacgtggaaatgattctcacaatacgatttgcatttcctaaaccagctgtccccagcatggtctacatttcccgaggaagtgctttccagaccgactcctctgtagagcctggtgggtgaggataggcttggctgcacacagcatatgtgtaagctacagagacttgtttctttcttgcacaggtaacccagaggcagaggttccaggctcaggtcattggcatgttttttgtttcatgaggaagcagaggagccccatctcccatcttaatctctgccaccaactagggtgctgcccttgtccctgtgacacctgtacctgccacattcacctttgcactgagcttagtcttgtgaccacatctcaccagacgggaactgggaggtgtagtctcttcgggcctgtgtgtgccagctcgatgcagtgtcattcccatggaaggagggagcaaaccctgccacaagcatccagagctgtcttcagatgcgctcttgggcctgaatccagcgtcccaggtcttccgaccagagacgactgaggaggtcgggcggccgcctccctggatctgactgcacatccatcactgcaacctacgacaaagctcctgggccacaaccggctggcagtgagagaataactgctaaaaacgtttcagggagctgagtccaatttcttccccaaccacaagacctgattgcagtggtccatataactatcaccacagctccctcaaatcaactctgccttattatcttttttttttttttttttaaatccggggaccaggcacggtggctcacgcctgtaatcccagcactttgggaggctgatgtgggcggatcgtgaggtcaggagttcaagaccagcctggccaacatggtgaaaccctgtctctactaaagatacaaaaaattagctgggcgtggtggtgcatgcctgtaatcccagctactcaggag

SEQ ID NO: 81865 - DNA, 1071 bp, Homo sapiens
tcatccctctttccagcactttctgacctcccctttgttattattatgatgattattttttgagacagtgtcttgctctgtcacccaggttggaatgcagtggtgtaatcaaagctcactgcagcctcaacttcctgggcttaagcaatcctcccaccttagcgtcccaagtaactgagactataggcacgtgccaccatgctctgctaattttttattttttaactttttgaagagatagggtcttgctttgttgcccagggtggtctcgaactcctggctgagctgtcctcctgcctgggcctccccttttttaaatgccccttgtcagccacaggcagctggctccattatgaagcctctgtttgtcaccaaagcccaacgccatggctccctccctaccttgaggcctcctaaagccttgggtccctccgccccacccctgccccaggaagtgggctccaccctgagaccccttctcggcgttgcaggtttatcagtaaagagatcctgaccatccgggaggccgtatggctcacggacaacacttacaagtacgaggacctggtgagaatgatgggcgagatcgtctccgccttggaagggaagattcgagtaagcagcggttccattttccttattaatcttcgttgtcgctgtgctggagggtgggggtgggcattcagctttcctgctgtgggagggcctcatggactcagagagcagctgtctctgctgtgcccaaagccatggagcaggaggccacggttgcaccacgtcgccatctgcgctggtgcgctacgcgtgcagcatcggcgtgaacatcatccgggccagaccctgcgctgggcctgcatgcggcactgcaccaaggagcccccgagcgctgagagcccacaccccgtcccggctgtctaggtccccactgtggtggattacaaggaggtcctgctgacgctagtccctgtggagctgagaacccagcacctgtgcagcttcctctgcgagctctccctgctgcacaccagcctgtccgcctacgccccagcccgcctggctgccgcagccctg

SEQ ID NO: 81866 - DNA, 1569 bp, Homo sapiens
ttcccattctgtacattccatataaatggcgtcatcggacaagtggccttctgtgtctaggtgatttccctcgcggtaacgtttgctgggtttgtccatgtggtgtgtgtccctgctttgttctttttcatggctgaataatattcccctgcatggaccacatgtgtttatccatcccgcagctggtggacattttgcctattgtgaacagtcctgccatgaacattctagtacaggtttctgtgtggacatagtttttcctttttcctgggtctttacctagagaggaattgctaggtcctgtggtgactgagtttaaccattcggggaactgccaggtcagattccagagtgactgcaccattttgcattctcattgctcacttcagtgaactgaagctaaaaatggggtgggggtgcctcacatgtccactccacgtgactctgtttccagcttccatgatgacgcccccaaggactacaggcaagtctctctgaccgccgtgaagcagcggtttgaggacaagcgctatggagaaatcagccaggaagaggtgcctccctcccgccacctgggcgtctcatggggtgctggggtgtgggcgggcctcaccctcggggcctctgcaccccctaactctagcttcccctcaggtgctgagctacagccagttgtgtgctgcattaggagtgacacaagacagccccgaccccccgactttcctcagcacaggggagatccacgccttcctcagctctccctcggggcggagaaccaaacggttagttaccctgcgttctggctgcgccatacaatgctggcatcctcgtgccggcccagttccctcagcgcttcctcacacagagaggcccccaaggcttgtcaggggagcagcagatcccaggacagtgaccctgggacggagccctgcagtcatgcctcgggcccctgcgtaacctccactgtctccagcccaggtctccttcctcagaggctattgcctctcgctctgactgggctccctgtggaggaagatggtttcgagcacgcgggagcctagcctggctctagccctgcccgtgcctgtcatgcgcgtcctggacttctctgctccatgatgctgctgtcactcccggcactcgagctgtgacctgagtcacatccccagcacttccctcgccacccgtgtggacctgtttacccgcctctcctatctcagcaccttggctgttcctcctggagttaacttcctctttctacctcacccgcctggagaactcctactgattccacaaggccccgatgaacagggccctccctgtgctgctggccctgcgccgtgacccctcagcaccatgtgcaccagtaaccttcccaagggcaggcactgggtggctgggtctttcctgtcaatataggaccaggcagggctgcctccagaagcgttgtgtcgggagtgggctcctggcaggagacctcaactcctggggagccctggggaagcagccaaagcccctgctgctgcttcctccccaagaagcgtgacagcactttccattgtgtggaag

SEQ ID NO: 81867 - DNA, 1106 bp, Homo sapiens
ggggaccagatggttggcccacgccccacagctgagccgggtgggctgggcttcacacccagacctggggcctgagtttgcctgagctgtcctccaggttggccctgcctgaagggcttatacctgttctagcttcaccggcatcttcttcgtagcagaacctttgggagcacgtggtgacaggctggggcacgcgggtgttagaggcaggtgtggagggcctggcctcccagcgccgccgtccatgactgggtctcctgggctctctccaccttgcaggaagcgggagaacagcctccaggaagacagaggcagcttcgttaccacccccactgcggagctgtccagccaggaggagacgctgctgggcagcttcctcgactggagcctggactgctgctctggctatgaaggcgaccaggagagtgagggcgagaaggagggcgacggtgagtgtggggccagggtgcaccagaagggacatcacacagagggtggctctcaccgagggcctctgggcacccggccctgtgcgagcgctgtgggaggaagatgtgcacagagtgcggggtggggccagctcctgccccgccggggagtgtgtccagacatggggagagaggaggggagagcccccaaaagaccacagctgctcccaccacacagggatgagaggacttaggccacacctatccggctcctgctcattccgtgttgggaggacctcactaggatgagggaggcagagaccctgtctggagttcatggagatccttctaggcctgtagtctcatgcctgtaatcccagcaatttgagaggctgaggcaggaggatcacttcaggctagaagttcaagaccagcctgggtgacacagcaagacaaaaaatttaaaaattagctgggcatcgtggcgtgcgcctgtggtcccagctactcaggaggctgaggtgggaggatctcttgagcacaggaggtgggagctgcagtgagccgtgatcatgccactgcactgtagcctgggcgttctttctagaatgttgtttgaggtgtgcccacgtggtatacgtgacactcctcactgccctgctgggatcactgccctgt

SEQ ID NO: 81868 - DNA, 1091 bp, Homo sapiens
cctttgcgcagagagcagagaggatgacttgcggccaccaagtttctgtctccgcgggagtcccgtgcaagccatcagaatgttgaaatgagggtgaagagctcagatccctctctttggaaagtttagcctggaagcagttggccacactgtgtggagggcacctctctgtcccttccgtgtctcactgtctctggaagcttcagcccatgtgtgtcctggtgttcccagccccaccagagccccgtgccgggagctgacagctttcacgcttaaggcacgtgtgacctgggtagtcagacaccacttgagcccctgcccacatctgctggtttggggcttcagtggggagctgacagctgtgagcacaccactgtcccctcatccacctcggcctgcatggggcacccacttccttctgggtggggcttccatggtaagggggcctgcgtccctgcacactgcgaggactgccttggccacaggcccactccctacgacacgtgactcgttttagagctctgtcccagaggcgttcgtatgtgacccacagatggcgtcaatgtgaacacctctctttgtgctgaatttctgggccattcttttcctgtcttatttctaaatttccttcttccaagatgaaaacaaaagaaaaacttaaaacagaaggtattaaaaaaacaagagattcccaccattatttaggttcacctgcaaaacaaaaatcttactccagcccctcaatgccatcctgacacactttatgcaaaaagaattttcccagataggctagccagaaaaaacttcaagtcctctgtaacatctgaggtgaccaagaggcagaagagcagagcagtcgggggccgtgtcctggctgatcccaactgcagctctgctgtgggggcccgtgggagggaggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactc

SEQ ID NO: 81869 - DNA, 1045 bp, Homo sapiens
ctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgggccactgcccgggaatcccacgcctgcctcggtgaggccttggagggtggcctggggaccttggacacaaccagcctgcccctgacccatccctccctgcagcttgctcctgcaacggccatgcccgccgctgccgcttcaacatggagctgtaccgactgtccggccgccgcagcgggggtgtctgtctcaactgccggcacaacaccgccggccgccactgccactactgccgggagggcttctatcgagaccctggccgtgccctgagtgaccgtcgggcttgcaggggtgagccaccaccggccacctgcaggccctcaccctctgacttcccagatccccagacaggcttctgaccaggcccttcccacctctgtcctcagcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttagtgagtgaccctgccccgcctcagccaccaagccaaggccaccccagctccctgctgttgtcccgtctattccccgagccctgcagatctctctgcccctccatcgcaggccattctccctccctctctgcagagacccctatccctggacccactgaggacagc

SEQ ID NO: 81870 - DNA, 1529 bp, Homo sapiens
gggaaccccaacttgaagttggttgctgagaagttccagaggcctggacttctgactggtgtctggagacgtggggggcttgtgggatctgagctatctccaggtagatgtctcccggtgtcgggattgaattggaggacaccctgcgggcgcccgctgcagaatggattgcttgctgccgggagaaacccccgcatcttctgggtcgcagatcctgtgccgattgcggtgctggcgtcagagcagaggaaaacgtggtatgagagtttttccaaagagtccagacacgcttccaggccctctcagccacccccacaccgtccctaccattcccacctggcccgctgctgcctgtgccccagggtttccgggcactccgagcttccctggcaggcaacaaagctctcatccctggatcttgcggatctcgcgcccgggctggaatgcctgtgctgccctcccctgcctggcgggtggggtcggtgctcaggagcgggtggggcctgccggtctccctagcccaccaccaggtttcctctgtatccccgcagcacttggcaaggtccaggggcttccgtggggagcgagattgttttggatcccgccaggggagcccactgagaggagcctgcatctcctatcacgtgaagcccgcaggggccacagcacctccttcctgtggtccctagctgcgggcgttggcgttccccacccatggggcccggcctcatttcctcttcctcttcattcccggtcccactcccaggaaatggtgagggattgctcagaccagatgggaagaagtgagacgagcggcagctgacgcccatgccctgttctgtggcccgtgactgaggtccagccacacagaaccccgcgtccttgatagcttgtcagctgctgggacgggggctgttcttgtggccaggatgtgtgtggtggtcaggccagggcaggatggggcccaggcctgcaaccccagctcttcaacctggagtcctagcgaacactgacctacgttgggacagggctgcctcttgcccagggggctgcagttggccccttggtggcatctgggagtgtgtgggagtgccttctgtgctgtgggcctcatccccagggctctacctccagcctgagctgctctggcatttgcctaagaagcatctgtatcgaaactggctttgaaaacttcacagtggagcttccctgggctggaattctctgtttgtcgctcgcccccgcctccagcatccccaagtggcctgggctctgactgccactgtcaggccacggtcctgtgggatccaaccctgagccatctctgggggtcccctcatcttctccaccctcccggtctagactctgccttcctttctccctggcttctctgtcccaacccttcctcctccagggccaccagggggatttttgtaaacgcagatctgatcgggtcacctgcctagactttcctcctaccccgtgtggggacacccgcctcttagcgcatcccagcccctcagcactgc

SEQ ID NO: 81871 - DNA, 1081 bp, Homo sapiens
gtggctctcgtctgtaatcccacactttgggaggccaaggcaggcacatcacaaggtcaggagtttgagaccagcctgaccaacatggtgaaaccctgtctctagtaaaaatacaaaaaattagccaggcatggtggtgcatgcctttagtcccagctactcagaaggctgagtctggagaatcgcttgaaccaggggcgaggaggttgccgtgagtggagatcgtgacactgtactccagcctgggcgacagggtgagactccatctcaaaaaaaaaaattaactgggcatggtggtggacacctgtcgtcccagctactcaggaggctgaggcaggaagatggttcaagccattcaaggctgcagagagcagggtcacgccactgcaccgcactccaacctgggcaacagagcgagaccctgtctcaaaagaaaagaaaactacaccacatttgaaaaaatacgttctttaaaatgtgaaccttgaaacacagatgctaaaagtgtttttttaatcctgcagggtgtgagatggcagacaggtttgcaggaaaccctcagaaagggggctggaggatttagccactctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacg

SEQ ID NO: 81872 - DNA, 1022 bp, Homo sapiens
ccccactcagccactccgcctcctcagaccccgctgaccgcctctcgcccttcctggccgctcgccacttcaacctgccctccaagaccgagtccatgttcatggcggggggcagcgactgcctcatcgtcggtgagcgccagcagacggggctctgggatgagggtgtggggtccgggcagctgaagctgctgcacccagccctccctgaccggggtggcagagaagaggccctgggtgtcagggtggaccaggcatgatgggtgggagggggctggaagggagagaccagcctggacagctggtcctgggggctatggagggtcaacggtctgtgcggtttcagagaggcccgtgcagggcaggacagctgggacagcaggtgaggtgcctgggtcagtgctgatagggcagtcaggccgccactgacctgagcatcctgcagggggaggaggcggccaggcgctctacatcgatggggacctgaaccggggccgcacaagccactgcgacaccttcaacaaccagcccctctgctccgagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtggtaggcagggttgggggacggcaggaccccatggccaagcctggcgttgcctggacctgctgctgcctctacctggggtttgggctgggcttccccagtccacctgcatctgggtcagagctggagggcctgctgtgcccccagccccacccagagctggcataggaagtaccttcctcctccgtggaggcttccatagcccaaggccttgggagtgtctgggtcttgctgcccctgagcctctctaggcagcctgagcccctggggtgggagtacaacggcagtgggaacgtgcagctaagggtgggcctgtggtgccccctgctgg

SEQ ID NO: 81873 - DNA, 1390 bp, Homo sapiens
cccaaatggccactaattaggcaatacagcacctgcctcaaatttgggttcatatagatttttttcctccctttttgtggagaacatagtcttgctgtgttgcccaggctagtcttgaactcctggactcaagcaatcctcccgcctctgcctccctaaattctgggattacaggcgtgagctgctgtgcccagctcatccagattcttgctggttctctttctcagcctaaatgtcttgtttgcgtggagaaattatcaaatgaagcaggagtgccaaacaagcctcataggctcttcaccctacaacatctatgttaggtagaaaagtatgtggatttttaaaaatcatctggtataaagagtttttaagaactatcttcatcatcttagtatcagattgtgcttgagaagttaggtacaatgtaatgtgattcattgctaaaaacaaaatgcctcccacaattgcagactcactcattttaccaaactatggaatttgtcaacaccttttcttgggaccaaggaagcaaagtcagtggataccgtgtcctgtagacatgtcacttgtgataaggcacggacaacatgaactggcaaaaacattggcatttggtcaaatgcttatgagctaaggatagaagggaaaaaatagttgtgtgaatgattttacctcttagttcttacgaaggatggttatcgggctggaaaaatgtttattggactgatgctttggagcctctcaatgaatgtaataaaaaaaatgtgtagtgagcacaaatgtatggatttgcagcacaatccaactttgaaaatgtgaaaataagtgagttagtgatatgtttggttggtgttaatttgagtcctaaataaaatcgagaactggtaaaagaaggtcactgtgaaataacttgctatgagaaggcttagagggatgggaagtcctggacgcctcttctccagggtgttggaggagagagggaggcgctaggttgacaagaccgcatctgcgcattgtggtcaccagcgagtctctccactgaggcgacaggtacatgtctgtcgcatttgcagccgtggccggtgagaacggcagcattccctgatccgtcttgttttcttttgttcctagtgcctgctgtgtggacagctacactcagcaaagtcttagggagacttagaggagtcaccatgaagaatcagtgtcagacgtttcatcaggaatccctgtcaaggccgggtgtggtggctcacacccgtaatcccaagactttaggaggctgaggtgggtggattgtttgaggccaggagtttgagagcagcctgggcagcacagggagactccatctccacaaaaaaatagtgaagaacccctgtcgtgtgtaaaacac

SEQ ID NO: 81874 - DNA, 3623 bp, Homo sapiens
gggaacccaacacctgcagacgacgcgcagccgcagaggaggcggggcgtccgaggccccgccccgtatgctaatgaagcacacaccacaccgccccgccccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcggtgagcgcggcggcgggagggactcgggggcgggggcgcgcgcgttgctcatgcccgcagctcgccggggtccggtgtgtgacgtcactctgacgtaatcccgagctgtcgggggcgcccgggcctcgtgtgacagcgggcgggggtcggcgccccgagggctgcggggagccgccgggggtccggggcgcagggcgtgcgggcctggccggggtgtgagtctcgggggtccgggccggcggccctgccagccgggtcgtgcggttgcgggggtggggcggcggcgccgctgccatattagccccgggagcggcgagagggaggctggggtgggggcgcgaggggggcggcgcgaggggggccgattctgcgggcaggtgacatcacacctcgaaggccccagtgcgcgggcggcggcgcgggtccggcccaggaacgcccagccggtcgctggagctttccggctggtggggagcccatgtcccccacgggaggtcctcagccctcgcccttatggcggccggccccgagggtcaggtgggtctcacccacaggcaggtacttccggttggagctggttacagttgcccaatacccgtgtcgctgtgtgggctgtttgggaaagctgggctgagggcttggttcggagagcccgcggagacccgggtgggagtgtgtggaagtggagggagcggggagacagcagcatcggcgctggcggggctgtgtagcttgcagagggtctgtgctctgaggtgggtgagagggtggcatgggtgtccgagtttatgggatccagtcgttgccctcaggactgaggcttccagttgtggtcctaatgaatggaggggtgaatgaatgaccttcctttccctccctgaggcctgaagttgggaggggcttccctgggcttggagaaggggccttctagggttcttggtggcaccctgcttttgaaattgggccttgacaggtcctgggcgtccaatttagtgacaattggtctccctgggagaatggcacttgggctagggctaggcccaggaatgtgggtccgacgagttaagttctggcccagtctcagcctccgtggactggcctggcctggtctgatttccgcctccgtggttaggtctggttttagctttgatgaccgtgccctgccccaccctgcctggtggcctggggaggctcctagtgcagatatgtggagggtttgaactccaaacagtctctgctgactgtaaacacctgtggggtgggggcttggagctctctgttctcttgcgggcctccttctgcctgggcctgtctgccattcgtgagtgagccctggccttcccgtcgtgtgcaagtaaggggtcatttgtggtggaagaagtggtctagacttctccttccccctaggcaccgcctgctctttccacagactcaaggcttctcccaacaggctgccgagcccttccccccagcctcctctgttctttgccctcagaatgccttcagagattccattttgcctggccacctgtggggtattagcttgtggctgtcactcattcatccaaacaatcttgattgagcgcttactatgtgccaggtactggtaggacagcagtgaacaaaatgggatccccgcccatgtggaacttaaattctagctgttgctgcttgcccttgaagccctgagtttgtccaccaagccctttttctgcacccagctcctttcctctctctccgtcaagacctacacaggtctttgggcagcctgaccagcaggtgtctggaaattgagaacacggtattgctggcctaggcctttcctgcttatccctggctcttcgggataaacgtggcttactgtggctctccaggagctgacctctgacttcacttggccaattcagacaactgcttttttttttttttttttttttctcccctcctcaagacagggtcttgctctgtttcccaggctggagtgcagtggtgtggtcatggctcactacagcctcaacctcccaggctcaagcaatcctcctgcctcagcctcctgaataactaggactacaggcacaggctaccatgcccagctaattttttttttttagagacagggtctcgccatgtggctcaggctggtctcaaactccttgttgcctcaaacgatccacctgcttctgcctcgtaaagggctgggattataggcatgagccaccatgactggctcaacttctgacttcatttctgccttctcagcatgctttcctccaggacctggcttcacctgctgtgccgacctaaacaagccccctgccctccagtggcctctgctgttgccacaacgccaacctccagctgtgtccccagctcctggcccttggcctgcctggcactgacggattggtcttaaaccgaatgaggtccacaaacctcttgcaggcccccgtcccagcttccccttttttttctcatgacaaatgtcctgttctttcttcatcatgtccttcaagaagttgtcatttgctccttttctgtatttcctgtgacttcctccctgctggcgagtgccttgtattttatgcttgtgtttctgcaactgctttctggccccccactctttctgtggctgctgagcctagtgccgctcacaggtctgccttctgcagtctggtcaggcttggcctccggactggagtccagggtgctcatggtattccgctcctggtggccatccctttcttccctgtgctcctcttggtgcctcctccccctgccagccacatgattcttcctgctgccctctgtagaaaagggcctggctcacttcctgcctctggtggactactggcctcacagggtccactacttgggttgctgagttccctgtattcagtctcctgccaacgtgtctgccatgctctggtctcttgtgcatacatgatgcagttggatgtggtcctgggcctgcagtgggagccccctaaaatgcactgtaattgctctatatgcttgccagggaaaaaatgcactgtaaccaggagttcagg

SEQ ID NO: 81875 - DNA, 1011 bp, Homo sapiens
tttgtgtgtgtgtgtgtgtgtgtgtgtgtgtgtgtgtgtgtgtctgtcagagattcactcttgttgtttgtttgagacggagtctctctgtgtcgcccaggctggagtgcagtggcgtgatcttgactcactgcaacctccactcctgggttcaggcgattctcctgcctcagcctccctagtaactgggatgacaggcatgcgccaccactcctggctaatttttgtatttttagtagagacgaggtttcaccatgttacccaggctaatctcgaacttctgacaccaggtgatccgcccgccttggcctcctaaagtgctgggattacaggcgtgagccactgcgcctggccaagtcaggctggttattgatctgctcccctaaaagaccatggcatgagttctgtgggcagagagggggcagggagttgccagtgcagtccccacaagcagctcagtaggcccctgtggtggccctggagggcagctggcagaagtcagaaaggcaaatgagcccccgtgacactgctgtgtccacagaattctccactttgagaatagggcccaggagaggggaactgaaaagaaaggcaacattctcttgggagaggaaggagggacagctctggaggagacaggccaccctggagcccagcccaccagcactgttgcggtgggaggcttgggccctctggccaggctcctgtgtgcttggagccaccccgtgtgcaggggagacctctctgggaggtcagctgaggcctcgtagttggactgttgatgatccccgtcgtcttctctgcccccatcctcttcttggctcaccctgtctcctgtctggtagagaagattctccaatctgtcaagggttcaggcctgctgtgtggctgagggtgctgagagctgccctttctggcagaatgtttggccctcctaggttaatatttggggctgggagcgttggggagcttggcctgggcagtgagtcaagggagctctggcctgggtga

SEQ ID NO: 81876 - DNA, 1003 bp, Homo sapiens
catgaagtccatcatcccagtggtcatggctggcatcatcgccatctacggcctggtggtggcagtcctcatcgccaactccctgaatgacgacatcagcctctacaagtgagcactggggtcaggcccctgcccagggctggaggactgcagggaggggggcggttcacctgtgggtggtgacccggacccttgtctccccctggttggcaggctgctgatgtcagtcctctcttctcgcccccaggagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtgacgggcctgtgtctgctcagcttgttgggggcgggggcgggcgggcgggcgggcgggcgccgggcgctgccggtcacgt

SEQ ID NO: 81877 - DNA, 1044 bp, Homo sapiens
agataatgaatattttcttatggagccacaagagttagtgagtttagaaaatgaaccctgttaacagtactttaattgagccgtctgtgttctagttctgtccagagcccccgccgttttcccctccagcacaggattcatttcaggatcatcacttgcgttatatgcccaaggggtccctctcttggtgtgtgggcagagccagagctgggaacaatgggggtggtgtgtgggttctgggctcaggcttcctggatttggcattggcctcctgatgtcatgtatcggctggaagactcaggacaaccttctgcctttctgagcctccgtttcctcaaacctgaagtgaggatgaaggcagcgtgcatggcttaggggcgttgggtgctcagcatcgtgcgtgagatgctgagtgttcaccactcagtattagccatggatgtctttttggaaatttcccacagccctccccacacagagtcaaatgtcaaaaacctgctgccaactggcacctggttctcacagctgctctctggggctctggggcctgtcagagccacctgtccaagattcaggattcagcacatcacctctgccccacccctaccggcagcattcctttcctacctgtccagcctcttctctgtccccagccacattccccactcctgcccccaaactcttggcctagaaggccctggcctgctccccaggcctcctctgctaagccttgcctacctgtccccactgtgccccccactgcctgcgcatctctggccagcacaggcgtgggaggaactatggctcttcttccttaggaagagtctctgacaagtaggactttgttttcttcccagcatgcactgcagtgcaggtgtcttaacccttggcgcacacacaggatgaaggcagagagccaactattgagggtgggaattgggaagcctcctgcctggatcatcttagaaactggaggccccttttcactcgggtctcccctgtgccgtgcacgccacctcttccagggcccactcaccctgggtg

SEQ ID NO: 81878 - DNA, 1105 bp, Homo sapiens
ttgttagcctgctgcagagtccctgagacagggagtgctggtgtggttgggggctgttggcaaagccatgtgggcttggggactgtcacctagctgtgtcccccaagcaggctgcagcatggagtcggccctggaggctgcatccctgcaccccgcccagttgctggggctggagaagagtaaggggaccctggactttggtgctgacgcaggtgagggcctgtcgcagggtcaccgggcagcctggccctgcctgtagactctgttgttcctggggcggcctggacagggccagggagggtgggtcctccctagctccctcctctcaggtgggctgccggctgccagcctcagttgtagccccgtgttgccatcaggccgggctttctggtgttgcagacaaggccaggcaaggggttgcagggagcattgtccagtacctctgtccatctgtgatgggtcagggtgtcttgcactagtcgtgtccctgggcctcagtttccccaccagcgtcgggttgttggggagcagctctggggtaggtgggcggccccactcctgccccctactcattgcccggctctgtcccagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggt

SEQ ID NO: 81879 - DNA, 1038 bp, Homo sapiens
actagcttgaaggggggcccccaggaatggccccttctggatttcatacccttgtgtaaccttgtttcactttttaaaagattttatttaaaaagttttttttttgttagagacagggtctcactttgttgcccaggctgctctcaaacacctagcctcaagcagtgctcctgcctcagcctcccaaaacacgcccgttcactttctaccagggttgtgtgtgaccagcagatgtgttggaagtgatggtgtgtcacttctgaggttaggtcattaaagacgcagcggcttctatcttgtgtgtgttctctttttcttgggccactcgctctggggaaagccagctgctggggcttgaaaacacacacgcctgggaagaggccgcactggtgagggacggaggcctccagcccacagctgtgggaacgtgggaatgaaccttttaggaagtgaatctttcggccctgctctagcctttagatgactcagtcctggcagcatcttgatggcaacttcacaagagagcctgagccagaccacccagcctggcctctcctggattccagacccgcaggagccatgagtttctttgttgttttacacatcaaagttttgaggcaatttgttacacagcagtatataactaatacaccagctgtagggctttgggcacgttccttagcctctgcacccccgtttcctccctcgtgccatgagcattgtagaggcgagtgaggaacacgtagacgcagcacagtgccacgcacatgaggcagctttccagcccctcccgggatggttgtggtcattttcttgcccctccctggatggaccgtgacctcacaacgtcaggccaagttattgcattcttggcctgaggtcatccattggccatagacagaggttctcggcaggaaagggtgagataaagagaggggtcagtctctttcctccagcccgggtcgggagaaccgtgctgggccaggtgagacatccgctgtctgtgcggtgtcctgggatgagccactggacctgacc

SEQ ID NO: 81880 - DNA, 1113 bp, Homo sapiens
ccgtgctggagagggctgaggagaggctgtgtgtctcagcaggatgccagtcaggattcttctggctatgggcttattttttgcaataaattcatcgttaaagtcccattctttaacctgttttttcccttttggaattaattcgactgcagtaggaaggggttgtagctgaaagtgaccgctgtgcattgaatgccatcagaaaaggctgatgagatttgcagggaagacttgaagcctcactgaaatgcgcctggcgtgtgttgacctttgcagtggaacatgtgggaaaggggcccgcactcacttttcagttctgcctcggtgattccaggagccccggggttgggagcggggacaggaccttgctcctgagtcttaggtgtggtgtctctcgccccttgctgcattggcgggaccctcggtgccgcggcctcagttgcagggcggccagggctgctccgtgaaggaggcgctcactccatggagctgcaggacgctgcattctcctcactctggccattgccgctgtccttcctgcttccccttttctggtgagggagggctccaaggacttgctggctggtccccagatgccagcactcctgcatcttcccctcctctcctggcctgtcactttgttcctcctctgtgaggggcccaggctcggatgcccggccacggcctctctttccagcctgtgcggcccaggtgggtccaggatgttccctgctgccctgttctcagcagttcttgtcttcttcaggcttttcctccttgcctagagaaatttccctacatggaaacccctgtggctgtacagtcttttctgaccagtctgctgggttttttgttatttgttttttgtttttgagacagaatcttgctctgtcgcccaggctggagtgcagtggcacgatctcggctcaccgcaacctccgtctttcaggttgaagcaattctcctacttcagcctcctgagtagctgggattacaggcacgtgccaccgcacccggctaattttttttttttttttttgtaattttagtagagaccgggttttgccatgttggccaggctggtctcgagctcctgacctcaggtgatccgcc

SEQ ID NO: 81881 - DNA, 1148 bp, Homo sapiens
gggaggttctgagtgggacgcgctcttcgtgtgggcctggaggacctctaggcggcctgcactcgcctgatacagctggcttctgctgggaggctgggtttgcatccaaactctgagaccttttggacaaaacatgccaaagaagttggtggtagtaagaaattcatactaaacttgttctgttagggtttttttccttccaggtatattatttcccttcagtagccctacattttaaaagttaacgttcagcgttgagtcagggtcaggttttgaatgacacaggatgttttcagatcctgagtttacctgaagctctcaaagtagcctcctaacaaaaattattgaaaacatcaactattttggaatacttttaggtatgtagaaaaattgcagacgacacagaatttccataatttcccccagccagcttcccctaatgccatgacatgaccgtgatacctctgtcactctgtcgaaactgaggtgttcgcgctggcaccacactactcaccgagcgacaggcctgttttggattttatcagttttcctcctgatgtccttgctgtcccaggaccccgccccggtgccacatcgcatcgcgttgtcctgtctcattcgccccctctggtgtaggatagctgccgtccttccttgtttgtcatcagcttggtacttttgaggagtcctggtcaggtattttgcagaatgtgccttcatttgggtttgtttgatgtcttgtggttggacaggttgtggggttaggaagaatcccacagagatgaggtgcccttagtgcgtcgtattggggtacaggacatccacgtgactcatcgctggtgacgttcaacaaaattacttacaaaacttttaaaaaattattattgtttgctttagagatgagctctcgctctgtcatccaggctggagtgcagtggtgggatcatagctcactgcagtctccaactcctgggctcaagcgacccccccacctcagcctcctgagtagctggggctacaggtacgtgccactgtgtctggcaaaattagttttactttaccaaaaggaagcacataggcctgctctgctctctgctacttgggggttttgtgtcatagattgtaggacactggtggtaatttaattt

SEQ ID NO: 81882 - DNA, 1142 bp, Homo sapiens
gcgcgcctgagctcgcctcgcattgttcttctgtagtgcggggggccactgccaccaccgtgaggacacgttggggtctggggagggattgttatggctgtgggtgcaccttgcacgtcttgccgacctagctttgcacgctgatcttccctccgtgcccgcttacattgttaactgggtttctgccctccctcctctccttcgtatttctgtgtctcattgacaactgttctgtagtcgctttgttgacagttgccaaactgctttccaaaaacatttccactgcaatcccggtttttggtgccagccgcagtggtgtgagtgcgctcgctttattatagtcttgccagcactgggcgtctctgtgtattgtaaacacatgcgatcatcactcttatctctccatcccccccacaattaaagatgtgccgtgctatctctgctcaggttaccttggccttgggatgagttggctggaggctcaggcagcgcgagggacaggaggagggcgaggcgctgcctggtggattagcggggagccatggcacgggcaggactcaggagaggaggccggcagctcacagcagaccgcggggctcagctggcctgccctgtgcttggggtttgtttttgagcgttgaaatgaggtccttaaaccttagtccgtgcattgagagcaaggcagctgccttgagccttacttccttttcctctttgtcgcctagtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggtgagtatttgctgctgctgtgtgtcaaacgtacgtgatttccttggggaggctcaccttcctcggggcttgccggagactccaagcaaggctggtgtccttccaggcaggaggtctcaggccccttgaggggtgtcacctgttgtgaaggccact

SEQ ID NO: 81883 - DNA, 1010 bp, Homo sapiens
cttgttacctgtcttcggggtgttttttcctctgaaagcaaagaaatgaaggtcgaaagcagctgacatgggacgttttgctgacgtgggacccatgaagccgtgtgtggttgtggatttagtgaaggttgtaacaggttcaggggaggcctgagcaactcggggtgtactgtctccatctgggcctctaaagagacagagtcccgtgccgccactgtggtcgccaaggtggccgccgtgtgcgtgctagggccattccagggagccctgggggcacctcactctggagggcctgggtgagttcctgaataattctttcttgcctgacctttgtgaagaaaccgtaggtgaggtttattttccttttttctcttttttacacataggaaatatttcacaatgcaaagaaaaacatgaaatatagcttacccatattcccaacatattgttttaattaatgttaacttttgctgcccttacactttagattttttaaattgcaggttttatgaaataatttttttataaaaggattatgccctcatgaaaaatgccttcaaccatgagactagtccccaaagttttggggactcagatcctttcagaaagaagaaactctttggaaaaccttgggcattctgcatggctgcttacaaccacccagtgaaagaacaggcctcctcttttctcagctttacctgttttttgagacagagtcttgctctgtcacccaggcttgagtgcagtggcatgatcatagctcactgcagcctcgacttcctgggctcaagtgatcctcttacctcagcctcccaagtagctgcagttacaggaatgcaccaccgtgcccagctaattgtaaaattttttgtagagacagggtctcactttgttgcccagactggtcttgaactcctaggctcgagtgattctctcctcagccttgcaaagtgttgggattacaggcgtgagccactgtgcttggcctcagttttacttccttgtatgtc

SEQ ID NO: 81884 - DNA, 1631 bp, Homo sapiens
gccaggggccagaggggcagtcggggctgagaggctctgttcctgtttcctcgagaccgtgtaatggcgttcttaatgagaaagccctcatcatgctggtgcctcgtcttggagctggggcctgggatgcccggcagatccagtgacatgactgtcttgggccacaggtactttcagtttgcactgaattaaaaattcttatcagacttttaaggttagttttccaaaaatgacttttacaaaataaaacacatgagccaggcgtggtagcgcgtacctacgttcccagccacttgggttggttaaggtgggaggatcgcttgagccagggaggttgaggctgcagtgagctatgattgtgcccctgcactccagtctgggcaacggagtaaacctgctccaaaacgaaacaagagatttttacacttccttaactgcacgatattcagatttcggccttagttatgccaaaaatggagaactacttaaatatattcgcaaaatcggttcattcgatgagacctgtacccgattttacacggctgagattgtgtctgctttagagtacttgcacggcaagggcatcattcacaggtaaccgcgggggtggctgggtgggtttgcaggacgtcagtttgatgatcagggccagtgaccgtttggctcacaggccacggctgatgcccagatggcccccgcccttgaggtcagccaggttggagtgctccctggatgggtgggactgagatgcctgcctgtgccacagcctgagtgccaaggcgaggccacacgtccacggagcgctgacgtggagaggctctcctgccaataccacatgcaatggttgcgtgtctttcctggcgagctaatgattcttttcaccatcttgactgatgctttttatctttttcagttgtagcttctgtgtgtacttctttctggtctcgtttttcatgactttctgataaagtcagctcagaagtgtgcatagctttcattttgtgcgttaaaaatgatagattttacttcgttaaaaaacgacttagaatgacatggagatgtgaggtggtgaatccctactgtgtccagccaacacttgttgcttgtgagctttaggcctgtagccctggttgtcagcctgtaaggatcatatacattcattcgttcattttgttttcagcaaaatttagagtacgtaataatgttgctgttttaagtatttcttctcaaatgtgaaaatctgcttttacagggaccttaaaccggaaaacattttgttaaatgaagatatgcacatccagatcacagattttggaacagcaaaagtcttatccccagagagcaaacaaggtgtgtgagttttatttctagcagagcctggctctgtgcttcagatggaaagcgacttctgaggagtgtttgcattgtgtcatcttcatcaacgactgaggtggggataccttggccgttctcaaacagatcttgaactttctctgggcaagaccctgccacgccagcaggtcttcctgggggggccccaggcagtgtgtgttggtgtagagtgggaggtcgctggttctcctcggcgcctgctctggttcatcctccctactcgtcttctggacagtgtg

SEQ ID NO: 81885 - DNA, 2070 bp, Homo sapiens
tgatgtggccacctgcagctttcatgtatgcagaggcctgggagcctcgaggcccttgcccccaccctgtgtgccactcagctgctcctgcgtggtgtttggttacggctggcaggtgccacggggctgcagtgctctccctgctgggcctgctgttgctgcagaggttttgctcgcgactggctggtggccgttctcccgtgggctctgtgctccattgctcccagggaggtagctgggctctgaaggagcagcacaggcttcagttgtctccagtctcaatgcctggggagcttctctgagtgtgggggtgtgtgtgcttgcacttgccgcatacctgtgcaggcccctgtgcctgggcctactgagagctggggctgcttgatacgtggcttctgttgccgtctgtgaagccaggctccatttgttggcagccgcctgttagatggcccatccttagctctgcacagctgtgtggtttgaaagccttggagtgggtccaggcagggagctcccaggccagacctcacacggggacagtgagtgagtcttggcaaacggtgtcaagcatggaaggagacttcagggctgtacctcctccctccctgcagggccgcaccccctccttcatggggaatgggcactgggcgtccccttcagccagggaggttggccatggtacctgcccttgggccaaggcaggagagcaggtgcttcgttggctcctgctctcctgaggtcctgtaagtgccggggcagtgtgaccattgggcagtgttggagacaagcaggctgggcaggcccacaccccgtggaggggtcggcgtggaggggccggcgtggaggggccggcagcgtcgggcgtttccaccatgcccgttggcgagcaccttgctccagcccagctgggtgcgaggctttagggctgtgaggcggggctgtggtgcagctgtaggagtgtgaacacatgggggacgctgcatgtgtggatggttgcgtggggcagcagccagggcctgcgtctggaggcacggaggacgtggaagggcatgccgcactcttatcctagccattgctcgtggcaccttttctttccccttgtccttggcctccacagagctcagatgtggggcctgcagccggggaggtggcttcccttgcccagggactctctggccttggcagtgccaggagcgtgttagtgcacaggctgtgtccgcttggcacgtttatgagtgagtttccgttgtcgacactagcttgtctttttcctagagtaacaggcagcgttatctacagtaagtttagtttatctttgctgggattaagaggaatgtcttttaaacaattgaatgtgtttagtcaaatcaaaatatttagcatctaccacagactcagactcctaagacacctggggcccaacaaggtcttgcacggaggccctgtctgccagcctgtgtgatggatctgccaccaggcctccttgggccccttctcttcccagcaggcatcccagcccccacctccggggggcagcactggcattcacggggcccgcagggtaagggcccaggtcccctcttcctggagaggaaatctgaggcttcgcccctctctggccctgattcccatgggaagaggagcccgaccaggcaggatccagtgaggcctcggttctgtggccaggtgtcccatggaggagaatcagggctgcccaccctgtcgccttgcgccttgctgtgtgcgagctcccaaggcctgacagcggcagtgcgggaggggctggggttttaggaccttagaggcaagtgaaggtgcggttctcactttcccttcttctctgcagtatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggtaaga

SEQ ID NO: 81886 - DNA, 1055 bp, Homo sapiens
tgcgtgtatggtgagtttttcagtggtcacatgctgtagaatggaatctgcgtgcttttggtcttttctaaggtcataggtttttggtatcaatatgttttgttttttaaatgagagagagtcttgctctgtcgcccaggctggagtgcagtggcgtgatctctgctcacacaacctccgcctcctgggttaaagtgattctcctgtctcagcctcctgagtagctgggattacaggcacatgccaccacgtccagctaatttttgtatttttagtagagaaggggtttcaccatgttggccagtctggtttcgaactcctgacctcgagtgatctgcccacctcggcttctcaaagtgctgggatttcaggtgtgagccaccgcgccagccaatgtatgcattttttgagattaatattcaatatttctactgagctcttactatctcttcatttatacctgctatagcctctgtaattttatcatccactgaatcattattttgaaatcctgaagttttccttgtgcctacatgagaatacggtaagttaagttcaggatcacacctgtaatcccagcactttggaggccaaggtgggtggatcacttgagccaggaattcgagagcagcctgggcaagaaactgaaaccctgtctctacaaaaaatacaaaaatcaaccaggcatggtgctgcacacctgtagtcctagctgcttggggaggttgaggtaggaggattacctgagccttggaagttgaagctgcagtgagcagagagcttgccactgccccccagcctgggtgacagagtgagaccctgtctcaaaattggaaaaaaaaaaaaaaaaaaggtaaaaggaatttttaaatttacatggaatagtttacacttaaaaggaacatttcaaaaatatgtgtgatgagctctttaaaatccaatgttgtttgtaacagcttttcagacaataaattaaagagtcactgaagctcttagaagctgcattgtagaggctggagaggccacacggtagctgagagacaaagcctccggct

SEQ ID NO: 81887 - DNA, 6077 bp, Homo sapiens
cccacactagtggctcagtcctgagggggcaggggacaccctgtgcttgtttttcagtttggtggtgactgggggtggtggtcatcagcctgtgtagttgcttactgcttgtgtgaataaccgtcacacccacgtgctttcaggactcggaatggctggtcgcaggcagctcaccaggttggggtgggggttttggtgggactccctggagaacactaaacggcttctgtcttcgcagcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttatttaaaagaaaagaagaaaaaaaacacccaaccacacaaagaacaaaaccagtaacaaacacaaaggaattcagggtcgctttgcttgctctctgtgctccgtggaggcctccgtgtgccctcgttgccgtggggacccagctccatgcacgtcaacccagtcccgcccagactagtggacagacctggtgtcaccagtttttcctagcatcagtccgaaccatgcgcccgccctgccccaactgtgtgctggtcctgctgtggccgaggggaccgggtgtgtttggctctttatgcccctcccgctgtggtcctggaactcttcaccagggagggagccctgcgggggccgcagctttgtggagggagccgccgtgcttctgtcacctgctccctttcttgcgtctccctgtgatgggcccttaggcctggctgggcccattacatatccctgtggtggctctggtggcagctttctgtggcccctgctgtgttggcaggcaggtttgcgtggtgaggagcgggaggggttggagtggtgcgggagcaggctgccgagtggagggtgccatcgagggctccggatcccttatcctacttagcagtgttggtctctggggctggaagccgagcgcatgctgggagcggtactgtcagaagtgagcccagttagtaccccgctggctcactgcacgagagagtcctgccccgagccctaggtggggccaggaggtgccttggagaagccagccagagcagagagggctgctgacttccgtgtggagcagagaggcctgagggcctcctaaaaggtttaaatgtccacgcctctccagttgctgaagtagggtctgagagaaccctggcatcagcagacccagggtgcttctgtctcctgcagaccacgccagggagtgcagacaccaccgtcacacacgccccttttgtgttttggttcaagtttctcagagcccctcagagcttctacatctgtgcatcagaaatctcacagccttctcatgctgccggctcatctgggcccatagagtgggctttgccagttgctgttgcacaggaggcgagaacagcacacttcaaccccagcttgctggtcggctttcctctagagagagccggttttggggccatttccctttgatgctttggtggccttgccccgctctgcagcacagacaggccagatgcatttgtcctttgcctagctactccccaggtagagagtgctcctggtggcctggcaggtctgggcccttctctccctgcccaggttgtccctggagggcagccctcactccctttgggggagaggcagacattgctgcccacagacctgcctctgactcaactgtgtccaccctccctggtccctacccccaagtcacaggtgactcagcagtgaccctgtgtgccaggccagatccaaactgagagggaaggtgtcgtttttacactgctaatgacgagagtggctctttttagctaggcgagtacagacggggcctgggagggggcagagatgttccccaggccctgcctgtggttcctgcctgggccttggctgctgctgtgtgagagctgcatgtgagcctgtgaccgtgagctggggtgagctgggccgcacctaccctggggccccagggagcaggacgctccggggcccagcacgttgccctgggcctgtggccggagtcggagtcctctctcctcctcctggcttttggaaaggcttggctgtgttggggagtctctcttagccctttcaggaatttctgttcaggcttcctcctcctcatcagctattttacccatctcagaacgtcctgtgtctccatgtaggagagtggctctctcagatctctcagggcgtctggttatagggaaacaagtggagcagggacgtggctttaattggagcactcggctgggctgcttggggagactcttccgtgcgttcttcctctggatagaaccaccacctcctgggcgtcactgacaagctccatcttaacctccaaagccacagaactaggggctcagagccagagctggcagccgccagccaaaatgatgccattgcctgagctgacagccaagcccttctgtgggtcacctttctcctcacccagccccttgctcttcccttttgaaaggcccgtgtgttttctttccttaccctgtgcttgctcatgtctactccggttttctctaccacatccttagagccatcacctggcacgcaggcgccttacattctacggtagaacgtggggtactgtgtgtgcacatagacacacttacgtggaattacagttgtgggtttatccaagatgaggaagatttcacctgctgtttaatagacttggggccatgtgcctccccacacatgggcaaggacaggtggaatgtcgggaccacactgtgcggcttctcggcacaaagcggagggaggctgtggtcgctgccggcctaggtgtcccaggtgccccgcctttctctgggacacagttgggggctggcttctgagggattcctttctcccctctttgtgtggccccagccagggcggtgggcagtcctggtgtagagcacaagcctctccaccctagagaaatgcctctgtaccacggctaccatgtggaaccttaacttgcagaaggcttgttaacaattgttttgagagagatggctggtcatgccacagctgctggggactccgcctactccagccctcttgggacacactgtgggatttgtggcccttccccagaggaattgtggagactgtcccatggaacaaaccctcaggcaccagcacagggctctgggtgactcagtaaaactaacgtttgtctctgacaagatcagctgtaggctcaccggccagagaagaccactgtgagcattttgccgtatatcctgccctgccatttgttcactttttaaactaaaataggaacatccgacacacaccgtttgcatcgtcttctcccttgatattttaagcattttcccatgtcatgagtttctcagaaacatgtttttaacaattgtactatttagtcattgtccatttactataatttatctgaccatttccctactgtaaaatacttaagacggtttctgatttttccactatttaaataatgctgtgatgaatatctttaaaatcttctgatttcttacttttttcccccttagatgcctggaagtggtattttgaggtgaaagagtttgttcattttgaagatatttctgtctctctctcgacctgatgtgtagacgctcacttccagtagcagaaccaccttagttgtgtcttacagattctgaacaaatcggtttctgataagccatgtgttccaaagaatgtctgaataagaccgctctttatttaaatgctaagaggatgtcactactgcaatccatctgtggccgattttttccaagagccaatttccttgttttggttgcaagaacctggctctgcctgcatgtcagctctctgccctccctgctgccgtggctttcaagcgcttggcagaatcttgtacttcgtgtccacaatggtactgaatttgcatctgcacagtcagcagagataacaagtgttgaactgaccttgccacatgcttagtgagtgatttgtaattaagtttatagactcagaaggtatattaggacatttggaatcagtagcagagcaaagcctctttgaaaaaaaccacgtagctgattgggttttacaagagtgcatttgtctcccccttccacccgtggggccccaccttcaggtcttagtggttcacaagagcccagcagccaggctggctttttcattgtagggcgtggttgtcccagctggtgtagatttcaggccgccccccccaactccctgcccacagtgttgcagattgcctggctggcagcaagtccagaccacccaaatttggttggattcttcatttctccactgtagttggggtccattgattgtgcaggggaacgtgcaggaggtttttctaggcaccgtgttcagtgctgcttcactctaccagagattatggccaaattgcacggaatttggtttcttgccctctgaagcctgagggcccccccttgcctggctggttgacagacccggggtggtcactgctgagacttcagagatcgcagctgctgtgagaatacggtgaaggtactttgttctggaagatgttgtcatacacttttccccagttattttcaaacttgacatgagcctatgttgactcactgggtgggggtcccttcttacgcagcacacgtggcaagtgcctgaatcggggctggaggcacttcagagcctctgaggggccaccacttctggcccaaaattgcagggttgtagatgaggctgcctgtggagaactggtgtgaggaggaagctgtttccaacaaagagcactttcatctgttgagatggctgtggtgagcaactgaacgagcctacgtgtgtacctgaattttccccgtaactcatttcttccatatgaagaaacaccaaactatgtacagagaactttttacaaaaggcagaccttttttaagctgtgtaacccacatagcctaaccacctggcagaatgactacgaataggggtcattgtgctggtaaaagcctctattacgactgtaagtaagttggatgttggcaaaattaaattgttacagtatttagagctgctgtagctgttccttcacaacataaaataggataaatgactagtacgtctttcaggtgggtggcaagcagaacatgcgtaatattctctacctggtctgtagctgtaactgtgatgtacagacaaagcaaaaattaaaagaacttatgaaaacaaatgcaatgatactaggatatacacttttgtatttttattcttatataaggttatttgctggctattgttggcctctagttcagtctgtgttatttaaattctaatatatgaattatttgaattgaattcatgttcggggccacgttgttgtatgtattgatgtacagccttgaatgtgaataattattgtaaactatattttacaactttttttctggctttattatataaattttctattgggtcagtgatttaatcatataatttaatgaatctgtttatcctttttttttttccaaatacttgtgctttaggtgtagttaccagatgatgaattttcctcgtatggtcagtagtcttgtaataaaaagcatgtagagtgtagaggtttgctggcgtggctcttcctttgaccccgccacggagtgggggcgcggttgggggcgggtgtctgccattgcccgctagcgttggcgccccaagctcggtttcactccctccggaagtgggaccagccggctgcttttcccggatggaacttccgcctgccatgtgaccggcgggtgttctacaagggctgaccagtgggcgggacagaacgcaaagggcgatattaaaagccggactcttccggtgaagcggaggtgtggtggggcttgctgggatcatggcggggaatcactgc

SEQ ID NO: 81888 - DNA, 1076 bp, Homo sapiens
aaagtgctgggattacaggcgtgagccaccaggccccgcccttattatataaattttctattgggtcaatgatttaatcatataatttaatgaatctgttctttttttccccccaaatatttgtgctttaggtgtagttaccagatgatgaattttcctcctatgctccgtagtcttgtaataaaaagcatgtacagtgtagacgtttgctggcatggctcttcctttgaccagttcatgaactggagtcagggtgggggtgaaggctagggtcgaggtctgggtcaggcgctcgtgcaccgctcgtgggaggtcgaggctgatgtccgctgctccccatcagcgttagtgcccagatcaccccgtgctccgctcccgccggaagcgggcccagcctcctgcttttcgggaccggaacttccgcctaccgcgtgacgccggggcgggcgctctaccagggcggacctgtgggcgggacagaactcagaggacgctattaaaagccggacgcttccggtggaagggagctgttgcggggcttgctgggatcatggcggagaatcactgcgagctcctgtcgccggcccggggcggcatcggggcggggctggggggcggcctgtgccgccgctgcagcgctgggctcggcgccctggcccagcgccctggcagcgtgtccaagtgggtccgactcaacgtcggcggcacctacttcctcaccactcggcagaccctgtgccgggacccgaaatccttcctgtaccgcttatgccaggccgatcccgacctggactcagacaaggtgagggcctcacgggccagcccggagggtcctggccttcccggcctgcggctcctgcacacgccctgcttcgtgcggaggagacttcagcgggagcgggcgactctcctcgggcttcgagccccgcgctcccttgtcgccagctcctccccagcttgccccgatcccctaccctgggaggggagggtgaggatggcgccctggcgtccactgcctttgaggatcctgagtcgattcaccttgggggtgtctcttcctcgccctctttgctctt

SEQ ID NO: 81889 - DNA, 1041 bp, Homo sapiens
tgtcgacctctggccacactcagccctgtcagcctcgggtgatgcaccggaggtccctgaaggcagcatgtatggccaggagtggctcgccctgccagtccccctgctgccacccagagctctggctgaccctagcagcacaggcccccgctgagtgggtctccacctctggggactggaccctgcactgtggggagggcagggcttcctgggcagcccccgagttttcttgcaagaaacctgacacccctgctcctgagagggctccagttcctgccgagcagagcaggactctctgcagcgacctcggcttggcaagaccccccgtggttcacctgaagcatgtttcttccccgagaagccgcaggacctcttgtgaggggccaggtcgtgagtccacacacgtctgcttctcactaagctttgagtcatgtgtggggcagggacctcccaaattccagtttctatgctgggtgaggccgagaagcaatggaagggaagggtggtggggaggcagcaggcctggcgaccagggcacaggggccccaccctgctctccgaatctggctgccttggacaagcctccttggtctctggcctcagtttccccattagtaattggtgacatcaaagtcctcttgtgggccaaagatatgccacagctgcataaaacaaaacagaagagagagtagaggtgaaggttttgtgtgcgaaattgaaacagagtcacttgaaatggataatttcagagtaaaaactaagtatttctaattaggttgattgcagatgttggtgcacaggaaattctatgccttcgcgtctagatttctgtggggcaatttgacagagtttatctcctggattggctcagggcactgcaccctcttgatttcgttcccctctggtggcacgtgtctccgagcaccgggaatgactgagagccgcagggccgaccctctttgcagagctctgggagctgcgggagggttgggcagcagcagggttatgttgggttcagaatctggcgtgagagcctggcag

SEQ ID NO: 81890 - DNA, 1064 bp, Homo sapiens
gggggcttgggcaggcgccgctgatggccttacgggcagcacaggggccctgcctaggttggcccagacgctgttctaaacctccccgaggtgaccttgctgcctttgtctccatgagcctcggagtatatcctgaattttgtatgattttgtgtttcccattttcccatgttccatatttttttgttgtttctgcatcagggtggaggctgatccacatccccaacaccagcagtgagctgccgaggccctcgcgcctgggctgggcactgtctgggcctgggctggcaccacgagtagcccccgcacacattaggccgatctggaacatgtgggctcacccgagctgggagcaccaagaccctgcctacatgcttggaagcgagtcaggccacagcgagacccgaaccctggtgggatttgggggtcctggtttaagaccctggcacttcctatggatgtggaaatctctcattgaaagcttcaaagagagcagtggtgagagcagcacctccacacgccactgcctccccgccctggtgcggatgtccctgaccttccgctctgcccagacagggcctgtttctcgaggaaacccaccagttagaaggaacccatgggaagaaacggccggagagctgtgaggccagccacagaagagccagttttggaatttcccaccaagggttcagcctactgctcgcccttcagcctctggtgcccggcggctcagctgggttctagggccacgcagggctctgcagtgtcactccgggagagggctgtgggggcagctgcaggcccggcgcgccgagtccacgcagcctgggtaggtcctgcatgggcccagaggtcgtggggctcagagaattgaaccacgtgggaggagtgtactgtggcgggggccccataggaagcccactgtcctggaggcactggggcggcgggggtgtggagcggctggcaggttcttggtagacgcagctggggttctctgctcctctgccctgcagccttggctcccagcgaggttggcaacaagcatctggactcctggaagtctt

SEQ ID NO: 81891 - DNA, 1038 bp, Homo sapiens
aagcatcagccacaaaagctgcctcctaaagggggtgtttaatggaaaagccagccccgcccagtggtaggagtggccaagacacggcagcggcctacccctgcctgcccgtcttgaggccgagcccagtgccagcacgctcagtgccctgccggctccttggacctgtctgtgttcctctgtcctgctgtgcagtttccgccgatggccgtccccaccctgccctccttccctcctgccttcatccttccagttgcagggctggggttgcctcgtgtgtctgggggcgcccagcacgcttccttctcctcttgcaccggcccagggcctgagaagcacatggtgggttgtcttggcctagaggtcacggctcagtgcccaggtcctgccacaggttgggtgccctggcactcatggcggccccgagctacacgagctggtctcccccaccttttgctcgtaaagaaactgaggcttggggtggcctggctgtgagcctgcagtctgaccactgaggccaggcctggaggcctccatggctgacaaaggggttctctggggttgtcctgggcagaggcgagcctccgccctatctgatctttcctgacctcctgccagcggtctgtcgaggtagcagtgagccgtgaataattcctgagctgagcggtgtgcggacgtcacgcggccagcattctctctgtatgggggtggggcagggaggaaccctggactcgggtggcagcactggccgccttgccagacttgggcccctttgtgggaaatggtgtccattttttagcagttgcgcaggaccgcccagcgtcctcttcccgggagctggccctgtggccccggcccttgcttgagagctgtggagtctggagggctggggaaaggcagggccaagcccaggaggcagggcctgtggggtgggcagctctggctggagtgttccgggggagggtggggaaggaggatagggtcaggtctgtgtggagctggggtcaccctaaggagtaggggggccgccgaggctcc

SEQ ID NO: 81892 - DNA, 1046 bp, Homo sapiens
cgcaggcctgagccccacacagcaccccacccagtggcgtggccatgagcaggttcccagcaggaagcgtcggcctccaggcttggagggaaaatgccagatccaacccccagcataccatggcctcggcgtagacatacgctgagctgcatgtaagcagcggctccatacctggcgggtcactggaggtcactcaaggttacctggggtgacctgagctggaggtgttcagtccacacatcggccctctcaccacggcccctccgcccattatcccaggagccctgctgggctgacacgtctgcaggaagcctgttaggtcggggcctgagcagctcccgctgggccgagccatgggccctcattgcaggggcaggggcaagggcaggggtgggtgtaaagcgtggattctttggtttagtttggtctggtaaagacaatttatttttccttattccaggagtgttggaggaagcagaattttacaatatcacctcattaataaaacttgtaaaggacaaaattagagaacgagacagcaaaacatcgcaggtgagacaaatgactgaggctggaagcttgtatggctggtgtgaaggaagggctcccctttactcccccgaccggctgcctcccaaataagtcctgcggtctggggctctcctaccctgagacccttgtcctctgtcactgccccagtgcctgccagctccgtctacccggctctccccagggtcccttgaaggatccattcatcctgcccggcccagactctgggagcccccaaaggatggctctgaggaagttgggcacgggagacgtgtgtagggaaggagggccccatgagggccggtcggggagaccctgaggtggatggcatctggtagggagcagagggtgccaagggcctgcagccagcatggctggagggagacagcagatgggtcgtgtgggtctgcgcaggcgccagaaggaccttggttttattgggaagaggggcggctcgccacagacacacctctcacagctggcacggcccttctgca

SEQ ID NO: 81893 - DNA, 1017 bp, Homo sapiens
caagagcctttttctggtagctgggagcgagcttcgtctggcactggctctcagggccctgcttgccagagcctttcccgaccgatgaattcagggctgcacggttgctgcgtgcggagcagacgtggacgctctcgtgtcgtcatgtcgagccacaggtgctcttgggatttcaggaacatgactcattttattttggaacttagaaatagaaatatttttggaggcgaacgaggaagcagaaaacagcagctgttcgggccgcgtgttttgcttttgtggatgtgctcaggattgctttgggcctcgtgccctgtgctgagaactgcagagtggacctcagcctccctgggtcacctgggctggggccacaggcagcagtgggacatgggtggcccgcccttacctgtgcccattgtccttgcaggtgcctgtgaagcatgtgtaccgtgtgctgcagtgccaggaggaggagctcacgcagatggtgtccaccatgtccgacggctggaagttcgagcaggtgaggggccctggccagcctggtggcagccatgctgcagctgaacttgtgctcacaatggctcagggctcagtgctcctggaaatgcagactttgctgctggcgtcttcctgcagttctgggggtgctcacggcagcgacctgtgccctgtttccactggaggagccttgggagttcgggtggggtgggcagaggtgtctcaggctctgccccgcaccttcccctcctccctggcctgcctcttcttcccagcgctgcgctttcttcgcatcatctggcacctctgtgtgagggaggggactggcgtccccagagcctcctggccagcccactatccagcgcaatccccgtcccccacagctcactccatcggagcatatggaggccctgacgcctttcccaggctgcctccccttcccgcccatgctggaaggtgctgccaggccctcgttgccttctctctggttttggcaagctgcggcgggtggggtct

SEQ ID NO: 81894 - DNA, 1057 bp, Homo sapiens
gctgtccccatgtggcacctgtgctcttctgccaccgtcttgtgacttctggctgggagggaacaatgtctcctgcccgtggtgggcacctgcctcccggggcagcttcaggtcttcgaccttagcacttctgggtggattccaaacccattgcaaagaacgggtgtcctcccccttccttgattacgacctgcttggcacgcttcatcccttggggaccccttctcccagttcatgtagggaagccgctgggctgaccagctgtcccggctgtggggtgggaccctgcggggtgctgggaggtggccagaccggacccagggtccccagtggtcagcaggggattgcaagcagggcttggaagtggctgtgaggacacaggggctccggggggcatggccgtgagtgctcccaggggtacccttagctgcttgggcccatgccggcacccctgtggccgcctcactgggctgggtccactgctgcccactgggtcagccgccagctatacaggagcagcaggtagctgcgggctgctctcccggccgttggtccaactgcgcaggtcttagagaggccaaagtgtgagcctcgtccagctgctttttggcttggtcatctgctgctgtcatgcttattgtgatttgcgtattgccttttaattttccctttaaaagcacagaagtgcctggtggcccagggtagccagccatgggccagatgcctggccagagagacaggttggccctggacctgcattggcctggcctgcctggtgacccggagggaggcaggttggagtggcctaagggtgtggccagcaggctgcagcagacccgccctggccgaactcctggacagcacagctcctccagcggctttcggtccagtcagctggtcccaggctcttccctccaggttttcagagccgccctccactctcctcccgctgcccccctccctccgccccagctcagggacccgtctgtgctccgtccccctggggcagcagccccttttggcccagctggaagcgccaaggaaagctcagggtcct

SEQ ID NO: 81895 - DNA, 1087 bp, Homo sapiens
cctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctgggatgtttgggacttcactcgacctgcacgggctctgcccgacatgccgtgggagctgctgggattcctttagaaaccgctgcccgcatgctttgaaaacagacctttctcagctggctgtggggacctgtcagagtctggggactcggcgtgcagggcgggctccaagcgctttgcttccggaactccggcttcccaaggggtactgtgcagactgaccaccggcctcccgcctgcaggtcagaggctctgacactgtctggtttccaatgcttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgac

SEQ ID NO: 81896 - DNA, 19301 bp, Homo sapiens
ccaacatggggagacaaaatggccgccacgccccgagccgaaattacatccgggctccgcgacacgcccgaaccacaactcccagaatgctctgcatcgacagcgggagacgagacgcgctcgggcgtcgctttgctgccgctaggccctgtgctcctccccgcagcggaaggcctacgaatacgcggtgtcttacgtcgcttcctccgttcttcgttgcactggccaacgggacgcttagtctttcggcaacggggtgaaaccttccttgtgcctgaaaaaacggtacttcgcggtgtggcttcggcgcctgcgcaaaaggccgcggggcgcactccagttcccggcaggccccgcgacgcgcgtttgcgtgctgacgcacgcagttagtcgtgctgacgtgcagcgcggcccaggcggggtgcgagtggcgcagttggagcccgttgcggcccctgaggaagcgaggaggcgtcggcgtcggctgaggcgggcggaccggcgaggcgaggcggcggccccaggcccgagggactcgggagctcgagcagcggcggcggcaagacctctccccctcggaggcggcgggcggaggcggcgggtgagagggtgagggagccagcgagccgggtgggggaggggcggcggccccggcgcgaggccaaagcgcgcggagaactgcccaggccgccgagctcctccgcgcgcacgcgcgctcgacgcccttcgctggcgcggacgccctcgcctcccttcccccttcccgccgttcctgtcgcgcgcgggcttcacccccccccgcccctcccccatgacaacggcgttcgcagccgcctgtactcgggttcgcgagcgcccttggtgaggggggagggcgcgcgcctcggcttcactcctccccccaacatgtgccgccgaggtggccttcctgcagctgccgttttcggcccttaagtggcggggaaggggcggcggcggggggcttgctcctggacccttgcccccggttccagatctcctttcctcgggcttctcttcggcgttgggctgcccgtgtcgggggcctcccagactgcgggacgccgcgcagccccctcccccattccgcaaggccgaaaataggcccccggcgctgcggggagggccttgaacttcgtgggccggatttaaatggtttaggattcccggctatcagcctttgagttgttagtggcggggagaaaccccaaatcttaaaaactgtgaagaaagtgaacgtgttcagtttacatttgtaaggtagaccgtgcgttccctttttacactttttcaacgtctcccgagaattcgtgttcaaactaaggaggcttttggagaccttcgttgggaagaaaacgccagactcatatataagttttctggttggtttcaggcgttctttggcacacagctcttctgaagcttggtttccactcggcttcagttaggacgaatctggatcagaatttcagagtgttgtgttgtctttcatcctaagtgcgtgggcttagggctcttctaaagctactattttagctttctgggttctttgtgtccactcagccgctctggagcgccccggtgctgagctggctgtgcttgctgatgtccatttttttcgacaacccttgtctcccctttttctccccttttggtaccgttttcttttttgcatattttactgttgaattcaaatatatctttctacttcattgttagcttaccactcggataatttcccaacagaaaagggtgtttttgtcttcctttgtactttttactttctgcttttaacttgggtaacttttgcatatccactgtctatggcccccactttaagagttttgtaatatcgtttggtttggtgatttgtgtgtggtgttgatcttcctactttctgtgtcttaacacaccccttagatgccgtggggtcgtcgtctttttttgtggggtggactaggtggctcattccctaaaagttctccgaaacattgtgacctaatatcctttgcttagcacctactggtttttcttttttttttttttccgagacggagtctagctctgttggcaggccggagtgcagtggcgcgatctcggctcactgcaaccttccgcctcccgggttcaagcgattctcctgcttcagcctctggagttgctgagattacaggcaatcgccgccgcccagctaatttttgtatttttggtagagatggagtttcaccgtgttggccaggctggtgtcaatctcctgatctggtgatccgcccacctcggcctcccaaagtgcaggtgttacaggcgtgagccaccgtacccggcctggttttcctttcttaaggagtggggggatttttgtgtgaggtggtatggaagtgtgggtgaatggttaagctgaagaattaagtgcaggtcaaaaacatgctgcaggggaagcagaaattaagtggggtaggggagaggcgaagaaggacctagttttaaaccgtgaggaggattggtactagaagatgaaaatgaggattggggtgtagagaaattgattttttgagccatacagtttttcattttttcctggatttctgcttgccttatccaggtttagcctcttctgtcaccttctgctttcaatattgggtctgctactgggcttgggtagggacccatccttaggcgcatgcgctagtatatttttccaaacatttgtatgatgcttcttcattctggaattttctaaatgcatccttcccttctatccagttcttttacatctttgattactctctccgctttacgtattccttagggttttttcttagtagtattttctcatatatgcatgttctaggaaactatcttggagaggatgagggtgagaaagagagtatatgtaataggagaaaggaatagagtatgtgtagccaaggaatctaaccaggaaagctgggacttgagaatttttcagaatcacgttagggttgggacaagttgaaaggctagaacctgggaggaggcatggggttaacacaggagagaaggaagaggcagggctgagagagaaaaactaggaagtgctatccaggggattggtggggaaagccaacggttggacattaatgaaagtggggtgtagagagggtttctacatagatttagggcaaggtatatggagaaggtatgggaacggttggaacagaggaggctggtttgatgtgtttaaatagagcagagttgaaaacaggtaatatttgacagctggcaagacagggaggaactgcaaattgttgtaaatcctattgagaggaaggaaattgaaggaataaaatatcaggatagttgataggatctttaaatatttggaatcaaggaaatggcccttacctgggaggtgaagtatatgacgattatccaaggttcatgtgtgtttctgatgtgcatgctggcctttagttggggtgtgaggctgcacattctgaaccaactagtctgctgttcagatacctaggggctgtgtagtttatttcatattcgtatagggtggtctgaaatccttaggtaagtttttgggagagtctttggacatggactagaggccgttgggtgccacagatctgtgtctggtgtttgttgtgaccaggaggctttggttggttaccagaggttaggaattagagtagttggtaaacacaccacttgtgcattttggggccaaaggagaacaaaaagggacagtgtggagagattttagaggaacaagatccttgtttgcctagggtggaaaaagaagaaaatttaggtgtagggagggattatttagaattctgtgcaagggcattgagagaaaggctgtaagaactgggctgtgatttggtagaaaggaaatttggaagggcaaagaagtggttttcttgggagaccaggaggatggtggagcattatacagcgaagacttagtgtgaagatcaatgttgaattagggatgaaggagagcagggacttgggtgtggggcggtaagtggttagtttggggccaggggcctgacccgtgtctccccgctccccctcaggagcggtggtgccccccccgggcacggggccatgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtgagggagagctgggggagagtcaagcactgaatgagtgcagagctgggggtgttaggtgggatgtatagggagcttagggtggttgaaagaggcctggcaaagagttgtggtaggggaggaggcagatgagctctagagaagtgaaaacagttaagggacagtgcagagtgggaaatgagaaggctgtgtgtctggggcatagatgggagcctgaggtactaaatggaggcacgtgggagaagggaggggccattgaggaacaaaaatgtgttttaaggaagagatgggaaagcagagaccaggtagaggagctaggtaagctgataggtgttgtcattggtagaaaagaagaagataaatggatgtaaggattgaggccttggaaagtagcataggcaggaaaagaggaattagaagaatacgtgaagaagtgggaatcatgggctgggaagggaaattttggaaaaggagcccattaaggcagaaaactcttttagagcagtggttttaaacttcagcaatggtgatccttttatacagtatcccttactttggaatcccaggaagtaaaaggcacattcttgttgaagttggggaggagcacttggaaccctgcttgcttaacttttttcttttggtccctgaggtgtagcatatttaaaatccactgttctagagggagtagtaagtagagggaagaaagatgatgggaaaagatcagacagaagggacttttgggtgagcgaaaagttctgtgtgcgcatggagagggaggggccccttttgggaatgagggaaatggaaacctgggactggggaaagtgtcctgtcgagcttaaccctgaagggatttgttcttcaggtacgaggaacagcaaattcaggaaaaagtggcgacctttcgactcatgttgctggagaaggatgtgaaccctgggggcaaggaggagaccccagggcagaggccagcgtgagtgttgcgctctccctcgatgactctggactctactctggctgctggctgctgctgctgtccttttccttacgtgggacttcctccctgctttcgtctgcctttcccatgccttatttggctcctgcttatacttgtgttctgaatatggctctgtcctttatatttccttcagacttttgcccttcttttctctagggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacaggtatacaaggccaagaaaccactgtcagcttcttttcttgattgtaagctccatgctctatttttgtctttttgcgggctggtttcttcccaaactcttcagattttgttcttctgaagttgaggtgtccaaaaaaatgtgtccaagggttagtcacagtgggtcacgcgcgtaatcccagcattttgggaagctcaggcaggagatcacttgaggccaggagtttgagaccagcctgggcgatgtagtgagaccccatctctacaaaaagaaaaaaagctggttggtggcacatgcctgtagtccaggctgcttggagaggtggaggcaggagggtcttttgagcccacaagttggaggttacggtgtgagctgtgttgctgccactgcaccccacctgaggcaacagagcgagactcttatttttttatttttattactatttttttagactctgtcttttaaagaaaagaaaggaatgtttgttctaccacccatctctgctgcttttcatttttccctagccttgttcgggagtctagcagttctcgctcaccaaccccaaagcagaagaagaagaaaaagaagaaagatagaggacggtaagttagttggaaagtgactctgatagccagaggaccaatcctgtggtgtacctttctctctggaagtggacagttctggcttccacaaagcaggagatagttgtcagggaggagggagttaccattgaggcctcaactagaagaaatacctgagtttctcagtggggaagtgttgagtttgcagttctgctaattaagattggccagcagcattttggattctggaattttctttttcattttgaggtttgttgacttaaggagttacttgtgcttgttggagaaagaagaaataagtcctgggcttaggtctggggcattagtgctattaggacattcaagtgttttagaaacctttttaggagagagattgtaagtgggagggccaggaaagaagccaagcaggatgagcttgcttttgaatccatctttagcaggtcagagagcagctctcctcgacgggagagaaagaaaagctcaaagaagaagaagcacaggtatgaggtgggaatacttgaatgactggagaaggtttgctgaattcaggcagaggtgtttcttatgttttttcttctcttttttccaacaggtcagaatctgagtccaagaaacgtaagcataggtaagagctctttaactcatagggggcgcagtggcatgtggagtggtgatttttttttcttggagtgaagctcaattccttgatcttccttgtgtcaacactccctctttccatttcacttttggttttatttccttttttaaagaagttacttttaacaacctttccttatttcccaggtctcccactccaaagagcaaacgtaaatctaaggacaaaaagcgaaagcggtgagtgaatttgtggggaatttgcttaggaagtaagtgaacgccaccttagtgggagggagttgaatgagttatgtccctgactggtaaagggttgagggatacgtgaggagaatccagggcaggtacagcagtaccctgagctgtggtggtggtcttccttcaggtctcgaagtacaacaccagcccccaagagccgccgggcccaccgttcaacttctgctgactctgcttcctcctccgatacttcccgcagtcggtaaggggtagtccaggaggaagggagggagagggaatgatgggttaattaatttaatatttattgagcgcccacggtgtgctaggcgctgcacagaccattcggaagacacggtccctgccctctaggagctgacaggctaaagcaacaggatggacagacatatacatttccccttctctttttttttttgtttttgtttatttgttatttttgtttcgttctgatgtatatggactgccagaatagggggggtggtggtttgttcgtggtgtctgggggaggaaggaatccttaccctggcttccttaatcggggaaggcttcctgaaggaggtgggctcagaggtgagttgtgaatgaagcgggtagggagtgggctgggtggatggtttggggatgtttgggggaggtgagtaaaggggtagagggagaacgctctttgggattgtgttgggaaaagaagaaccaaagtggactgtacttgcatttcagtgaatgatttgagttgtgcgactaaaggctttttggaagagggttgtccagttaggaaaggtggatgggagttggggagggggttttctgttctccctttgagctgatttccttcctctcccacgtcctcaattaactcctgcaggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggaggtatgttcctgagttggtgatgttcattggattgcaaatgtatagatttaggatagacatgtgatgtgaaagggagaggtaataacttattaaaataaataaattcagttttttttcctgcatttctctcctagttctcttactgcatctgcagaacttttagtgttgttactagactgaattgtgaaccctttagaatcaaatctcactggatgttaggttttatattgtgtcttgtttatacatagatagaactggaacaaacgttgtatcttatctgtgtactccgtatgatgcctctagtttcttctcttttttcattaaatgctggtcatgtctcaccaaaactttttaatccattgcgttgccaccaatagtttgaatgaaacactgaaatagtcttcagtagtcttctgttccaattttaagcattaatcatttcctcttgctttagtgattacagtctgaattcttggcctctatcatcaattttccatgtcatccagggttacctttccaaattacaagttggttgacctcagaaacttaactacttccttattgcttttgaattatatttaaggcttttaatagtctggtctttttctcatttcctgtactctacccatcctgggctgcttttttactcttcacacaaatcatgttctcacatctttattcatgctgtttcttttcgtttaatagagttattcttcaaaggtgaagttgccattcgctttaggaaactgcttatttttccatttaaagatagtttttttccattcttataacattttgtagtggtatttgttaaatgtagtagtgcattagttatttgcattttgtgtttcttttagttttaagattctggctatccatatattcatatgttttcaccactgtgctttatatgattccttgttattgaatgaaagtgatcgcttgtggtcagagggtgtgtaaaagaaaagttatcattggaaagggtgttgggatcttaggggtgatgtgaagttttggcgtttatgaatccctatccctgctctctcttccactcttagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagaggtgagggagcttgacttttagaaatcttcagtgggggaggtattggggatgggttggggagtggggagggagaaaccatgtcacaggtgcttggctcttggaggaggtatggggaccttgaccctcaagctgggggtagaagagaatgctggggcagggggcggagggaggaggaatgggacagataaaagtctccgaaggttcattctctagaggataatgataagttttccgtctctacagaggacagaactagaggaaatggacttaattttacagcaggagggatggcagttagacctcaagaggaactccctgggctggaaggatcttcagaggtcatcccatccctctccctgcctccaggcaggacggccccttccccagccaacctgcactcacaggggcctccccaagctgcggctctccgaggaaggagactacccagcttcagcttccacacctgagcccagaggccttattcctccatcagggacattcttgaggtttaaccttgatcccttatgctgcgggccccagcctgttgcttctgttagcagaggttgggtcagctcgcaccactgctctccagagaattgctggctcacgtggctcggagagctcccagcgcctttctcaggcacccctccccccactgccgttcctccaggccaaggaaggtagggttggggctggggcagcttgtctccttgtgacactcctctcctcccacagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggaggtgagtgctgtcttgcctgagttgaaaggtgggtgggggagtgacttgtccagagaaggggccctggggtgtgagctccccgctgggtgtctcacgtggccttgggcatctggttgtgggggaggaggcacttgctctcctctccccatgctcgttgcaccctgttctggcgaagggctgcgccatccacagcggcgctcaggccaggaccagggggtccttggtttcttcctctccctccctcaacacatagcctgttcccagggttctagctttgtctccctgttgctactgccagggctctggtctggccaccatcatcttctcccgactctgtccacagcctcctccctgtctccccgtctccacgccattctcttccacatgtagccagagggacctttctaaaacgcacatctggctacttccctccactccacaaatccttcgggacgccctgtggcctgcaggacaaagccccacctctgcgggagtggcgtgtgaggctcttcaccaacgggccttgcccgccctgtgttctcctcctgcccgcccccacacatgccctgtgctccagccacacccagcgccttgcagtctaaggagagcccatgcctttggacatgctgttccttctgcctggaatttccttgtccgcctggtgaactcctcgttctgcaagactccgctcaaaacagcaccttcgagaagactgccctgccccttccctgccttgccccatgtccccctcccttgggtccccagagccacgcacatccagccctgcttcccacacacggggccgtgcgtgcctttcttcaccactgagctccttcaagggcagggactgtctttatctttgcatcccccgctgcaccctgtgcctgcccactgggcactcggtggatggtgtgcgggcggatgggtgagtgagcggacaaaggtgggtctgaggctggccctgtgtggtgtgaggtttggtggtcaggacctgggcgggtggtcctgagtgctggcccgtgtgcttgaaagggtgtggtgctattgggtcctactgtgttccccaggtcccgcagcccccggaagccaatagactccctcagggactctcggtccctcagctactcgcctgtggagcgtcgccgtccctcgccccagccctcaccacgggaccagcagaggtaaggccaactgcaggtgtcagcacccagcctgtctggccgccactgctttctacaaagaagaaagctttgcggttgtggctatgtggtgcctgaggtggtgccaccctgtggcctgatgtctgtcctgtgttgcagcagcagcagtgagcggggttcccggagaggccagcgtggggacagccgctcccccagccacaagcgcaggagggagacacctagccctcggcccatgagacaccgctcctccaggtgcgtgtcctggaaggctgatgcccccttccgggagccagttgtggtggtgggtggcggccccattttgggagtggcccagaaactggccttgagggctggggtgggaactccctgttgacccatatcttctcttgcaggtctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttctttgttcctgtgaaatgttaatctccgtgagttcttcctggttcatgtgttctggggggtttggggtgggagggaatgcagatgggagttgggggaggggaggatacagttcaggataccccagcctggagtcagggccagggaggcatggccccacttgtatccagaagttcccaggggtgattgtgatggtggttgggactggaggttgtataaggtgttcttggaaggaaggggcaggagttggaattagttggtccctactgtcccccatgaggttgtgaacccctccccccaacttttcatgtttcttaaaggcattttggttttttaaaatctgtacagcaagagcaactttttctgtcaaataaaaatgagaaatgcaggaactgggtctgtagactgtttattaaaggtgtgttaagggggcagccacttccctccgtgattacagcccccagcgtgggtggacctgtgtgggtccgtcttggggttccctcgttgaacatgctgtcaaaccagg

SEQ ID NO: 81897 - DNA, 1035 bp, Homo sapiens
agccagccgtggtggcatggtcctgtagtcccagctactctgaaggctgaggcaggagaattgcttgagcccaggagttccaagctggagggggctatgatagcgcttatgttgggtctgtgccactgcatgcctgggcaacatagcgagaccctgtctctaaaataaaaaaatgttcaaatgcctagtccagggtgacagagctgggattgaaagccaggtctgcctatctccagatagctcagtggctcctcaaattagatttgcctggagaatttggataaaaccggattctaaagtcccaccctgggaggttttgatttagaagttcttggatataaccctggaatctgtgtatttgtcaagcagcgtggtggtcctgggccacactgagggaactctctcttccctcctctgacttcccgtgtagttgctggtcagaagtctttgggacttgccccatgtagggcctctcccaagatcctgcttctctcctcaggatgaccaactcttggatgatggcaagacactgggcgagtgtggcttcaccagtcaaacagcacggccacaggccccagccacagtggggctggccttccgggcaggtgagaggcccaccacccactgggctgggtggtagccaagcaggttgggaacactgttccaaagaaggtcatcagggagcctggagttgaagccttcagggcagtgtcttcctcgtgcctaaagggctggcaatatcctttcacaatgtgtttgtttcctcatttttttttttttaaaaaagaagcaaccaaatgagatgcttacagaaaccaaagcttattttgtgaagccagctcacatttacaggaggctgagtgagtgcctggctccgtgctctgcatgttactctgtgtgtggcttccactgccctgtctcatcctctcagtagccctgggaagtccacataccatcatccgtgttctgcagatgaggacacaggcttaccagcagtcacgtagggagccacggttaggatgctgactgccgggc

SEQ ID NO: 81898 - DNA, 1076 bp, Homo sapiens
gcggccacgactacgccgcgacaagacggccccgagctcggtgtgcccgagcttggagcccgccggaccgcaccaacacggggacctcccctctgccagtcccaagacggcgccaccgcctccaaaggccatgcccgccgtcgggatggcggccgcacgcccctcgataccgcccgcttccagatcacttaaaatggcggcggctgcggggcggcacggggcggggctgcgccgggggaagggacgcggcgcggggcatgctgggccacgcgcgggctgccgggaacggggcggagcgcggctgcgccggcgcgtcgaggggagaggcagcagccgcgatggtgagcgggcgtgggggaggggcggccgggccgggccgggggcggcggggggcggctgggccgcgcggggggcccgggcttcgtgctcacgccggcccgccgcccccaggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggtgggtcccgcgggcgggccgaggggagcgggtacccggcgccgggcacggggctgacgcctacgctgtccgcgatgtaaacagtagcggccggcgacgcctgcgggcgcccgagccgcgggactgggacatccgttgtgcgggtgaagcgcgagctgcgctcgccgcggggatctccggtccgggggcgatgtttagacctcgtgccgggccccgggcgccgagggcaccgtggcatgcaacccctgcaacggtatcgcccgcgccgtgcagttgacgaaattgaggttcggcttggtcgcttaaccagccaaaggtcattggcagcgccagggttcgaaccacgaccccttaatccccacccttcttcgcaggcccatcggaatcacgctgtccccccggacactccttcgggtggagggtggggaactcagtgaatgcaaagaaagtcaggtcccactcgttcttcaccaagcaaccgtttgttatta

SEQ ID NO: 81899 - DNA, 1002 bp, Homo sapiens
cactttgggaggtcgaggtgggcggatcacgaggtcaggagattgagaccatcctggctaacacagtgaaaccctgtctctactaaaaaaatacaaaaaaagattagccaggcgtggtagcgggcgcctgtagtcccagctactcgggaggctgaggcaggagaatggcgtgaacccgggaggcggagcttgccgtgggccaagatcgtgccaccgcactccagcctgggcaaaagagcaagactctgtctcaaaaaaaaaaaaaaaaaattagctgggcgtggaggcgcctgcaatcccagttactcgggaggctaaggcagaattgcttggaggcggaggttgcagtgagccaagatcgagccattgtactccagcctgggcgacgtggcaggaccctgtctcaaaaaaaaaaaaaaaaaaaaaaaaaagatggctggtgggagagtcttgggttttgggtcctaggttcaactttcagccctccctgatggtagctctgtagcctcagaaaattggcttaatttctggagtttcaggagctttatcctaaggtggctgtgataacctggattgttgtgtaaattgcacatttggggcttggcaagtggcagatgggagttctggctgttttattaccagtaactgggacatgggcttgggttcgaggaggccacgtggctcctgacacagccttaaggatctgaggtggcccctgccctgggcacctggggtgggaagggaggtgcagggaacagggagacttatttttcactgtgatcttttcgaaccatttgaatgtattataccttgtgtgttttattcaaaaatgggtagatttgttaaacaaaacctaaaaaaaatatgagcaggagtgacagaaaacagagaccactgagtctgagtccaggttggcccctcccggtgtaaccttgatgcaacattgagcaggcctgagctggggtgacctcactgacagctaggagaggaatgagactctcc

SEQ ID NO: 81900 - DNA, 1112 bp, Homo sapiens
gtacggtggatcctggacactcttggtctacccccacgccacccacactgcttctagtctcacggggttctctctggccaccccaacatcatgtgaccttttagttcagcttgttaaaagtcagctgccagctggctgaggggtaggtggacagggagccaggaggccctggtgcccagcccagaaaggctcagcccctgccctgggggatgcacctgcaagcatgaggtctgaggggttgggagagtccttcaggagcattcagggtccagtgcttgccaggccacgtgcccagtcatccccagagcccttggaaagggccagccagcgtgggagtctgggctgcagggcccagaggggaggagggcagggaccaccgtgcagcgtgctaggggatcgcagattcctggtggggcctggctgggggatacaaatcagacccccagccctgccacccaggcccctgtggccccactcacagtgtcactttccctttcagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccaggtacaggcaggctgtggggcagaggcagggctgtgggcatcctcatctcttccagctcagaactgatgccccaggccaggcacccactgagcagactgcttttgtgcacacacaaattattcatataaacagaatgtgaaaccagtctttgtttttttttttttttttttttttgagactgagtcttgctctgttgcccaggctggagtgcactggcgcgatctcggctcactgcaagctccgcctcccgggttcacaccattctcctgcctcagcctcccgagtagctgggactacaggtgcctgccaccaagcccagctaattttttgtatttttagt

SEQ ID NO: 81901 - DNA, 1021 bp, Homo sapiens
gcggggggtgcagtgagccgagatcgcaccactgcactccagcctgggtgacagagcaagattccgtctcaaaaataaatgttctagactgtggcatccccaggaaaaaggattccaggaatcctgaactttctgtgttatctatttccaccatgttttgatgtgtgcaatgaacatgtgtctctttgtaattagggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatctcttctggacaggtgctgggtaggccttcctggtctctggccgcctgctgccagggtgtggccatccccagcaaccggagctggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgt

SEQ ID NO: 81902 - DNA, 1172 bp, Homo sapiens
agcagacaagaagttccagaaaggcttacatttactaaaagtttatttcaaatctgcctccaagtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccaggtaagcaggtccaggggctggggtgggcagggctagcttttggatcctgagtgtcactactctctcctcccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacagg

SEQ ID NO: 81903 - DNA, 3832 bp, Homo sapiens
ttccgggttttcactttggaattggagataagggatcgtgggcccgtgtagtctcggaagaggttgtgtagtttaggatcaaagagctggccgtgatgagggcagggatgcaggcgcagcccgtctgactccaaactgccttgctcttaacccgactgcaagaccctcaagaacacgggccccatggttttcctcttatgtttctatcatctctaaaatacaacagcctggtgggcaggtgagtatgaatctgtcctctgccttttcttggtaggtgcttattgctcccattgccgtttaaagtagaataagtgtgtggtatagacatagctctcttctgtggcctctttggagccacagggccaggtggtatcagagtggacatgctgccctgtactcagcctctgtctctgcccccagggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgagtgaggggacggcttctaggcccatctgggggacctcctttgtgtttctgcacctcccttggcaggacagtgtcctgggcagcctgatccccttccgttccctacagcctgtccctgctgggctcacaggctccctccacatttgacttggctgctcccatcatccccaatgcaggcccctccaggggttgctctgtgcatactggccccttgtccagagtctggcacgccctgcagcagcccctgtgccatctcctccggccctggcgccagctgtgcagcgtccttggcgagtcggcccagcctctggcactggccctgagtgcagtgcctggccagccctccccaggctggcaggctttgagctaccccctgcctgccatcttgcttttcttaaacacagtttccagtcatttatattttcttttagagaggagttttcccttgtatgagtcctgtatgaagacaattttgttaaaaagtacaaacaacattggcccccaggtcagctttctcacaggggagcccacttttcacaccacagcctgggctgcctgtgttgctctgcagctgctttttccacctcgtgacacatccaagaggtcccctggggtcagtgcaggtcggccctggctcctccgtcgctgggtctccacagacccagcccgagggatggaggtttgtctggttttgttattaccctgggcaggggtctgagacagatgccagctacaccaccgtgccccgtgtgtgaacccttaatggggtctgccaggttgtccccctatgtgattgtgccacttgtggctcaccctcactgtgtgcgtgggtaccacctcccttccaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcaggtggggaccggggcacgccaggtgtttggcaggctgtgggaggcccttcctgggacggaagctccattccccaggagggaagctccaccctagcccaggacacccggcctcagagccacaaggctgagacgccatccctgccctccagtggagagcgtctctggtcaggctgcctgtgagcctcgaaccctccagagccactttgtgtaacctgcctcctcacagctccacaggagaaacaattgtcactccatttacagccagattaagggccttgccggagcccactgctagcaagtggcatagctgagactggccctaggtgctgggttccagggtccacactggtaaccactgccctgatcatcaggatagtaatacctgccagcagtaactgtggtgcctgtccatcagggcactgggaggactcaccactgtggcttgtgggctccctgggcacagagcccatattccatgatgtccccatcctgcccagggttcatgatcaggcctgttggggtgtcccttccccctgcttccgcccctccctgactgatgaagacagcagccctctcccacccacctccaagaggcagccctggactgggtctgtgtcccagggccaaccctgcccctttctgtccccatcccgtccctgccagtctgggcctcaccatcctggaagtggcatgcaacatggagctgccccacggtggggagggctggcagcagctgcgccagggctacctgccccctgagttcactgccggtgagtaggtgagggcgggagggggtgctgccacgggctcctggggagatagtggctggccatggaggcactgctgggctcagggtgcagtcggtgttctgggaccccgatgtggcccttcctcatgggcaggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggtaagctcccgacagtggcggctgcctgccctgctccccagccccgggggtccgcccacccacatcctgagctcctctcccccacaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggtgggttcaagtgcagggtatggggggctagggggaaggtgggggatatcaccggggctccatggagattcgtggtgaatggggaccactcccacaaacctggcccccatcacatcctggggaaggggaccaagactgggggtgtgtggcctggccaggcttaatgcagctgggcatgtggactggccgttcagggcatggcttcacacttagggcaccagcaccccagggagtggctggccgcgcagccccgaccccagtggaggctgccagtgcccagggataaaacattgtcccttctctgggaagagaaagcctctggagtctggggagccctgccctgggaacaagtccttggtccctggggcctggtgtcttga

SEQ ID NO: 81904 - DNA, 2417 bp, Homo sapiens
aaaccccgtctctactaaaaatacaaaaaaattagccgggcgtggtggtgagcgcctgtagtcccagctactcgggaggctgaggcaggagaatggcgtgaaccggggaggcagaacttgcagtgagccgagatcccgccactgcactccaggctgggcgacagagcgagactccgtcttaaaaaaaaaaaaaaaaaattagccgggcgtggtggtgtgcacctgtaatcccagctacttgggaggctgaggcaggagaatcgcttgaacctgggaggcagaggttgcagtgagtggagatggcaccactgcactctagcctgggccacagagcgagactcctcgtctcaaacaaacaaacaaaacaaatggacaagttttgagccttaaactcagggctagaattgaaccattctacacggaaactgcttggaaatcgcaccgtcctgtcatcctgctttttgccgccttgcagcctgatcactggctctggccttggactgtcattgtataggtttcatcctgttatctttcatttgcattcaggatagccagggcagggctgcttgcacagtcactgtcatcagccagtgcctgtcacataactagaaagaataataaatgctaaagcattaagtgtccattttgcccacgagaagtgaggctcagggagcatgtcttgactgagttccaggatgtgatgaccactttccagggtgcatgcccctagagtcctgtccacatgtggcctgaggtctgggcctgccaggcctcaccttgttgtgcttctgtcccaaacacagtgcagctccttcaacctcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccatcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatgatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgcatttggtgttgcagcgggttactgagtgcccaccctggctaggggaagagatgggcataagtgagtcacgatcccctctccccgtggcttgagtgagcatacccaccaggcagaacctagagccagaccttggcctgacagccaccaagggaggccacctggctgtgcctgcccagccccagcggcggcgcacagattagagggagcccagttacaaatgctctttatttccaactcgagggtggggatgttggggagagggaggtgatgggcaggccctccct

SEQ ID NO: 81905 - DNA, 1327 bp, Homo sapiens
tgccgtcagggacagggtctctgcccctcctccggggcggtggtccagtgacgtcaccgcttctttaagacccccgcctccgcccctgtcccgacactcggcctaggaatttcccttatctccttcgcaggtgagtccggggctagtgtgcgtgttggagagacgcctcttggggccgggtgcagggtggtggcggcgtgggtaggggtgcgtgcgaactcgggctgcggccacctggatgggcgagtccctgagggggtcggccggtccgcgcccaagcctccgaggtgatagggtccttcggggctcccaagggttaaacgcccctcccccctccccagggacaaagactccgaaacccctggcgcccctcccccacctgccttgcctctcggggcggggcgcccctcccccctccccctcacctgggggagcggaccttgcggccactgcagctatagaacccctccagggcgcgcggctcccaggctggggtggtcgggtgggccggggcgccctcggacagagtctttttcatgcagtgcatgaaaaagaaaggggcaggggcacactcagaggggagaggcctgggcgcctataccagcgcggccccgaccctaactcggccagaggcctaagggccggacctgagcgctggggcaccgtgccccagccagtctccccaaggtggtctgctccgcccaggcctggggcccccggctaatgagtagagcctgccctccgaccgctgccggccgggaaaagtttaggtccaagccgtacaatgaaagtactctgggcagtgggaggccacagcccggccctagtcagaagtgattccctccacgacctccaacactgaggggacacaggtgcaggccaggtggcggtgggagaactggtgttgaggggagtctagcacggcattttcgtctagaattcataggaaaaggccctcagccttgaggctatgctctccggcgcctagggcaggtcagaagggtggggccagggagttatccactggctttgggggaggaactgcttttagatgggggattaatgatgcttttcttcatctctcctggtcctggtgtctgccagcctggggtgtggaaccaagttgtgagggacattgggtggtgggaggaagcttaggatctccaatcttagtgttgaaattaacaagttttggttgggcacggtggctcacacctgtaatcccagcactttgggaggcttgaggcgggcagatcacctgaggtcaggagttcgagacccgcctggccaacttgatgaaaccctgtttctactaaaaatacaaaaa

SEQ ID NO: 81906 - DNA, 1111 bp, Homo sapiens
tgatcgacgagttggggaggccgtcgagaggcactagggtctgtgccctctataccatgtggggtgcccccttccatccggtgacttcagtgcccagctatgcggggggagggactggggtcgggcccggtgcccaggagtgagtcacccgccggcggcaggggggttgtggggacctgaccccccccacccccagcgtcccgcgctacgccctccctcccggagctgccgtgtcccggtcgggccgtgcggtcacctgtgaggaatgcgcggggagggcgccggtgactcacgttattcgagccggccgaccctgacctcagaccccagaatagccgagtcccgcccccagcctctgacccgaggccccctccccaggcaccgccccctgctcccgcggcagctcctggagcgcggacctggacaagtgcatggactgcgcgtcttgcagggcgcgaccgcacagcgacttctgcctgggctgtgagtggggggcagggccagtggccagcggaccccagactgggagggagggtggctggtgcgcagagcggggccgagagctttgcatctgggaaatcattcgggaggaggtgggagctgggagggggctccggtcagggaggaggccacgtttgggagaaggcagaaggctcagtcttagggggcggggctggcctggagaggggcgaggtctgactccgagtcccgcccccaggcgctgcagcacctcctgcccccttccggctgctttggcccatccttgggggcgctctgagcctgaccttcgtgctggggctgctttctggctttttggtctggagacgatgccgcaggagagagaagttcaccagtaagtgtgccctggcctgcccagccctgtcagcactcgaccttttctctgctgctgacgaccccacctcttatcttgcagcccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggg

SEQ ID NO: 81907 - DNA, 1023 bp, Homo sapiens
agtctttccctgcagacagaggtgttccaggccttgcagcggctccatatgaccatcttctcccagagcgtctcaccatgtgggaagtttctggcggctggcaacaattacgggcagattgccatcttcaggtaccctctgccgctgtccacccattagccctggcacttggccctcatgggacggatgcccccgtttctgactcctgggtcccctccgctgtccctgcagcttgtcctctgctttgagctcagaagccaaagaggaaagtaagaagccggtggtgactttccaaggtgggtatacctgtggagtctggcttcaggactttgggtgggattggctcactcagttctgcatttctctttagcccatgatgggcccgtctatagcatggtttccaccgatcgacatctgcttagtgctggggatggggaggtgaaggcctggctttgggcggagatgctcaagaaggtaaggagtcgagcttgggaaagggctggggtgcctggacccagagagagcctttgaggtcacctggtattttctcttttgaagggctgtaaggagctgtggcgtcgtcagcctccatacaggtgagcagggccacgtggatagagggtgcatcagggtgaagccacttcctcactgaccttgcctttccttccccaggaccagcctggaagtgcctgagatcaacgctttgctgctggtccccaaggtctgagccccatgtgactgttcttggtccaaactttgatccttcaccctctgcctatcctgatttgacattgactttctgcctcatcctgctcctccacaggagaattccctcatcctggctgggggagactgtcagttgcacactatggaccttgaaactgggactttcacggtgagcagggtcctggagccctagagcaggtctaggtcagggagaggcactcttcctaggtctcctcctgacatcgcccctctacatgcagagggtcctccggggccacacagactacatccactgcc

SEQ ID NO: 81908 - DNA, 1073 bp, Homo sapiens
ggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccatgcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattag

SEQ ID NO: 81909 - DNA, 1661 bp, Homo sapiens
agtgcagtggaaccatctccgctcactgcaacctccgcctcccgggttcaatcgattctcctgcctcagcctcccgagtagctgggaccacaggcatgcgccactacacccagctaatttttgttttggttttttttttttttttttgtagagacggggcttcaccatgttggccagggtggtcttgaactcactcctgacttcaagtgatccgcccgcctcgggctcccaaagtgctgaaattacaggcgtgaaccactgtgcccggccttttacctaccagctttgcaggatcctgggtttctttccacttccaggccaatcaggttctggtgattgatagtggccctgggaataggcctgaccgtccctgttttgtcttgtttcccaggattcggaagcagaaccccagacaaggaggaatttaaacaagaagagcccaaaggggctgcctggcccactcccatcttagcagagtcccaggcagatagtcctggggtgccgggagagccttgcgcccagtcgctcggacggggcgctgcggctagcggccctggtgaagatgggtcccttcttggcagcagtgaaattttggaggtcaaagtggctgagggcgtccccgagcccaatccggagttgcagttcatctgcgcggactgcggggtgagcttcccgcagctgtctcgcctgaaggcgcaccagctgcgctcgcacccggctgggcgctccttcctgtgcctttgctgcgggaagagcttcggccgcagctccattctcaagctgcacatgcgcactcacacggacgagcggccgcacgcctgccacctgtgcggccaccgcttccgccagagctcgcacctgagcaagcacctgctgacccactcctccgaacccgccttcctgtgcgcagagtgcggccgcggcttccagcgccgcgccagccttgtgcagcacctgctggcgcacgcccaggaccagaagccgccctgcgctcctgagagtaaggccgaagcgccgccactgaccgatgtcctgtgctcccactgcggccagagcttccagcgccgctccagcctcaagcgccacctgcggatccacgccagggacaaggaccgccggtcctccgaaggctccggcagccgccgccgggactccgaccggaggcccttcgtgtgcagcgactgcggcaaggccttccggcgcagcgagcacctggtggcccaccggagggtgcacacgggcgagcggcccttctcctgccaggcttgcggccgcagcttcacgcagagctcgcagctggtcagccaccaacgggtgcacacgggcgagaagccctacgcctgtccgcagtgcgggaagcgctttgtgcgccgggccagccttgcccgccacctgctgacccacggtggccctcggccccaccactgcacccagtgcgggaagagtttcggccagacccaggatctggcccgccaccagcgcagccacacgggcgagaagccctgccgctgcagcgagtgcggtgagggcttcagccagagcgcccacctggcgcgccaccagcgcatccacacaggggagaagccccacgcctgcgacacctgcggccaccgtttccgcaatagctccaacctggcccgccatcgccgcagccacacggg

SEQ ID NO: 81910 - DNA, 1140 bp, Homo sapiens
tcaccatggtagtcaggctggtctcaaactcctaatctcaagtgatccacccgtctcagcctcctaaagcgttgggattacaggcgtgagccactgcacccggccagaagcccttttctaactccctcctgcaaggccttggcatggcctctttagaggtgacatagagacccagcttcctggagccagttctcctcctgccctcgtggggaagccgcaccaagaagttgagaggtgtgaggagagtggagtgggctgctgggagccaagagggaaaccaagacttggagctaaagctttgagctggggagggggcgggggggccagagaaccagccagtgaggaaggcctcggggaccctggagaccaggcttccagaggcagggaagtgacgggccagatgcaggcaacagggagcacagaggttagacttgtggtgcacttcctgccagtgatggagagaggccccaggtttctagggaggggtggtcttccttcagagcaccagtggaagttctcggcttcccctcacctgggctgtagggtccgttctcacggtggtctcaaagcccagggcccagcacaggccccccagcgcctccacgtcatgctgggccccaggccggccttggatcacagccaggaggagggcagccctggccttggacaggtcatactgtgtgctgggaccgggggccggctgcagagagggttaagacacatctaaagtggcctgagaggactccagctcctggcctccccggccggggccccccctaagcttctgtcccactggaaactgtggccatgtgattggatccctgccctgcccccctcacctcaggcctccagggctccacgcctcccaggcacagtgcccccctcaaggagctccgaaggacggggcagcaggtgccccctgcggactcttcagccaccctgcggaagagctggggatggggccgagaaaagactcagccaggcttgtggcttctatagtctcttcagggtcacctgccagaatgcagacaggaggaggccagcaaaggacagacaggcaggatggcctcaagcagggcccaggctccagttcaggctcaaggttatggacttccctgggcatggatggcctcgagtgga

SEQ ID NO: 81911 - DNA, 3935 bp, Homo sapiens
ctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtgagagagagagagagctgttttatctgtggtttgtttagccctgagcactgggacattgcgcccccggtcgaattcaagtaaattgccctgagtagaccttacgtggggaagaggacttgtgatttaacctggaacactcatcctccagattttcccccaaatgaacgaaagcagtgaagagtgccctgtttccacgcggaggcggtgtccctgcaacagttagtgttagccatggagttagatcgccagcgttcaaatcctcaatctgctagtactagctttgttactttggcaagttacttgatctctttcggcctgttttcctattcgtaaaatgaggatattaacatactttctagggcttagagggagagcagcatgtaaagttgtgaacactactagcttatgagtgcttagtacttgttacctgttgttatgttagggtccacggtctggtcttctctgcaaagctgggcctccgttaattgtgaactttgaaagataatttggcaccgaggccctgaggtcattggtccccagggctaccccaatttagcctatcctatagtgaggaatagaagcacctagaaaaggtggggagagcaaaagggagtgaggtgtatcttaagagctgtgtggggaaggtgtgctctgggagtgggccctttccctaacccctccccctgcacatgggatcaaaaaagcctttagtgtaaaccatttttctgttacctgggcccaaagggatcgcctgaggttctctgttgaaggtttgctctcagtatcctatactaatttcccttcctcttgggccctgttgtgatgatgagtgatgtgggttggttcccaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagaggggtgaggcacagttatctgggcaggtgggagggaggaggggcttgggggttgcccccgacactagctggatgtagcaatgatgcgaaggagaaggaatttctgaagatcaggttctcacctgtggaatgaaagacctgcagttggtggtgtgggttctcctggggctgggggaagggaagggagtctcagtagagcccttttttatgcagaacagaggcgatttagaaccacttgaatgacgcagggtttggagtgctactcttggtactccttccctctcaccctgtcattttggatatcagctgattaggcctctgtgcagtttagcgtcattcccaaaagcagaggctgggtgttggggaatggatactgtgttttaataatccttgggttgccaagagttaggaatgccattctcattataatttctgtcaccttcagcattatctgctccctggctttctctttttcctcctgaagggaacatggaagacaaggagatgactgggccccaggtgatgtggaagtttccattgtctccccccagcacccttcctcccctgagtgttgggggtgggggttctccatgtggaaggtcctttgtcccttaccacagcgtctcccccactgctttgtctatttcacacctcacttggaggcctgatacccttcttcccccctgacatgtgcttggcatccctggattttgcccctttaacccatgactctgcttgaattgttcttggtgcatcaggggctaaaggagatcttgtgctgtttcagttgcctgagagcttagaggacgtggcaatgtacatctcccaggaggagtgggggcatcaggatcctagtaagagggccctctccagggacacggtgcaggagagttatgagaatgtggactcactgggtaaggacttcttttccagggatgatgactgcgccatttctgaccagggtcctgcccgttattcattcacctcctggacacagactctgagttttgccaagaagcctccacaggagacttccctttgtctaaagtcccctgtacgagagtcatgtatctgccaagtggtacagttggcacaggcagcccgggactggagtcccagctgccagagcctaaggcgagtctgagccatgtgcacttcctagggcagagcaaacccaatgcggtgacaacctgccagcatcacacacatgcagtattccaggatgctggggggctctaaatggttgattccttgcaattttcagatgcttattcttatgagctcgccagtgtttcctgtgttccgttagtgtttctaggctcgtccccaaagacaaaaatttcaggggtagtaggatcaacattccagcctatcatctctcacagcccataaaaattcagaaagtggggagggtcttgtggaaatttggaaacaatgtatagctccaaagtaggccatatcataaattaagatttacctatgtcttgtactgtactcagagttttaaaattatgcctacggaatatgacagactgacatatagttggatttaggtggaggatatgcttgtatttattgtacaattccctcaacttttctgtatgtatgagaattcttttaataaaaagttggggaagtcttaacataaaacaagactgtgtgtacattatgattatacctatgttgaaacacaccagtagaaagactcactggtgtggtggtggtagtcccagttactcaggaggctgaggggagaatcacctgagcccagtaggtcaaggctgcagtgagctatgatgatgccactgcacctcaaccaggtgacagagtgagactctgtttcaaaacaaacaagacacaccgcacattgtttccatatatcaggtttgcctaaaaagtatcacaactgtacatttgttgacactaattctgcaaacgcaatcttgctcactgcaacctctgcctcccgggttcaagtgattctcctgcctcagcctccagagtagctgggattacaggcatgcgccaccacacccggctaattttttgtatttttagtagagacaggatttctccatgtaggtcaggctcatcttgaattcccgacctcaggtgatccacccgcctcccaaagtgctggaattacaggtgtgagccaccacacccggccttttttttttttttttttttttttgaagtgagtctcactctgttgcccaggctgctctggaacttctgggctcaagcagtcttcctgccttagtcaggaagtgtgccactgtaccagtttccatattacttttcactgctgtgatgtccaaagttgaacatggcccttttagtgagagatgctaaataggaaaagatcagattacagcttgttggaattaaacttctgttggagtccatgtttgctggaggtgg

SEQ ID NO: 81912 - DNA, 1328 bp, Homo sapiens
gagccaccgcccccagcagagtaaggcatttgaggatttgggtgcagggccggcccagcacagctgctagagaggtacattacgtcctttgaccctgccattctccatcccagtgaggcaagtgaggaacccagggtgcagagttcaaggaggcccttattcttgagcttacttgtcccaccctactctcagccctgctccatcccacccattcctgaagggcagaatcgagaggctcaggtggaaaggaaaattctaagactggtctcggctctgattccttgaccagtggcccgaccctttatcctgatgcttctccagagtgctttacctttaggagaggatgggattctgaggtagaagcagcccttctgggctgctgacctaacaggcagcggcagacaggtgggattttcttttctccagcatagaaataatgtacgggtttggtttctctctctctaccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaa

SEQ ID NO: 81913 - DNA, 1062 bp, Homo sapiens
tggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaatgtctgtgagtcttcaatgaaagcctctgtctagacccccgagtgttgatctgtctcccctctgccttggtcagaggccctgctttctcatagacttactgggttggtcaggaagatgctgacaaaggaggcagcagacaggcagaggcaggtgagggcctggcagcctccaggctgggactgccatgtggtaacaaagggtcaagccaaatggctgctggggtgatgctgtcatagggtctctagaaagtattctttccttctgtggtctatagcagtaaaaatgttttcaattctttgtttagaatgtttacattcttactcagtagctgaggaagatctgactcttagagaacaggatattttggtcttgcaactgatttc

SEQ ID NO: 81914 - DNA, 1465 bp, Homo sapiens
gttatcattagtcaatagaattgagtgctttttatctttttttatatattccctataatcagcatgttactttcacagtaagaggaaaacaaacactaaataggtagtaacagagttaagaaagcagagtgtgttttaccattaaattgaaaacctaatttatccttatcttaaagctaactagaactagtcagcacagtttctttgttatacgatatgattacaaactaatgcttttcgcaaaggcattccaccttagataatctgggacaatacttcattattcagatccttgtgtaaaatttaaaaaaatgaatttatgaaacacaaatttaaataaatttaaagaaacacaaatgtattattttcaaactgtaaattttataaccattatataaatgggcactgatatacaaaataatgtcagttgctaaaacaagacaattcacagctggcctacatcatataatggcagaaatctttaaacacaaaatctaatgattagaaccagaagttgaaggcccactgaaggagtccttaatattatgaggcctaggtttcaaaaagctaccaattctagaatggattttactctggaactgtttcttgactatttcttgttgcatctctttcagtgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatga

SEQ ID NO: 81915 - DNA, 2162 bp, Homo sapiens
gtagaagctgctgtgttaaagggctggcaggcaccacagtttgtttcctttcaccctagttttctcatatttgtgtatagtcatttgtggagcattggtggcccagtatctctttaagcctttttttgtcattttttttagtgtcttatactacccacaatgtgggctgtacacctgtcgctctgcctccacccccacaaaccaaaagtaagttctgtggtaacaaggatgggaattatttctaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagaggggtaaggagcttcatgataattttcttctcctgggagctgtgataatagtttattcacccaaaatgtcatgggcattttttgaataccctgctctgtggatttgtaaaaccagccttgatagcaactatgatgtccttccaggcagcagtagaaatgccaactgtggatgaaagtgggagtaggcctagagaacagaaatatctaaaccacagaactcttggtaataacagtgtgaactctgttccttagactagtggagaggaaggaaagaaatggagtgggaaggcttggggccacttcatccttgtaaaatacagaaggaattgagatcagatgggctgttagtggcagaatgtgaaaacagttgtgtaccaggaaaaacataataaaagacaaaaaacttcatctcctaccatacagtggagtccctgagtacttcattttaagatatctttaatttttgcctaactcagaaaaatatgagaggaaaaagggatttcccttttatttctctgatgaaaactgaggaaacatttagttggggaactagttctaggggctggtggatatttgattcttatttatgaagagactgcttcaggcatcacacacaccacacgtgtaaaggtgtcccatctgtacttaaaaagtcaggatcagtgttttagaaatgagctcaggatgtttatagataaaagagatttcttctggctcttttccccccacagctgtgcctactcaacagattctagcttttcctgagcaaacaaacaccaaagactggacagtgacacctgagcacgtcttgcctgagtcccaggtgagctgtgctttccagctgttgagggctacctttctctgctatgtatgattaatactgtccaggaggggttcagaggtgtgttagtcccgggtgttctctgggcaactgggtacctcccaggctgtgggctgacgccttttctcctttttttctgccttctcacttaaaaaaatcatgttcttttaattcctttatcgcctggccaattcatagccaggtggctaggctgcttctgtacagtggcaggttctgagctgaagtccattctcttctttagagcttgttgacatttgaagaagtggccatgtatttttcccaggaagaatgggagttattggatcccactcagaaggccctctacaatgatgtaatgcaggaaaactatgagactgtcatctctctaggtaaagattttcccttccctttatgtagttgagtactctattcttggcttactgagaaggaaccccagtgaggggtgtcttactgttccaggagctggttgattctcatctagatggtataggggagggtgtaggtagtgtatccagatcacctgtggagctttttccaaatgtacatgccgattgcttatcccacattgagtcctttatcctttccttctcttttccaccaaacttcctcttctgtgtcttacttatctcagtaaggggcacattcattatccagtggctcaaggcatacaaagtaacagttttcctttattctgatcttgtcatcataccccactgttaattcattagcaagttttcttagctttactttgacatatcctgactgcaacaatgtctcatcttcttgcactgttagcatcctggtgtaagccagtgtcatcttgaaccaggcatacatgcgtagctttttaacaggtgcgcct

SEQ ID NO: 81916 - DNA, 1571 bp, Homo sapiens
gagaatagtataatgaaccccctcaaggccttaaaaatcaccaacattttgccaatcttgtttcatttatcccctccagtttttttattttttgcatttagagggttgttggtttactttggagtattttaaagtaaatctcagacattctaacatttcacccttaaatagttcagtttgtaagagataattcttgacaatctctgccctaaaccatctttggggaacagttcctactcagtggaggacctctgtcccataggagcaaagctcattgagaacacaggagctgcctttcccttccccagagggtgaccaaaaaactttactgacaacttctcaagatggctttgtaagaagaccctcttgacctcctccctggagtatccatttatgagaacaccaggcatcccagatgcctcgtaatgagagtggtccggaagggatactagatgcccgtgatgatccctggagcaagttattactaacttgaaactaagtaatctactcctgcacttttaacaagcctcagagtgcttcattcattaagagttcagtggcatcggttaattagtggtttcctgaaagcctactgaacaaaaaactaataataattacaccaggcatctccccaggagttcaaagtgccctcagaagagtttctcatttactcacttgcattggctttaattttttttttcttgaaacaatgtgtaaataaatattcaaagcattaaaatttcattatagttcacctccctcttagtaaacctgcttgattttattttgttttaattagcatttgaccatcccatttgggtaacttctaagaagaaaaatgaacctcaaaatttaatatccctattctactttcttcctcatttgttatcatgcttccttgtaatgaggaattttctctcctttaccctggttagtgttccttccttaccttgatcctctgtctggagtttttctaaagtagttactctatgctttaacacccagtgtcctgatagtcaagaagtgtgctacaaactgctgtgaaagatcctttatggccagttaatacttgccataatttatcagtgtggtcttataaaaacatacttagccaaacaagagttctttgcaaccagaattcctcgtgccataagctactgtttattaccttctgcaagtctcaaatcaacacttaaattaacctgctgacaaaaattcattctgttcttatctctgcctaaggattactccgcctaagtttactccctaaaactttttgagaattatgtacgctgtgtgctcattcattcattcaacattgggaagatatttattggtcactttttatgtatcagcctgtcaaaactgtgagacaggaaaaacaaccaaaaacctagcacctgtctcctgggaggacaatgtaagcttggataggtagccagactaggatggagagcagaaaataactggtgtaggaaattggctcccctttggggttctgtgctcaccctccctctccttatcccaacaactctcttgaaaagaacatacccaaatcagaagcataccac

SEQ ID NO: 81917 - DNA, 1062 bp, Homo sapiens
ggtggagatccagtggtggggtttggccatgtgcctggccatatccactgcatatcgctaggtgatctccgtgtaaatctagcagtacgggtaagagtgtttgcggaggaactcctcaggtctcttcctccgcatcagcaggagggtatcatgggtgtgactgtcgggcactaacacgaatctccatcccatgattctaggcgttaggactggagaagcagctccgggccaccgtcccagctctaatctcacttaggcaatgcagagctgtgggcctgactaccacgtgtgtctctggcttgttgaaatgggcactttgtacatctcacttgtgctgggtagagtgtcttttctttagaaccagtaccaatctcttaggcttttggcattctctgcagccaaattctaacatgcttctacttagctggaatgtaccctcggcttacctttggtaaatggtatctccccaggtgagcttagccacttccatggctacaaagacctcattttaggtctagctccaatttcttttctatgtactccagattcctacattcaggtgcctacaggagtcgtcttttagatgtctctcaggcatcaaaacacatgcccttaactcatgcttttagcccctgatctgtttgcctccagtatgtggggccacatccatacaattgctcatgctatcaacaaacactccctctttcctcttgctatggcttgaatatttgtgtaccctaaaaattcatgtgttggaattctaacacttaaactgatgttattaggaggtggggactttggcagacccctcatgattgggattagtgtccttataaaagagactgcaggccgggtgtggtggcttacgtctgtaatcccagtgctttgggaggccaaggtgtgagaattgcttaaagccaggagttcaagaccggcctgggaaacatagcgacacgccatcttttcaaaaaatttatttagcccggtgtggtggctggtgcttgtagtcctagctacttgggaggctgaggcaggaggattgcttgagcccaggaagttgag

SEQ ID NO: 81918 - DNA, 1147 bp, Homo sapiens
agcctcaagtgatgctcccacctcagcttcccaaagtgctgagattacagacgtgagacactgcccaacccctctctttgttgataaatatgaatcctaatcttttttccaattgttaattgttctgctgtcacttgagatagcttcaaaaatgaaaggctcttgaggcctaaatagattagatggaaaagttcacctctagatagctgctactgagattgtccttagtacctatcccactggactctgacttagttatagctattctctccttacctttggatattcacccaaaactggatcttctgggaggccaggagagtctgcttggtcctgattttgtgtggttagtgtctgggttatagaataacccttctaaggtttcctggtcctgtttgtaactaccttagcttactttttccccagtatcccttgaagatattgtctatgttttgctttcttttgtttttatcaacaggagaggaaggcaagcctgagattaatcagcagttaagcctagagtctatggaacttgacgagcttgccttagaaaagtaccccattgctgcaccccttgtcccttacccagaaaaatcctctgaggatggagttggaaaccctgaagcgaaaatattaagtggaactcccacttacaagagaagggtcatcagccttttagttaccattgaaaaccacaccccattagtagaactctctgaatatttaggaaccaacacactttctgaaattcttgattctccctgggaaggagccaaaaatgtgtacaaatgtcctgagtgtgaccaaaacttcagcgatcattcatacctagttttgcatcagaaaattcattcaggagagaaaaaacataaatgtggtgactgtggaaagatcttcaatcatagagccaacctgaggacacacaggagaatccatactggtgagaaaccttataagtgtgccaagtgcagtgccagctttcgccagcactctcatctatcccgacacatgaatagccacgtaaaggagaagccctatacatgtagcatatgtggtagaggttttatgtggctcccaggattggcacagcatcagaaaagccacagtgctgaaaacacctacgaatctactaactgtgataaacatt

SEQ ID NO: 81919 - DNA, 1052 bp, Homo sapiens
tcccctctcccaagcatacatgtccctgaggccacccctcggctttgggcccaggtggggacagaagcctatctctcttcctgccactcctccccacagcccggcaccttctcttatgtgcagctcagaaaatgcacagaccaaggcttccatggagggccagtgtggtggggaggagcaaccaggacttgggtgcagcagggccctgctctcccctgcctagggggtacattggcaggtctcccctggcaactggttcttatgacatcacggggaagactcccagccttcctggacccctagtttgggagaggacagtgcccaaggcaagggcagggtgaaagaaaggcatgggaaggggccagaaccctgggggaagtccctggtccctctggctggggtcaggccacataaaacagacagctctggcaaactggagagtccttctctcaggtgatctcttggggccagcttcctcatctggggtgggaaatgagggttcaggagtacagacctaggaagacctaggtcggtactttgaaaatgctgaaaaggggctgggggcggtggctcatgcctgtaatcccagcactgtgggaggccgaggcaggctgatcagttgaggtctgtgggaggccggggtgggcggatcatgaggtcaggagatcgagaccatcctggctaacacggtgaaaccccgtctctactaaaaatacaaaaaaattagccgggcgtcgtggcgggagcctgtagtcccagttactcaggaggctgaggcaggagaatggcgtgaacccgggaggcgaagcttgcagtgagcccagatcgcgccactgcactccagcctgggctgcagagcgagactccgtctcaaaaaaaaaaaaaagttaaacattcatctttccggacctggccaagcaggaagcgccatcatgggagctgacgtccgccacaagaaggacctaaaggttcggcgcaaagagcccaagagccaggatatctaactgaggctgtttgttggtcaagctgtacaggttaccgtccagacgaac

SEQ ID NO: 81920 - DNA, 1029 bp, Homo sapiens
acaggcatgcaccaccacacccagttaattttttttttaatctctgtattcacatttcccagaaaacagttacagagtccctttgtgactttgctgtttcctgtgctcacactttctgtttcattgtcttgcgaagtctgacctgacttgcagtacctaggtaggttatttgtgaacattgatggaccattttgaacatggatcttcaagaagagtgcagacagaccttaaataaccaggaagcacactgaatgtagatcttggtacatatgggaactcaacaaatgtttgtggtgttcatttccaagtcctgctctcttgaaagcactaaggcttttcctgaggtgaccccaacctatggatcaacaagtattagtattactgtttcttaatctgttttatagtaaatctaaatatggttgtatagttcaaccactctatttaagatttctctaaatacaaggcgactgatctttaaaacttgtgttatttgggtcctatgtggtcactaaaattaaaaaaaaagacaactcagaaacatgaatgtcatcctacggattcccctcagaaataaccactgttaacattttaaaacactttttaatcagctgaatttgagtcaaaccactgttgacatttaaaaatactttttcttcatgacattttataaggacgggtgtttcttccttttagcagtaaaaagaaatgagatactaaagagagaaatgaaattcacagctaatccctcaattccattttcatgtatagccatctacttctcccattgaacttaaatatatgctttttaggtagcatttttggtattttaaattttatctcctttttgctttcccttgtagaaagttgacaaatagtccctaaagctgtcaataggttggaaataagaaggaaaagtaaagacaatatctaagttaataagtagttgctgtgtgatggggaactgaatgaattgtatttttccttggacagatttcacagagatgatgagagccctgggataccctcgac

SEQ ID NO: 81921 - DNA, 1043 bp, Homo sapiens
atgaagagggagagttgttgctagtgggttgaaaatgagagccagaaggtgaggattggttgtccaggagagagggagagtgagcagagcagggagacgtttatgtttgggctccttagaagagttagcatattctaggaagaaggggtgacacacacatcctaagaaagaagcctgtgcacagggctcagtgctaaatcctcattgtggttgtcatcaccttcctggcaacagctgcccatctgtggagcccagaaccattgtaagtccttagtgggtgccacccgatttgcgcctctccaagcctgtggaggaaagtctgaggcagagaaggagggcaggggaggacgaaacacaggacgtcaggctgctgcaagaggatgtgtgtccctcaggctgtccctttgtgtggccgctctgctgccgtcaggcaccctactgtgacaaagtccaagtaggaagcacgtcagctttctcccagctatgccctcctggttgtggcttcagtttgaggtgacattaggttttttggagagacccaggcgtcctggaattggtctctttagtacttagatgatcatttcctgagcgtgtgtcccgcagcctgtgagcatgtaactggggaagcacatgtttgtggtcacgtgtcccaaccaaaggtaggagctgacatgaacaggctagtggttgaatgcatgttaaaaatctgtggctggccgggcacggtggctcacgcctgtgatcccagcactttgggaggccgaggtgggtggatcacctgaggtcaggaattcaagagcagcctgaccaacatgtagaaatcctgtctctactaaaaatacaaaattagccgggcgtggtggcacatgcctgtaatcccagccacttgggaggctgaggcaggaaaattacttgaacctgggaggtggagattgcggtgagccgagatcgcgctatcacactccagcctaggcaacaagaacgaaactccgtctcaaaaaaaaaaaaaaaaaaatctgtggctggctgaacatggtggttct

SEQ ID NO: 81922 - DNA, 1024 bp, Homo sapiens
catctctaaaaatttttaaaaattacctcagtatggtgatacacacctgtagtcccagctacttgggaggctgaggcgggaggattgcttgagcccaggaggttgaggctgcagtgagctatggttgcatcactgcactccagcctgagccacagaacaaggccgagtaacagaacaaggccctgactctaaaagaaaaaaaaagttagaacaaagacttaagagaatagaatgtgatcttaactcttctcaagcaatgaaaaaaagccttacataagggtatcttcacctcaaatgtacatgtgttgcctgtcataacaagcagatggctaaactcattctctttactgcttgcggtatgtctggaaaactgcttaaagcttgaactgccctttaagcttttatagcttcttggaactcaaggcagagtaagtgaatccagacggggaaatccagacgtggtctcctaagatcttgccataaattaggtagaaacagaaacatactcctgcctgtttgttggcatagattttagactttatttaaaccttgatcattcctcaccagtcagtaattcatctttcttcctacgttacctcattggaaatatatttcccaggaataccgatggagaatagtggtgccggctctctctctcttctcttcctcgttctgtgcctctttccctcccccatgcttctgctctttctcccttttcattcaccctttatttttctttcttcttggctccctcctcttcccagctgcctactctgctcggatgttttgcctttttggatgttggtggctggctacaccctgcccactgtcccgaggtctgtggggaggcagcacctggaggcagcgacagcaaccacagggagcgccctggctcctccctgcccagcgcaaggccaaggcccttcccctcctgaaactggctctttacctctggagcctcagagagggaaaaaaaaaaaaacagaagtcattgccgccatatagattgatctccttgacacat

SEQ ID NO: 81923 - DNA, 1056 bp, Homo sapiens
tgccttcatgttctgtcctgtacacctggctctgccttttagatagtagtagcaaattagtggaagtactaaaagtctctgataagcagaaataatggcgtaagctgtctctctctcctctctgtctctctgcctcagctgccaggcagggaagggccccctgtccagtggatacgtgacccatgtgaccttacctatcactgaagatggctcactctccttaccctgcccctttgtcttgtatccaataaatatcagcacagcctggcattcagggccactatcagtctccacgtcttcgtggtagtggtcccccaagcccggctgtcttttcttttatctctttgtcttgtgtctttatttctacagtctctcatctctgcacatggggagaaaacccaccgaccctgtggggctgtaccctacatccctgaacttcagtgtcaagtcactgtcagggaccggtagcagcccaggatcttcctgctgaattgatggccttgttgcacggagttcctcctcctcttgctggttgccctttcttttcttcagggtgaaatattctattcactctcatgttgagggcagcatacttgaggcatcaggcccacacacatgctcccacacacactctctctctctctctttctctttctttgccatttcccttgtatctctctcattttgcacctgttctgtgactctctcgtctgaatctcaggaaactttggaggaaggatagggactgctgggaaatcctccaggaacaaggttaggaaatttgaagggcctgtctagccaaagcagccctcccctttttagttccatgtcagccaggagcatgtgaagcagccctcagtgatcagcctgcatggggtttgtcccttgcgagaggcccagctcagctaggagccctggtttgttgcttgcatcccatgctgtccccgggccaggatgctaagacctgccattctgatcttgctttattcaccaagatttacctttgtgttttcttctaggagttctatagttttagctcttacatttaggtctctg

SEQ ID NO: 81924 - DNA, 1020 bp, Homo sapiens
ggtccagtggccctcagcgcagatgcagagtgcttcttagacgctgcgggaaagccagcccctgcagcaccacacccagatgcacctgcagtttggaggattctggttggatgataaattccagctggcagtacatagcctcagtcccatctgtatgccctcccacagcctgcttgccactctgccagcctcttccttcacacagggatgctgctatagaaagggaggcagagagtcttaggacaagatgtcaggaatgaggcaggatcccccgttgcatctgccatttttttcctataggaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaaga

SEQ ID NO: 81925 - DNA, 1007 bp, Homo sapiens
catacaatagaaaatgcaggaccccatgcaaagcctttgtgcttctaggatcccctcgctacatggacaaggctcagggtacctccccttagaccaggtttccctataggcctgctgaagcgtctgggggtcagctggctctcagaactgggcaaaaggcagtgcgccacctggaagcagttctaagggtgagcaggaagggcaggtgcactcacttgatatgctggagcctgtggtttccagacagtgctgtggcaatgcatatcgccccgtccatccccagagaattctcttgaagactaagtggaaaagagatggagacacacggtgagccatcagggcagaaggaaaacacccggggaagcaacagtgcattgtctgggggcagtaacccaggcagatgtgtccacaggtgccatggcaactccaggtgggagttgaccctggagacaggtgtctacgagtggccagattgtcccacgcaagtgcgctggaggatgtaaggccataaatgcaagatgtgagtgacttctgactgaagctaagcacactcaacaaacccagctgcagtggaatgtggactataataagtctgattgtttatattcagaaggaaatagctacagaagaaatcaggagcattttattccatcagggaggacccagcagagaactctgctgctccaggatgcaggtaggtccctccagccacttacttgagtctccggagacttgagtttaccttcagagcatttgccagggctttggctccagccaccccaatggcatttcctcttaagctgttgggaaagacaggaagcctaaggcatgggtacaggctgagaggtgatactgacccctctgcgggtgggcttggggctgcttggtagaggaaacaaggacttcagcagtcacaggaggccagggctgtgccttcctcactccagggcaacagggcagagctggctctgggaagcagggcacacaggggcatggctggcctagcc

SEQ ID NO: 81926 - DNA, 1087 bp, Homo sapiens
caaggtgggaggatcgcttgagcccaggagttcaagactagcctgggcaacatggtgaggccccatctctttaaaaaaaattgtaaatattactttaaaaaataagttatatgctggatgtggtggtttgcacctgtaatcccagcactttgggaggccaaggtggaaggatcacttaaaggtcaggagttcgagaccagcctgaccaacatagtgaaaccccgtctctattaaaaaaaaaaaaaaaagctgggcgtggtgttgggcacctgtaatcccagctactcgggaggctaaggcaggagaatcgcttggacctgggaggcagaggttgcagtgagccgagatcacgcctctgcactccagcctgggcaacagagcgagactccatctcaaaaataaaataaaagttatagaaaaggaagtgggaggtgagagtgaaggtcttgtttctagcttgcacagttggttccattcacaagatggggagccaagaagcaggttttcaggagagagaatgcagggaccctgcacccgagcaagatcccgaagggaggtacagagggggtgtggacgcgcaggtctagggttgaggagagagggctgggacacggacgtgggagtcgttgggactttgaagatcactggagcccagggaaaggaaaagagctccaggaaaagagacgccaggcaagcgaagatgacataggacgatccctgaggagccctgcgcagaagagccaaacagaagaaaagaggacgaggcccagacagaggggacatcctggaagctgaaggagaagaaatggtcagggagaaaggccgatgaggctccaagggttaaacctagagttccctcacgccccagcgactccactcccaggtatatccagccaggagaaggaaagctcacgtccacacagaaactggtgcacaaaggtccacagcagcaccgttcctaacagccaagtaggaacaacccaacgtccgtcagctgatgaatggagaaatgaaacctgtgtacccatacaatggatatcattcagccttacaaaggaactaagtattgagacaggctacaatgtgg

SEQ ID NO: 81927 - DNA, 1050 bp, Homo sapiens
attctcctgcctcagcctccctagtagctgggattacaggtgcccgccatcatgcctggctaatttttgtgtttttagtagagacggggtttcaccatgttggccaggctgctctcaaactcctgacctcaggtgacccgcccaccccagcctcccaaattgctgggattacaggcctgagccactgcacctggccagtgctttcttgtcttaaaaagacactgtcacactggattacaggctcaccccacttcagcatggccccaccttaacaaagtacatccacagtgaccccatttctcaataaagccacatacttggggcacagggggttaggacttcatatcttttgtggggacacaattcaattcataaccccctcagaaccatccagtctgatagaagctgcacacccgctgaatgctttcagcctgtcccctgcccgccactctggaccttagtgagtagggaggaaaggacacaggctgagggtcatccaggtgtcccgcagaggcaggcggtatgtggggtggtgaggacgacagcccgtggaagatgccgttctgcacaggaaccgcaggtctcgtgggcacccagcctcctgttcactctcacgggaaaggtctgagcactggggctgagcgcagatctcagagctgcggtgatagcgctgcatgggatggagagaggcagaggccccgggccagggcccccaccctgcccgtgggcgggtgggacactcactgtcactgctccccttggccaggctggacaccaaccagttccaggaccccgtgatggagctgctgggcagcgtgctgagtgggaaggactgtcgcattcagaagatcaggtaacacagacccaggggacctccagggtgcctatggtcttgtggggtatggaaccctcttcccatcatcctctgctcagctggccagcggcgctgccacggagaagtgtctttggagcatgtggctccagatgcagcctgcttgtttctgcccaattccagaaagtgctagaggctcaggtgcctcatcagtagga

SEQ ID NO: 81928 - DNA, 1023 bp, Homo sapiens
acttggtcaccttcacatccccagggcctagaacatacaacaggctctccataaatatttgctggttgaataaatgaagagaaataaatcatatgtttatatcaatatatgctaaaaagtaatttgctaatttaacagatattccttatcttaaaaaattttgcccaggcacggcagctcacacctgtaatctcagcactttgggaggctgaggtgggtggatcacttgaggtcaggagttgagactctgtctcaaaaaaaaaaagtgtaaactaccttaagaggcagtagattatacagcacacgcactggtgtcagtgaggaattgatttctatcccaactcccacttcccagctgtgtatccttggacaagtcacttaacctctctgagcctcagtgtcttcatctgtaaaatgggagaaataatggtattgagagttatgagaaataaattatggaaatacagtgcttaacagaatatgcagaacacagtatgccttcagtaaatattacataatagtatttgaatggtaatagaacaaaataaatctttctctatcggagaagaaaactagaaatctgtcacaaacatcacacctaacagtttgggcaagaaccactcctggtctagtctagagtaaaacaagaaggcctgcaacaaccttattgctccaaggaaggggtaggcctggccaatgtggtaaaattgttcaaaataagagttatagtttttgggctgggcacggtggctcacacctacaatccgagcactttgggaggccaaaacgggtggatcacttgaggtcaggagttcaagaccagtctggtcaacatggtgaaaccccatctctactaaaatacaaaaattagccaggcatggtggtgcgtgcctgtaatcccagctactggggaggctaaggcaggagaatcacttgaacatgggaggtagaggctacagtgagatcgtgccactgcactccagcctgggtgacagtgcgagactccacctcaaaaaaaaaaaa

SEQ ID NO: 81929 - DNA, 1056 bp, Homo sapiens
gggcggcctggtttcaggcgcctttgttgctccccacagccgaggctgcagctgctgggtctgcactctgcctgcctggagcctcgggcagccttctcgagggtccatcgtgtcctcccagcacccagcaggttcctgggtgctcagaaagcattgttgggagggagggagaggaaggagggacaaaagaaggtaggcaggcaggggaatgtgcaggagcacttctggtctgctgcctcagttccctcccccccatcacccacacaggctctggggaaccagctaaccctcctacctcccctgagccacaagctgctctatgagtccagacccactactctcctgctctacaaccattgctggctcccacttgcttgctgaggaaaattcagaccccaggacccctgtcccttggctcccaccttgtcacctccttccctcagtggccccatgttgcttgctccctgtccccagcggatgtcccatactttattgtaatttttctcatgtggcttgctctgggccatgtccttccccctcacgcccttccctgtcagggcaggccacccactgaggtccacttccaggggccgagtgcgatctcctgccgcggacggcaacattctgctgtttcctcttagggtacaggtgacctgcctctggggagccctttgctcacaggaagatgttatggggcacagctgagtcagaggtgcctactgggtgacagagagaaaagaaagcaagaggtgttaaaagagggagcacagtggctcacacctgttatctccgtgttttgggaggccaaggcaggaggatcacttgagccccaggaggtagaggctacagtgagccgagatcacaccactgcactccagtctgggtgacagagcaagatcctgtctcaaaaaataaataggctgggcgcagtggctcacgcctgtaatcccacccctttgggaagccaaggtgggtggatcacctgaggtcaggcgttcaagaccagcctggccaacatggcaaagcccctcctctgctaaaaatacaaaaattagc

SEQ ID NO: 81930 - DNA, 1069 bp, Homo sapiens
agatagcagagaactcagaaccattccacgcaaagaggccccaagcaaaaggctgagagctgttgggcaacagatcctgaggggctgacgtgggcctgtctccacggccaggaggggctcccaccccgagcccagcaggaactctgtgctagtctgcactagtccacagtcctggggccactgccagtgccatgatgcagcccccacgacacagccaccaccatggctatagccagaccctcgggtctgaggccaaggccaaggcagtgctgtatttcttccaactctgcccactcctttcctgggtgggacggctgggaaggctggttccacagttctccccaggtccctgtgagccactggtccccggcccctgctctccttccagcccccaggcaccctgaactgtagggtgcaggacactgaggcaatgtgggcctcccagtgggcagccccacccagggtgtgggaggccatgggccccaagctcccctggggacttctcccactgccccaccctcaggaagccatgagctgtcaccttctctgtaaccaaattcttctctgggggccgcgacacgtgcagaaagcacttcgtgttttctgagggcacctgtggggctgaactacatggagaagccatttcacagggaaggagtcatacaaaagaggccttcccacagggatggcctccaggacagatgctgcccaagcctgtggtcggtggaagatgctgtccctcaccctgccccagactccccaccagccactgaggggctccccagagggcctgcctgtgctgggcccttgagcgggggcagacagaggctctgcctccattctccctccaaggtcccagccctgtgaacaggaaagcaccccaggaggagagcaggcaaggcgtctacaagcctcagcctccccaggaatcgcagggctctggggagcggcactggttctcacctctcactacgtaaatgcgtccactcaccttgccaaggcggcttcctaagctcctcccctgtggcccacatggaggggtggctgctggtcagggccacgcccccca

SEQ ID NO: 81931 - DNA, 1094 bp, Homo sapiens
ccagcccttctgggattttcacatccacagagaatgggtgctggcagccaacggcaacgaggagaaaagctgaccgccttctcagatcaggatgaggtgtttttacaccaaccccgaggatctgcagccttctcaggttaaattaaacctgtcacagacacaggaagggaaaagagcacataacaacaattatattgacatctaagccaggtcacatgctctgatttggctgaaattacaggataaaggaaaaatcctataggcaccatggctggaaacaaatggcctcaaaggaacgctggtggccgtggctttgtgcaacgacagccagtgttgtgtgacccagcgacgtgcaggccagggagggtacccttctactgatcaagagggaaagcgggaaggacgcacagctgtggtttccaacctgcacggaggcacccccatgaactcacagagcaccatcagatccttctgaattttgaaggaagcaatgatactctgctctgctcaaggccattcatggtctcaacattaacgttaccttgctttatagggtatcttccctctctctgccaggctgggttgtggcagtcactgaacaagcaattactgtgaaggtcgacgtggaaaaatgaggcaatgagggtggcggtgttctaccagattccaagttgaagaggtgctcgacaggcacacacatcccatgactaaacaaataacatgaacatttctctttatgtattacttttctagacatccactataagttgccaggacacaaatgcttattattggggtttacttatttaataaatggaactgtgggggatttctttttcttttctttttttttttttttttgaatgaccatataatctggacttactaactttaggtaacagtaagttaaaagatagaataaggtttcatattacaggaattcaaaaattgaccatataataaatgatgaagaaaactaacaataaacaggacaatgttcaaatagctcattggggccaaaagatcagcgtatatcctgcatcatctttcatgcaatgtctcagctttttttccctcaaacataaaggcagatt

SEQ ID NO: 81932 - DNA, 1520 bp, Homo sapiens
tgcacaatgtagctgacgagggtggcattggacatcttggtctccccaaatgtctggatgttgaaggctgcgatcttcagggacacggccccctgcagtagggccgccagtgccagcagcgcccccagcagcttcatgcccctcatcctgggagagcacagggcacagagacataacagaagtgagacgtcatccctgccacagcactccagccttctggagcccagctggcaggggctggtggagctcaaggtcagggggacgcaggcgggggaaaccctttcctacaacgtccagaaagccaaacagctggcaccacgtagaggaccccgagtcactcctccatccaccagaaaacccgcccgggagggacgctggagcctccgcctcactcgctgctggaggatgagactctaagcctccctccctgctccaaaccggccagtcacccagaggcactccacctggtgctcacctgagatgatggtgatgtcctcagagatgacgagaatgctgtcaagaatctggaatatcctttgatgacaattttctccttttgctgcttaaagaaaaaaaagtagtctatgaagaaaggtctctgaagaagcacttcaaggccctggcagtgctgctgggctccggatcctgcacaggcagtgcgtgtctgggagttttaaaagttcaggcagctgtgaccttccctggggcaaatgtgagccgtcacctgagagtgcagaaaacaatggctctgtgtggctttccgcataggtgggttgctagcacgtgtttctttctgtaagcacaggtttcttgctgctgtaaaaactgcacctgataatcacgtttgcacttagttttaaaatgtctgataacaaggccaaaggttcctatcccgtgtcccttgcacgtgtggtggcccccatcttccaggatagggcagggatgggccaggtatgtgcgggagggtggggctgggctccagtctccctgtctcttgtctgggggccccaaggtcactttggacaaagaggccaaagccacatccaaagttgcaaatggagccccctggtggctgacagccatgactgctctgtggcccaggacacgcctgccttcctgattcatcgccatcaggtgcaggcaactctgcaggaggctggggagctcggaacaagcagtggtgggggcctgcagcaccagcgccgtggggccaggacaggtggggcctgcaaagcccaccccaattgccagccaagcagtggggagccttcttgaggtagacaataggctgtgtgtttaggcccaggggatcccgagtgaccaggtcacaagggcagggcagcagctaaaggccaggcctcaggtccagtaatttcttggttcttttgttttgggtttttattgtttttgagacagggtctcacactgtgttgccaaggctggagtgcagtggcacaatcatggctcattatagcctcaaccgccagggctcagataatcctccctcctcagcctcctga

SEQ ID NO: 81933 - DNA, 1055 bp, Homo sapiens
ttttgtttgtttgtttgttttttgagatggagtgttgctctgttgccaggctggagtgcagtggcgcgatcttggctcactacaacctctgcctcccgggttcaagcaattcccctgcctcagcctcccgagtagctgggactacaggcatgcgcctggctaattttgtattttagtagagatggggttttcaccatcttggccaggatggtctcaatctcctgacctcgtgagccaccgtgcccagccaaattctgttttaaaaacggaaaaatggccaggcgtggtggctcacgcctgtaatcccagcactttgggaggcggggggatcacctgaggttgcagtgagccgagatcgtgcctctgcactccagcctcggcaacagtgagactctgtctcaaaaaaaaaaaaatgaaaaggtgccccatgcccctcataatgggtttctcctcttgcctttcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagtgtgtgttgggctttttttctgggtcctgtggcaggatgggtcctctcttcctgcagttcaactggtgtggggaggggctgctcacttcagcatcacctccactggatagtggtcactgatggcttgggcctgcaggcaagtgggcacagggtctgggctgagcctacctgagctcctgtgtcccatcctcatgtggctgtgcaagggaggacacataccagttggtcactcaggccataggcagcctggaagttaaagggaagagccgagtcgggaacaacggcgcctcggagcagcatccctgcaaccacgatcctgatgggtgttgggaagagaaagtaggttcccctttcacacatgggcctggctcagcacccgcaggaactaaactaaga

SEQ ID NO: 81934 - DNA, 1024 bp, Homo sapiens
tgactctgtcactgagggcagagggaagacgctgggtccaggccgggctctgctgttgggtggggtcccctcccagggcgtggtgcgcgtagctccctggagagcccctgggccacctggggcaggaggtgcttcctaagcccccagagctcccaaaaggggcctgatgggcagagcaaggcctgctctcggacaacccccgagtccactaccgtccctcgggtcagggccagcctggagtgccaggaggccatgggcatcggagggtttgcgcccagttagttgggcaacattgagcccatgggcctggaataagtggtgacctgccccgtcccttctaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggtgggtgagcggtgggtggggcgggctccgggggctgcaacctggggagggtcttgaccttctcagctctgtgctgggtgaacctgcccaagactccgggcagggctgcacagtgggtcagggtcacgggcacagaggccggaccgactgtgacggctgtttcccacttggaggtcacatgtggttttttttgtttgttttttgtttttttgagatggagtcttgctctctcgcccaggctagagtgcagtggtgcgatctcggctcactgcaacttccgcctcctgggttcaggtcattctcctgcctcagcctcctgagtagctgggactacaggtgcacaccaccacacccagcaaatttttgtatttttaatagagacggcatttcaccatgttggtctcgaactcctgacctcatgatctgcctgctttggcctcccaaagtgctgggattacaggcgtgagccactgcactcagccacatgtggatttctt

SEQ ID NO: 81935 - DNA, 1010 bp, Homo sapiens
gcaatcgtggctcactgcaacctccttaagtgattctcctgccttagcctcccgagtagctgggattacaggcgcccgccaccacacccggctaatttttgtatttttagtagagatggggtttcaccataattgccgggctggtctcgaactcctgacctcatgatccgcccacctcggcctcccaaagcgctgggattacaggcgtcagacactgtgcccagccagagttgtgatttttaacataaagcccaggctgtcattttccgagtgttaccccgaggctgtcccggccacccacagcccaggtcactgttctgggaggtggcaggacgtagaggaagctccggcagtgccgcctccctgcttccctcttagcacacgtgctgggttgaaggccaggcctgaagacaaagggcaggttaatggggaatgttgggtggtgtggagggccgcagccccgggagaagctgactgccgtgtctcccaggtgtggtggacagtgaggacattcccctgaacctcagccgggagctgctgcaggagagcgcactcatcaggtgagcctcgggccgcggggagaggaccctgctggggacaaggcccctacctgctcctttgcccccagagggccctagccgtggcccatggagctgagagcagaggtggtcggggaagcccggcctgcacatgggggccctcaggagccttccaggtgctggcctggcctctgaagcttgtggtccagaagaaggtgggggtggctggtcatggctgaggctggagtctggatagggggaggggccgcagagccagacctgcccacctgtgccccagggttgtgactgcagccctgcagcaggccagccctgtgtggaggggactccagtgtgctggctccaggttctccatcagtagctatcacttccccactctggccccaggctcaccaaatagtctttattcaaaacctcgcttactggctttttttcccctaatgcaagtagtat

SEQ ID NO: 81936 - DNA, 1055 bp, Homo sapiens
cctgtttaattccatgggagcggggctcagagtaaacttaggccaaggcatcaacatggccctgccgggggattcccccctcctgtgcttcggagatggttttctgctcttcttagggggcgcctgtccccctggcctttgtttttgcccctgggcatctggcacccgatttggagctgggccagtcccccacagtgccccaggcctgcttttggggtaagcccagaagcttcttcgaagcccagggtcggtggaggacccccgcccccccgccccccgcccgagggaaccaggagaactctgccgcctgcgacaggctcatcgttcctgatgggcatgtgatggcctgagtggtgcgctggggtcagaaatggggcatttgaggtgtgttgtgtgttgtttgggctctgcctatgaaaccctcgggaaccgctggagtcccatgcagggtatgtcccagtgtcacatccacctggcttttcctttctttgcctgccttagttctggagtgtttgaaatcgccgaagcttcgggagttagaaccgggacaaaaatcatcatccacctgaaatccgactgcaaggagttttccagcgaggcccgggtgcgaggtgagcgggagcccgggcccaggctcactctgggatccatgtgtggcctggaggccaccaggtcagcaggcattttccctggttctacctgcacgtagggtgcacaggcagagccgtgaagggccgagccgctgcgggactgggaggggggctgcccgccagggctgcgtagcatcgagctcctgctgggactgggaggaagctggcctggctgaggcggacctcctcctccttcctctgcgtggcccttggcctttagtgcacctgggggtttggcgcagtcctgtcccaggatgtgggcgtggccttccctctttgtgtcctgctggacactcagggaggccctgagtacccccaggagtcagcccagaaagccatgttccagccacaagctgacattgcagtctcgcagcagccggggcctccacagctctggttctcacg

SEQ ID NO: 81937 - DNA, 1061 bp, Homo sapiens
aaagctgcaataagccgtgattgcagcctccagcctgagtgacagagtgagactctcaaagaaatcctgaaaggaaagtcagcaccttcagtcactttgtgaccggcccagaggaactgcctttgactaaagcagaaactctttatgctttgagaattgactattctcctctaccttttaacagttattggaagtgcagctgaccagatagatcctgcaggatgagtgtccttcattgtctgtgcctcccatttctattcctgtaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggtacctccctcagtgtccaggcgtgtggcaggcccggccatgcagcaaggacaggatccgccttctagtgatgtctcgggtcccagggacgtactggccgtccgtaccaccaggataactctggctataatttagtgttacagtagcactcattcattatagaaaattttggaaaagcaggtaagcagaaaagaagaaaatttgaaatcaccccatcatccagcaataactactggtaacatcttagcatatggccacacagggttttggtatatgcaggtattaacatatctaaacatatcttatttttaatgtactcttttcatatttttaactgcgttttcccctcaaaatgccgacgaagcagtgctgtggctgctgctgtagccttgtggaaattttaaggctgaaaagttaggccaaagaggatcaggtaggggccctgagagacattgcatccaaagacagctgcctcaggacctgtcatcccagggtcacggcgtcattgcgggggtgtctgtctctgtggagaggtggacagactggcctcggtgggatctgagtattcccttttagggtgctggcttgctctgaaggtcatgccacataaatgaatgcaggcacgcgtgaatgaatggacttgtgaagggatgg

SEQ ID NO: 81938 - DNA, 1050 bp, Homo sapiens
ttttgtatttttagtagagatggggtttcaccctgttggtcacgctggtcttgaactcctgacctcaggtgatccacccgcctcggcctcccaaagtgctgggattatggtgtgagccactgcgcctggccagtataaaatttttttaaatgggcagcataaaaagttaagtgcagtgaactcataggaagagattattgtgaactgctggggccagggaggcctgaatgggagagagggcctgcagccaggccctgcagcaactcggatgggaaggagtcccagctactgagactgcagctgcagagtggaggagctgcatgggcactggcagtagtgggtagggatgtggggggtggaaggggaggggtgtgtggtgtcacattcaaactatcagtgcttcccattttgtgcgaccccaaaccaccagatagtttaacagtaagatcttgtagcctgacattgaggtttgtggtttttcctttagggtgtaggagaaacacaaagacggaaattgtacagctagcgtgtttggtatctggttcaggcagatttattcctctaatggtttattttttttttaatttttaattttttttttgagacagggcctggctgcatctcccaccctgaaatgcagtggcgtgatcttggctcactgcaacctctgccttgcaggctcaagtgatcctcccaagtagctgagactacaggcatgcaccaccacacctggctgtttttttgtagagatggggttttgccatgttacccaggctaatttcaaactcctgagctgaagcgaccccccggccttggcctcccaaagtgctgggattacaggcatgagccactgcacctgagttagtgattaaaagttgttgtagaagccgggcgcggtggctcacgcctgtaatcccagcactttgggaggctgaggcgggcagatcacgaggtcaggagatcaagaccatcctggctaacacggtgaaaccccatctctactaaaaatacaaaaaattagccgggcatggtggcgggcgcctgtagtct

SEQ ID NO: 81939 - DNA, 1906 bp, Homo sapiens
gtccagtcttggtttgcaagagacttgcagcggcctagacggatggccgggattcacaaaggtcgcagacacgggaactgcttcttccccagcgtcgcctccacaccctcgcgtggatactgacatccgccccattccaggaatgcgcacagctaggcgcagccggccagcgtgggccgggggcggcggggccacctcccccacctccgcgcgcaaggcccgtcgcccttgacaacgcgatccaaggtcacggaggtcccacccccaggcccgaccgtccacgagacgggtagtaccccgccacgcgcccgagcaggcagctgcccggacagcccggcgcccgccgtgacgtcaccgccccgcgcccgaggaagccccgccccgcgcagccccgtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggtgagggcgtcctggctggacgggcagcgggcgggccgggccacggagacggcagggacgtccctgtgctccggggagcgaggcgccggcacctgcttcacaggcgtgggaggtccggcgaggccaagcgcggcagacgcgtttactttcgctccgctcctcgccagctccagcttggctgccttttcctcggctggactcccctcgccacccgcccatgggagccctgaaggaggctgggtcttggggggtcgcggggtcgggcggagcggctgcggggtcgtccctcctggagcttcggtccagtcaggtagcgcacgtgcaggtggagccgctgcggagcgcggagtctttgcgggtgcatgttgcggggaatggactcactcggggtgatcgtgctagttccatggatcgtgctttacccctccccgcctcccagtagcgcactgagggttcatttgttaattcgttcattggacgcacatgtgagcgcccgctcagtgcccggcgccgtgcaggttctggggacgccacagtgaacaaaacctatagcagtcatccgggtccccagagcaggtggactcgatgtcgttgacgcagctgtgtcctcggggcctggaattgatggatgcgccaataaatgtttgtaaaacagagagaacgaccctaacctctgctttcccagtccccactcggaggtaacaacagtgaaagtttcggcattgcttcggggctgtacacagtgttatacgtgtaaatataaatgtctgcgtataagtattttttattctaaaaagcctaaaccatgtatgcattgtgctacgttgtacttcagaaaattttaacgctcccagcattctttccacatcttttcatgtcagtgtatacaggtccatgtgccttccagtgaccacacagtattctgtatgatggacgtgtcatttgtttaaacattgtcctattagtggacgcaataaaggttatttcaggttttactttttattacaatgctgcatagaatgggtgagtacttaaatatttgttcacgtgcggtatttctttagccttacataattagaattttagaattgatatttcagagcctatgcatttttgaaatgttagcagatactgccaaattgtccaaaaaggccttatcaatttatatcccctttagcaggcatcaagactgcctattccaaaggtattttcttcaacgctgaatcttatgtcttttcaaaaccagtggtctataaaagataccttgtggccgggcgcggtggctcacgcctgtaatcctagcactttgggagcctgaggtgggcagatcaggagttcaagaccagcctggccaacatggtg

SEQ ID NO: 81940 - DNA, 1667 bp, Homo sapiens
ccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcgactgaggtgggcggctcagcgttggccccacacattcgaggctcacaggtgattgtcgctcacacagttagggtcgtcagttggtctgaaactgcatttggcccactcctccatcctccctgtccgtcgtagctgcca

SEQ ID NO: 81941 - DNA, 1071 bp, Homo sapiens
acgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaa

SEQ ID NO: 81942 - DNA, 1572 bp, Homo sapiens
gaatgaatgaggtttatgttgacattgacccttggagaaaaatagtcaaccgaactgcctttacagtgcacaggaggaaggggatggcattgccttgatgagccatcatattccctggttctttaatgaggcctcaggtttcttttgcagcctcggccctgccctgtgtgtgcaccccaagggagaagtgttgcagggctaatttgcaggcttgcatttgctcaggataaagttcgagccttgcccccaccacacccagctttgtgggcattcattctctctctctggttacttctgtcctggctttagtccttgctcctctgctataactccttaaaggcagggccgatttcactggcacgttcatctgacgtgtgtgcgtgggtcctgcaggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggtacccggcgctgaaggaaggtggtggcttttgtcacaactgaggggaggatatttgtgtgcctttttcttgcattcgcatacttgttaattaccttcacttatgaggattagaaagcagaaaaataaaagcctaaagtgagaacttagaagcattttcttcagctgattgaggctttcccctggccgtctgagagcagcacagttggagctgtttccatcagtgggcattggggcctgtgcatcactgttgcacacataggggctccagcactgtggtggggggtgcacatgtgtgggggtctgctgcactgtggtgggggggcacacatgcatgggactctgccacaccatggtgaggggcacgcttgcgtgggggtctgtcgcaccatggtggggggcacgcgtgcatggccctcatctcactgttgtgctttgcccactcaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgaggtacagacccttctctgagctccattgcccacgtgtcccgctggagctgcagggtggcaggctgggaggcgcgtgtcgactgttaggtccttcctgtggtggtgtctccgttcacacatgcacgtcgacaccacctgcagcacagggcgttggtgggcagcagtgtgggctctgcactctctgcacagtggatgctctggggagctgggggtccacttagactcggagagggaagagaggaagacagaaaatgggacatggggcagtcaggacacaacccgctgatgtaaaaagtgagtcgaggaggcacagggttgccaggccttattccgtgtttggtggccactctgcacatgatgctcatgccctgctgccctctctccttggcgctgcccctga

SEQ ID NO: 81943 - DNA, 1025 bp, Homo sapiens
gctgtgcctaatttataaattaaaattttgtgaccagtacaggtgtataagaaaaaacgcatagaggttgatactgtccatggtttccagcatccactgctggtcttggaacatacaccccgtggataagggggactgctgtatagccagtcctcctcagaatcccgtatttcattcacagaggtgcagttccctagtgagggaaactggtcagaaagcaagtgctccctgctccggggctgactggcccatagggaggactccaggccacggtctgaggaggtggccatgcctccgctcatctgcagtggccagagttagaggagcaggcctggtgtgcagaagcaccttgtcagcaacagcctttgtaaatgtccggctctggcttttgtttcaggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggtagttttccagctccttccagggcgtgtcattcagtgagccgtgttaggatagaccagggctcttaagtgtcccagaggagcctgtgagccttcataggggattaaagtaaatgaaaccacaattaactaaccaaagtagttagttttgttttccattaaactagcgggaaatgaactgttgagatgactgcagtgagcgtgttttgtgtggcgagtctgtgtgggacccgctcttacctaacgcaggtaaacctggggagttgggatgggacagcctggcacctgaacagaggaagtagctctgccacgagggcttcatgtgcagtcaggaatctgggcaagaaggaactaaaagtggcttttctcagtttgccttaactgtggctctctgtgccgagtggtgccattcatccttttgttcagtgacgaaaactgaattccatttaactgattggcagcagggttggtgactggttggt

SEQ ID NO: 81944 - DNA, 1049 bp, Homo sapiens
aaagtaacccagagaacaaggtgtggacgcacacacagacttctacaagtgactctggtcttgtggttccgtgtgctttaacagtgcgccttctttgcctcctagtttcgttgattgcaaggagtgtggccggaagatgcatcagatttgcgttctgcactatgacatcatttggccttcagggtgagttgtttcccctggcctggagggcagttctgcacagagccagtggcggggcagttgcagtggctactgcatctcattcattgttgtcagcaagaattcagcgattaagagagatggcagttggttctaaatttaagttctaagcgtttgtccgctttaggaattgtggaatcaaagcagtctgcctcttcactctttaattttataataatgtgatttaaactgccaacaaactatctgaatgctgcattttgttggtttgacaatttacatcattatatacagtctcatcataccactattattttgcagttttgtgtgcgacaactgcttgaagaaaactggcagacctcgaaaagaaaacaaattcagtgctaagagtaagtttcgggaagctttctgtttcctggactgcacattttagaaacttgtagaaattgtccccattgttctttggttcctctcaacacatggttctgaggttcggttgtcaaagattttcgttagttttttccccagtactttgtatttttcttgtctcatccttaaggagagccaggccagtcatgagggtaagaatgcaagaatgttcttcaggggcttcactgagaataggcagcacagctgtgagtccctgaagtctgtgcttctcagaatggtcatctcagccacggggctgctgagcacagagctcagagcaggactcgcagccttgggctgtggatcttcatcaagtgtaaaacatctcagtccacccttaaagggaatatttggcctgattgttatatgaaagtcagcatttatgatcagcgcatgttttagatgaaaggttagatgtgcagtaaactttgtaaattctgaga

SEQ ID NO: 81945 - DNA, 1126 bp, Homo sapiens
atcacatttcttactctgtatattcatattgataaatgggtggaaagtctttgaccctgactgcatttatgttaaatgtttgtctagaatatggatttggtttcatttgtattgtaacacaattaactgaatgattaacatgaaaaaaaaaaaaacaggaaaaaattaaaatcagttctgggtgctcagcattttcatacatttaaagatctggcttaataccggaaataaaatctctgaattgctgtcaagcataaattttccattttgaaaaataaagctatttcagtttaaattgcttttttaaggccttttgtcagactgttttgttcaagtaaatttttccatctcaaaccctggagttatatttgactttctctgagtaagaacaaaattcagattcctaaatttgggctccatgcaattctagtattaacaactccttgaaaacatttgcctcttggagccggaccgagcctgtcgttgttagtgatgatggcctgtgatgtgtgcaatgagaccgaatgctaatcaatgctttgccttggctttctgctctgtgttgtcttggtgtctgcgtcttacctctgtgtctgtgctatttgttcccttccctgttctctaatcctgcctttccccacctgccccctgttcctttcattgtcctcactgacccatcaatcaaccaacaacgcccccccttcgtcgtggtgctctgccctgctctgattggtggcttcgttgcttgggtggctgtgtgttatgatggaccagttcacccaagtatggccttcttgctgacaggtatcatttctgtgagaagtgtttcacagagatccagggcgagaatgtgaccctgggtgacgacccttcacagccccagacgtaagtaccgtcctgtcattttctctggggtgagggagggtgaccttaaattgttttttcctcttaccaatgactataaggaaggtaccggtgccattttgacttccttgcaatgttttttggttttttgtttttgagacaggttctcattctgtcacctgggtggtgtgcagtggcactatctcgactcactgcagccttgaccacttgggttcaagcgatcctcctttctcagcctctc

SEQ ID NO: 81946 - DNA, 1048 bp, Homo sapiens
taaaagcaaaggatttctccaggattttaaaaccatttagactcacctgtgattacggtgggagtttcatttcagaatgtcttgaacggtcccttctagttggccatagttctgcgtgtttgattgtatcatgaatggggcactcaattaggagttttacttataaaagggaagtattggggattgagggaatgtcttttttgtgtattgttttggttgccactgaattggtttatagtttctgtactttaattccttcttgccagtgatgaccataccctcctgcacacggaagttcttcttcataccggattttaggatatttacaaaatagtgaatggccagaatattgctatagttcattcagggaaaaaaaaaatacatatttaaagaaaaacattaatctgcctcttgcctgtcagagtgttaaatcctgacataatttattaattgagttagtgccaaataaattagtcccagcaagaaaccttcattaatctagtgaatctgtcatgttcctcatcaaccaaacacaaaaaattggctcatcttgagatgtgcatgcactgaagttgtatgctttaaaatttgctgtatgtgtgtggttagtgaaatacaacagacaaaatgctcaatgtattgaattaagattagatttgggacttgtgggggacctgtcctagtggtagtgaactggccacacggtggcccacgcctcagtcttctgtagccgtgtgagtgcgcaagtgagtgagactgcagctgccgcgtcccattctgcacttggtggttcagcctggcgctcgagtcctgtcgcactgtttttaatactaatccttcctggcatcttgtagacatagttttgagcactaaaccgcattcgtgctgccgtcgctacctgacactcattcttctcgcttgtgtgatccacctccacccgcttgtttattcttacggtattcttgtgtactcatcttgttttatgcagcatcagcctgcatttctgttgatttctcatttatgtcctttccaaacatttagtagtttt

SEQ ID NO: 81947 - DNA, 2428 bp, Homo sapiens
acacaccaggctaaatttgtgtttagtagagacgaggtttcactacgttggtcaggctggtcttgaactcctgacctcaggtgatccgccctcctcagtctcccaaagtgctgggattacatgtgtgagccaccatgcccagcctgaaatggctttatttgccacccagtttgatgaatgagacagatttgggagttagctttactttctttttcagccaagtttttaatgttggaaacctttcatggaagaagcaaacttcccagtgttgtattttgcctcacaagctgaacacagttctgacactagtgtgttttcagaagctttagtccttaacggtgatggacgagagcccctcgagtgccttaggagcatcgtggctgggatgtcacagcagccaggattccgttttaaatgtgaggtaggagggatctgagcaccttttacaaagtgtcttttcttgatgttttctctgcagtctttaaaccagaggagttacgccaggccctcatgccaaccctagaagcactgtatcgacaggacccagagtcattacctttccggcagcctgtagatccccagctcctcggaattccagtaagttaattcataaaaatagattataactttgctggtgtgacttctgagtgtccattgttttatctcttgaaattagataaaataatccccctgccttgaagattgttctcctaatataaaaaactgttgtctgttaacagttatcagtgaaagtgtttattttgtttgatttcacctgttcatgaagccctggtccttggaggaggggtgcactgaagcaagggaagcacatgcccctgagacttcactttatatttggggccttgtgtcacttttgtctgaaagaatttgtgaacatgaactgtaaaaaaatatttgggcttctctcttttatattcctggatagccttgcaaaggccatggggacccagccgattctatgtagcagtcattactagctttgtgtttatatttgtcttgtaatttcattttgcttgctaggatcaagagtgaatatctagaaatacacactgtttgataaacttgttcactattttaattcagtggattaaagatctatttttaaaattttttgttagaagtatcttttaacaatttttctttacttttgcctttggagtattataatgtgatcatacctgaaaatactaattacacttttagtgagtaaaatcagttgcgtcagaggttattttcttttcatttcctatttcttactgttgggaatggaagttattttggtgctttctgtttctattattttaaaacaaagctgccagatgagactggcatttggatattgggggattccctatactgagaccatttttttttttttaaggactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaaggtacagttttaagtttttccggaaagtgaattttcctggttaatccagccagaggggtgttatactaatatgagaccacgcctgtatactgggagtgcatatgtgcaatctgctgtctggtgacacagttgatgcctgaagcgatgtgatgggtgatcagagctgggtgtacaggcgcttactgagggaggccatggggaagcgtttctggctgcccctctctgcctgtggtacctgtctgtagtgaatgtctcttagagccagttctatcacatgctatcccaaaatgtctttaaagctactaaaattgttagaaaactgtctaatatactaacagaaataatttactagtctctatagtagactagaacattataagacagtaaatggaatgtatttttatataaaagtatttctcctttatttttgcagtatgagttttccccacagactttgtgctgctatgggaagcagctgtgtaccattcctcgcgatgctgcctactacagctatcagaataggtaagcgtcaagcagcatcctgcattatgtcttagggcaaggcacgttcatctggttatagtctgtgtacattatttctttcctgaagttccaataaaaagtggcccaatttcaggccgggtgtggtggctcacgcctgtaatcccagcactttgggaggctgaggtgggagaatcacttgagcccaggagttatgttatcagccttggcgacatagagaaacccccatctctatttgaaaagaaaaaaaaagagaaaaagtggc

SEQ ID NO: 81948 - DNA, 1055 bp, Homo sapiens
aatagttttcatcttacagcacatagaagggcctagggcagtgctataacttgagcacctaaaatgtgaccagggtggccgggcgtggtggctcacccctataatcacagcactttgggaggccgaggcgggcggatcacgaggtcgggagatcgagaccatcctggctaatacagtgaaaccctgtctctactaaaagtacaaaaaattagccggccatggtgacaggcgcctgtagtcccagcgactcgggaggctgaggcaggagaatggcatgaacctgggaggcggagcttgcagtgagccgagatcgcgccactgcactccagcctgggcgacagagcaagactccgtctcaaaaaaataaaaatgtgaccagggtgaccgaggaactgagttttttattttttgtaatattattcgtttggtaaaatttcagtagtcacaggggctggggactgcgatatgagacagcagcctccaagggctcgagagccgcgtttttgggagatgctggtgcgctgcaacagccctgccgcgtggagcaggtcctcgggccagaggaggggagcggcgcagttcacatacactcctgacttcacttctgcacatatgggatcttcttacagaaaggtgctggtgaagacaggagtctgaaaatgctctcctcggccaggcaccgtggctcacgcctgtaatcccagcactttgggggccgagattgcaccactgcactccagcctgggtgacagcgcgagactccatctcaaaaaaaaaaaaaaaaaaaaggaaagaaaatgctctcctcagcacggaatttgaatagttatttaatgaatgaataaatgatcaaccaaagtgacacttgtttcaggccctgtcactcccgattaccactggggcggtgacagggtctgcaggccttctccgtgcagaggcccagtgatccacgctgtgggctttgtgcgtcctgaggcctctgttaccactcctcagtgctgccactgtggcacggaggcagctacagatcctatataaacgaatgagcacagcta

SEQ ID NO: 81949 - DNA, 1167 bp, Homo sapiens
gtaatcccagcactttgggaggccgaggcaggtggatcacttgaggtcaggagttcgagaccagcctcgccaacatgatgaaaccccatatctaccaagaatataaaaaattagccgagtgtggtggcacacacgtgtaatcccagctactcgggaggctgaggcaggagaattgctagaacccaggagggggaggttgcagtgagccaagatcttgccattgcactccagcctgggtgttagactctgtctcaaaaaaaaaaaaaaaaaaaaaaaaaaaaaaaaacacttttaaatttaggaccataattgcactgactctgtgctgaagcgacttaatgaacaccaagtactttatttcttcttccggaagagaagaggaatcataaatgcaactctgactagaggaaggttttaacaaacctgttttaggcttgtaagagtcttcccgtgaggttgcggtaacataaaggtgtttgatattcatatgttatctgtaatgtttttctcaagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaagtaggccatttattcattaccttattaaagcatgctgcttttccacggtgttaggattccatgtggaggattaaaagctaaagtagaaacataattctatctgcccttttacctttcttgcctgccattccccagactttcccctgcagaaacactcaggctgagcaggacccctgccctgtgcctgtggggctcatggcaggagtgagagatgagctgctgctccgagggcacccaggctgcagagctgtcttctgatggtgctggcaggggccgagttgaaatgtgtctgggtccttgagcaggttaaggagcttggctttactcataaaagtataaagaaccagtgatgtatgtgagtaggagaataaccaaaaaagccataatttaaggaagatggtcattatgacagcacagggtgacttggaggcagaaggtttctgcaggtgcagtgaggaagctga

SEQ ID NO: 81950 - DNA, 2545 bp, Homo sapiens
tcaccatgttagccaggatggtctcaatcgcgtgaacttgtgatctgcccaccttggccttccaaagtgctgggattacaggcatgagccactgcacccggccagctttttatttttttaatggatggtgaagggggtgtggtacgttactcttaggaagagtccgagaaagaagcaccctagatgtggggagggagtgcttctgaatgctgagaaggagaagcatgcaagacagtcctagactgctgagcacttgcagaggctgaaatggggacggcacgggctgctcttggccctaggggttaagcccagctggctggatgtcaacttctggagagagtgtacacacaggtcctgtgccaggttggggtgtcagcagctgtctcaacaaccttgaaaggttcttaagtagagagcctctggtttttggttggttgaagcagtgatttttattttggggcagggagcatttgaaaaccctgtagctcttgaccattgagacccaagcaggaggacatttttccaggttgtgaaacaaggtggtgacattatccagaagactctaaggaaagaggctttgctcaggctttgatttttgaaagaaatcaaggagtcaggctgggcacagtggctcacacctgtaatcccagcactttgggaggccgaagcaggaggatcacttgaggtcaggagtttgagaccagcctagccaacatggtgaaacccccgtctctattaaaaatacaaaatttagccaggcatggtggtgcacacctgtaatcccagctacgcgggaggctgaggcaggagaattgcttgaacccaggaggcggaggctgcagtgagttgagatcacaccactgcactccagcctgggcaacaagagcgaaatctcatctcaaaaaaaaaaaagaaagaaatcaaggagtcagagaaattgagccttgggaaagtggctggatgctgtgttggggattggtccaggacttcagcctggataggaagatgctgctggtgtggggtatgatgcccctgctgtttaccagcagaatattggaatagatgttttctagttatgcacttagcaacctccctaccagcacatctgggtaaatacagatttctttaagtgctgttccttagtaattgtttttcattttgtttaaaaaaattctcaaggagtggggaagcttacattatagactccctggaaagtcttcctggtctgcatcggcactccgttatttgagggtaccatttctaggtagccattgaaggtagtgctccgtgagtcatcctttgagccttctcatgactacagcagcgctaaggcagcaccttccagaaattctctaaagggttctgtcagattctagtgttggtcctaagactaatttgaactggtgcttctttagaactcagagtttacagagtattattggaaattggaaggaactagacaccgcagtctggagacacttactggctgtgaagtgtctttcagtgatgtggtgttcctgtaaactacaggaggctaaggttgaggacggctgacccttgggcacttcttaatgcttaaggtgcttgcaaaattaaaagaacatttggagacttagcacagattctaacaatgaatgtaaacccagcaaggagctgggaatcctcggatgatgggcgtcagctgctccagaggcattaggtatgggtgtgcacagaagcttgccctggtctctggaaacatctcttctgtagcttgtgagggtgctgtcctttcagggcacctcctcaccctctttgttgctatgacactttggtactgtgccctctggctcagctctaccacagcctcgtttaatgtctcacttgttcctgtcttacccaaccttatgccttcatgtcctcgtccttccctggtacccctcaccatgccaccgtcaccacccccacattgatgccgttttctctggatatggagaagtctgttccttcatcatcttcattgattaattgggtgatttcttttcagttttctgttgcctgtgcgttccatcttattttacttaagagtttatttagcaagttgtaattctgttttcctgtgggtgcttttcctaatgaaccgttgtgggtacatttacagggatgaattcatttaaccccatgtccttggggaacgtccagttgccacaagcacccatgggacctcgtgcagcctccccaatgaaccactctgtccagatgaacagcatgggctcagtgccaggggtaagtgttctctttcgctgtgctgcagatagccctccctctcacatggaacattatctaagcagcagaattcatgtcacttgagaatcctgtggttcttgttcctttgaatttgggttatgctttatttctttcatctctcattttaaaaaaattattactacacagaattatttgactgttagttattttattggaataacaaattcataggaatgtgtggctttgtgagaatgtgggagttccaaggctggagaaggcagcctcagatatgtggcca

SEQ ID NO: 81951 - DNA, 1079 bp, Homo sapiens
ctttagaggctgaggtgggaagatcattgagcccaggagttcaaagttgcagtgagctatgatcatgccactgtactccagcctgggcgatagagcaagaccctgtgtcttttttttttttttcttctttttttggtatggagtctgactctgtcgcccaggctggagtgcaatggcacgatctcagctcactgcaacctctgcctcccgggttcaagcaattctcttgcctcagcctcccgagtagctgggattacaggcatccaccaccatgcccagctaatttttgtatttttagtagagacgggatttcaccacgttggccaggcagatctcaaactgctgacctcaggtgattctcccgcctcagcctcccaaagtgctgggattacaagcgtgagccaccgcgcctggacgaaaccccatgtctttaaaaaaaagaagaaaaaaaaaagtagtttgatagatgtgttatcctttcagcgtccaagccatcttcccaacacctgatcccgcagctctaaaggatcgccgcatggaaaacctggtagcctatgctaagaaagtggaaggggacatgtacgagtctgccaacagcagggtaggttgctgtttaccgtgctctggcctctacagcatctgtagtagacagcactacatttgtctgctttgttatctggaaatagtggaatctatgtagttgggacagactcctccccttgaggccactgaccaaggagacttcccagataagacacaaatctcctgcagaactctcttgattagctacattggtgcatggagtatataaatttacattatatccatgggatatatttttcatagtaggtggtgttgtaatattgttagcatcagtgaatattcaagaagttcatttgaatgaaatggaacatgtattaagtacctactatttgatatgtcctataaagtcattgggaattcagcaagaatgtgggcttctggtgtatcaggtatttgcatactacttttgccagtgtactcaatgaggaagttcattagttagaacctacaacacagatcattcagttgctttttac

SEQ ID NO: 81952 - DNA, 1050 bp, Homo sapiens
tcctttaataggaagattgtagacaaattgacctctatatttttttcctgagcttaatttctatgattttattttctgatattgggggtggagacacagaggtgtgtgtcagtgcagctgagtcactcaggagcgatactaatgaagcagaatgaaagtaagaggctgcatgtgggtcatttataactttttcacttagatagcagctaacctccataaacacaccttactttggttacaaagtagagtggggagggtgtctactgattatttgtgcacgttgattaccattattgaaaatatgacactcagagttcctgccgcagtgcttactataactggccagaatcacttatttaaataaccaccaattgtttatatggtggcatgttggttatctgtcatcaaaactttgaagtatatattaaaatttaactgttgattgatttcttttctgtctttaaaggaaataatccaatgaacattccagcaggaggaataacaacagatcagcagcccccaaacttgatttcagaatcagctcttccgacttccctgggggccacaaagtaagaccctgtttcagatctgagtgacagtccaacaggagcatggactgagaaccacacaaaactgattctttctaaatgtgtggcagagaaaatagtttaaatggggtggtgaggggtgaatgctgttttcctttttttctttaattataaatgtagagcagataatagattaaaacatagtttaagttttatttatttacatcacttggctctcctgacttaaacttttaaaagtcacatgtggtggcagaagaaccttactagacaaagtgtgtttgagtcacttcagtagatggatgaagtgtctttatttcctccttagcccactgatgaacgatggctccaactctggtaacattggaaccctcagcactataccaacagcagctcctccttctagcaccggtgtaaggaaaggctggcacgaacatgtcactcaggacctgcggagccatctagtgcataaactgtacgtaac

SEQ ID NO: 81953 - DNA, 1038 bp, Homo sapiens
agcctcactccaaccttaatttcaaacagctcagtcagtcaatcaatcaagtacagtatttcttgaacagcttcatgtagccggagagctcagcatggtgctctgctgcataggaatcccatcagaaggatatgtccatgctgtcattgtttgtgtatgtttcaaggacttgcaattatgtgatttggaagagcacattatagatttattaatcaaaactgaccgaccaggtatcatctctgctccttctcttaagccctctgtacctgtgcaggtgagcagtgaaggacagggttggggtcaacaggagggggctcctctgttcatctcagaggtgtctgctggtccccagagaatcagacgtttcccttgtcatacatttgccactccctggaactgacttcttgaggagtctctaggttttaagacataataatttttttcaagtgttatctgtgagattttatggtctgttgcatgctaagatagaaacttgacttttctttaactttttgttcctcacttactgctaggcagaataaatgagtccttcagcacagttcctttctccctaggcttgtttactgctttatgatattcatgtgtagtattttgatgaaatgtatttgcttctcaatagtttttaaatcattcgtgggcttctcccttttacttacctctcgtttttgtctgtctgtctgtttgtcgttatagccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggtaggtgaaggaactctcaacttcgttcttacttgtccacatgcagcaaagggaatggagtgatggaacccaaggcagttt

SEQ ID NO: 81954 - DNA, 1695 bp, Homo sapiens
ttattgttttttctcttctcccaaagcaaattatgcttatcgtgtgtgaactcttgagttaggaacccagagaggaaaatgtgaatctgaccctacgttggcttaaggttgggttttgaagacaatatatatgttaaaaataacgtaagggtgacctccctcaaaggaccgaggtagagacaagtcagtgcaatcagcattcttttcgaggagaattggagcgcacctgactactttgtagagaaaggtgggacttggtggagcccagtgcaaacagaataacaaaggaagaacatttcagacagtggggacagtgtctgcacagtgcacagcttgtgagggcatgcatttgactggactggggttcctgtgcaaacgaggtgaacagaaaggtggactgtgatgagctcctggaagcctcagggactctgccgagacccacctgtgctcgctctgtggagactgccttaggggccccgggactctgctttttaggcagtgtttcccacaggccagcgctggtcttacctgatgcacacttccttggtcagcacatgctccactctcttaacttctgtgattaatgtctctactgagagaaccttccagaatcacctgtggcgctaatctgaggttctttgaaatgaagcccagaccattgattacctttttggcctgtgttgagttttgtttggttggttggtttgttttgagacggagtcttgctctgtcacccagactggcatgcagtggcatagccaagtctcactgcagcctcaacctctcgggctcaagcagtcattccacttcagcctcctgagtacctgggactgcaggcatctgccaccatacctggctaatttttgtattttttgtagagatggggtttcaccatgttgctcaggcttgtctcgaactcctgagctcaagtgatcttcccaccttgacctcccaaaagtcctgggattagaggcgtgagccaccgcgcctggcctcattcgatttttccttgaattgttttttaaagattctgtaatcactgatctcgagttaaccatcccttatagcaatattcaattttttttgaataattaggacttgccaagataagtatcttatgtcagtcctggcatctgacctccagtaaattcagtgcacagagtggcatggttgactgggctttgggacccgtgagcaggttcccctcttggggcttatgctgcctcacttgtgaagttcttgctgctcaaagtgtaggcctcagggaagccatagaggtgctcccaggttgtaagcaataaagaaattgggcccccatttgagacctcttatattaaaacctgcatttttataaaaatcctgggtgattagtgtgcacattaaaatctgagatgcactgctctggatgccttggaagaccaggtatctgggccagtgctggtgagagggtttgagtcattctctgagagagagaccaggggttttccaacctagagtcccccagggactgttgaagcaagtgtgcagggtcggccccagagccagcctaatgcacgcactgtcccggctgcgtcagccatggccccagctgctgcccggcatctccatgagtgtagctcccactgcttcacctggcaacatgttccatctgtaggtgcctcagattgtttaaaacacctccttttggccggacgc

SEQ ID NO: 81955 - DNA, 1581 bp, Homo sapiens
acagccaagctcagagggcaggcgggctctccgtgtcaggaacggctgtgataatgttggaccctgactcactcactgcctctccctctccctgccccctgcatacatgcacttgaagcagcatggaacagcagagtcactttgttcactgagccaacacgaagacatggtatttcctgacagttactccatacgtgagaatttaaattccatgtcgctataatggcagtgacgtcttagggagggggatagaggggatacttcttttggaattggaaagcccttatcctgaagtaaattttgaaggctctgtcagtcagtctgggtcagtataaaatcccacacagacatttatgaaggtttccctctacgtggagctatggtccccagaactctttgtataactaaacgttcactctgcttcacagtgagagcctctgccctagggctgctgcatcctgatcaccccagtcgttttgccgttgtctaggttgtctgtagccctcggcacggctggttacgcagcgatccctgcttgttgggaggtccgcctggggctctggggctccctgccatttgtaggcttcaggcagtaagaaggatgaacctccctcccgtttttcaaccatcttcctgtcattttagaggtaaaactgtggtctttgggtgtgtcattcagtttcggacagctaggaagtgcccttcagtctcctgtcccctctggctggagctgtacccttagcgacccttccagcacagcacagtcttcctcatcttcctccatctcgtctgtgccatcttgccaccctcccctgttttgtgtattacgtgttcattcctctcattcttcttgatcatccttcctcaagaccccgcagctgcctggagaacatgtgctgcttttctttctggttgtttctgagtggcccagggaaagatggaaaaagtgctttgttcctaagagtactgtggagtggcgtgccagtgacagcccccgtggttttccttttactgagtccagcccacctccctctggcggcgagggagtaggcagcgagctgacgctgaccctgcttcctttaaagcagggtgtccctgtcatagagaagagaaatgccagggtaatggggcctgttatctgcctccctacagaagaaccacaacgagtttcctttaaaagccagtttcctggccaggcgcaatggctcacgcctgtaatcccaacactttgggaggccgaggcgggcagatcacctgaggttgggagttggagaccagtctctactaaaaacacaaaattagccgggcgtggtggcgcatgcctgtaattccagctacttgggaggctgaggcaggagaatcacttaaacctgggaggtggaggttgcggtgagccgagatcacgccagtgcactccagcctgggcaacaagggcgaaactccgtctcaaaaaaaaaaaaaaaaaaaaaaaaagccagtttcctaaaagtcagttaaattattctttgattgactaaaatttgaattaataaacaatttccctggacatttcttatataaagtgacattctggaatcctgg

SEQ ID NO: 81956 - DNA, 1092 bp, Homo sapiens
agtttgaagaggagcaggagagattgaaaaatatttccatatatgtagacccatgcagttcaaacccatgttggtcatgggtcaggtgtattttaaaggagatcccaggtgttgtatcatttcattgcaatatttccactgtgtgttttgaactaatggaaacttagttcaaatctgatggggaacctaacagaaactagatacctatagagtaattaaggattaaactgaaagaattccccttgggtagcagctttggaaggttttgttttccaaatgactttcttcgggtgttggtgccattgttggggcaggagggattgagtgaggagagtggctgagggtggggggaaacagctcgtctacttgcgggatggggtttagggtgaggagagagtggctgctaggagctgcttcatgagccttctgcttggagcatgtgaacctgataatgaaccttgaatttatcattgcaatgagtatttcataggaaactgtgtgagcatttcccaggcccttccttttatattgactgcgtcaccacagctgatgttacctcttttttgtttcagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatggtaagttacccttggccctcagtgttatggctctccggtgggtgctgtggtctgtggatttttaccattctcacagtgaaagtctataactaaaagtgtgtcagtaggtgataggaagagaacccagatttctcatgagtagctctctaaatgagtttaacattttctgtgatgagctagcaacaggagagataggtgaggatgattcagccgctcttcccaggctccttttgttgatggagagaattcacgtgcacgaatcactttacctttctctccagaatcatgagaaccagagacactggcttttcttacacttcctgtttgttagtggcttgatgat

SEQ ID NO: 81957 - DNA, 1019 bp, Homo sapiens
agggttttcctggcccaaagatgtagcacagaggacccattttatagccagactggacttgtgtatctgctgtgatcacacacacccgtttcaccattctgaaaaccaactccgaaggcctgttctcgttctgcccgacttttcagcatgggaaagtagctgtccactcctgtccactccaactggtagctgagatccttgtttggaagttttgaagatagaaagggcactgttcctgctgcctcttccgatgccccctccagccattgctgaccctctttgtgccttgactttggtcacttgttcgtggttctttgaccacctccttcctggctctattcctaggggctgcgtggcatggtggtgctttggcgtgttcattcatttgggtccttccgctgcatccctggtatgttgcaggggatgcagagaatgttccaggaaggtgagaagttttatcctagttttgtgaccaaaacaggttcaggatagattattacaaacatttatgtgacagataatcctctagagccgtgtggtactttgtactttccgtggtacccatgtctgctggagtagatggacagtcacagtctgccttttccctcctctttgttgatcatggtcactcacctacttgccagacagttcagacccgcagccacaggatttaatggatgggctaggctcagcaccaggatttgctgcaggtgcctctttgtattgttcttgggttttgagctgaacttaaagaggaatttcctcatcagagctcacactgcagtcatgttaaggctaatccagtttcacccccattctttcttgggggcagtggttggagttggggaaacctcaggatctggcttcaatatttttcttatcatacacagggactatgcattacatatttttactctctgagtgaagtgatagaaaacagaagtaggttctcaaacagttaattgattgatacgcttggtcacaatgctttttaatgggaaacctgggagagctgtgag

SEQ ID NO: 81958 - DNA, 1025 bp, Homo sapiens
tctgtaaagcattcctttatttcattactgtttaagcatggtcaggaaagaaatcatatgtagtgtagaatgattgctcccaaagctgtctctcacctcctcacccctagtactcactgtcgcagctgctcatcttagtgcttcgcatataggaacttgtttagttctcacgcaacccttagaggaggtgctgtgatctccattttacagatgataaaaccaaggtgcagagaggtttaagtaaatccctagcaagtggtggagtcgccattcagatatccccagagcccacatagttgaccgcaatggcatgttgcctctatggatgaaattgtatttgtggctgtgttccaataagaaaaatttggttttttcagaaagaggcattgggctgcctttggcccacaggccgcactttgccaccctgttttcatagacagatcctgtctctgtcccggctactggcgtgaggccggtgaacttgaaggagacagagttgcgttaagcggggaggtgatgagcccccgtgcaagggtgaagcctctagtgggggctgtggggagcgtctgctgagttctcaggctgatttagtgtgtccctgccctttccggggggccccttcctcacctataaagtggtaggttttagctagtcttatttctccacttgtctttgcaaagcttattactgaacatcatattttggttcctttttgtgtgtttttgaccagcatcagtgacaccccccaaagcccacttcctctgagtggtctgctgtgtattgtggcttgaggcgtgtcttgaggtgtgaggaaaactgctgaagtagtcagctgctgcaaaaatggacttagtgggctcctcggaaccaccttaaggccaggtgcggtggctcacgcctgtaatcccagccctttgggaggccaaggcaggcggatcacttgaggttaggagtttgagaccagcctggccaacgtggtctttagtaaagatggggaaaccccatctctactaaaaatacaaaaa

SEQ ID NO: 81959 - DNA, 1021 bp, Homo sapiens
ccacctcgacctcccaaagtgctgggattacaggcatgagtcaccacacccagcccactcttaactttgtctcttaagtatgtctcttgtaagcagcgtagcattagatcttatttaatttattctgataaccttagtcttttaattgtagtgtttagtttatttatatttaatgttgataattgttgggtttaggtttctcatcttatttgttttctgtttgctgcttctgtgttttgttcctttttttctcccttcctgctcttcttgtagaggcaaattccaacatctctgtcatctctgtatctgtttcatttacagtcttgtttgtttaaatatagaattcctggttatgggtcacatcttcctgctccttggcatgtccagtacttttagactgtgtagtggaaatggtggatgataatgttgttgaatatgggttttattgtcctttattagtttgttttgttctggcaggctcttaattactcagatcagtttgattctctcaaagcttgtttttaaacttaacttagggcaggtcttgaagccctgttccttagacatggccttggggtctcagtttaattcctgggatgttcagcaagatcttgaaactccgactgatcagaacttctatgtctctagcactgtgccacctctggaatctgttcaattcacaattccttcgtagtcctgcacacttagttacagctccagtaagccctaggaggtgttggtgatgtgattgttgtgtgtggtcgcactgggagatactctccattttaatggtgtgaacgtaacattatgatatataatggttgtcccgtagtgactgtgtatttcacactttaaacgttatctctcatcttctgaatcgtctgaggattaagttcactgtagaaacttgggaagtgccacatctaacattcttaatgtaaatgggtccaaatcataacttcaaggaccaacttttccaaaatatttttgctatattttaaaaagagttatatttatacaa

SEQ ID NO: 81960 - DNA, 1004 bp, Homo sapiens
cccggccgaaagtctttcatatttattctgtgaaacagtttaaatcgatttggaattatctattacatgaagaattgagagacttcacccttacagtgatgtgggcctgaagcctttttttccctaggaagtgactgaagatctttgacaatagtgccgggcgtggtggctcacacctgtaattccaacactttaggaggctgaggtgggaggattgcttgagcccaggagttcaagaccagcctgtgaacatagggagaccctatctttaaaaaaaatttaagaattagctggtcatggtggcacatgtctgtggtctcagctactcaggaggctgaagcaggtggattgcttgagcccaggagtgcaaagttgcagtgagccatgatcacaccactacaatcaagcataccaacagagtgagattctgactcaaaaaaaaaaaaaaaatctttgacaactttattgctattttctataaatattggctcttttaggcttttagtagtctcttaggtcagtatcgtttttatttagtaaagtctaaatttgctttgattttgagaaaaactaaaagatacttaacttttaatctttgtttaaaaaaaggataggaggtaggcaagtcacatgttacagattaagaagtggaggctgccagtgagtggcagaaccaggcttgcatccacacggtctggccagaggcctgttaacactaatgcaatgcagcctgttctttcgtaagttttacagtttctgttttagtagaaaattcttttcatctaatctttaaaatttgttaacttaaagctgtgcaaaaatgtgtgcagttctttgtcatttttgatgtttgtgattatttctcttctcattcctaattttttttttttttttttttttttttttgagatgggagtttcgctctttttgcctaggctggaatgcagtggcatgatctcagctcactgcaacccctgcctcccaggttcaagcgattctcctgc

SEQ ID NO: 81961 - DNA, 1073 bp, Homo sapiens
agtgcttttcctattaaaaaattaagaaatattttcctgtatttttctccttattacatgacttttttttttttttttttttttgagatagggtctcagtttgttgcccaggctagagtgcagtagcatgatctcagctcactgcaacctctgcctcctggtctcaggtgatccgcctgcctcagcctccccagtagctgggactacaggcgcgcatcaccacaactgactaatttttgtatttttttgtggagacggggttttgccatgttgcccaggctggtcctgaactcctgagctcaagcgatccacccacctcagcctcccaaactgctgggattgcaggcgtgagccaccgtgtctggcctccttgaatctttaactcaatttattttggcataaggagtgagacacagagatccagcagtatatattttttcttgttataatcatcttagtaccatttatttagtattggtaatccatcttttctcccactgatacgatatgctgtttttggtatacactttattctcttttcaaacatataggatttgggtctaatttctgaactctttttctttagttccattgacctttgcttgttcctgtgccagaaacctattaacctagctgtgtgatgacttttagtatatgacctcactagttatttctcacacaggtggttctcaactctgtctacactttatcagatttatctggagaatttttaaaaatatgatgcctgaaccccactacagagcaattgagttagaatctgggggatatggtagaaacattcgtatagtgtgtagttcctcagatgactttcatggcagccagggttgagaaccccactgtgttagataaatttaggactttttttcaaattttaaaaacaaaaaatctttgggattttggatttataagattcactacaactttataagtcattttaggagggatgtgacattttaacagttttgtgacttcctgagtcttcttatacatataaattatcttttctgggggtcttatgttgcttggaagcatagtatggttttctttatctg

SEQ ID NO: 81962 - DNA, 1019 bp, Homo sapiens
tgaacaccgcacaggcaggaggcatggccaaggtaagtgaactgaagcactttcaatacttcctacctaaccgcgggctttccctccgagtaatgcgtaaaatgggaccacgtggcccactcctgtttttcctcttgggctctccacgtgccactcatgcttggaagagacagatttctttctaggataaagatctctgccccatttctgtctttaaaatgagaattcttaaagaagtaggacagcttgcaggtcaggcagttggaaagtacagggcctaatgtgtccgtgaacctggtagaggttgctttctgcctgtgtactgcccactgaggaggtgatcactggtctgtatgctcctctgtggccatccagtgaagtatctgttggcacagtatccatttcactgaatgagaaagctgtgttccagggttgtcagctcactccctgctatgttaacaaggaagaggtggcagagccggggagaagcacaggcattcgggtcccagaggaaacaccagtgcagtggttcttcaagtggggtcccctggaccagcagcagcagcagcatcccctagaagcttgttagaaatgcagacttctttattgactcagaagctcggcgtggggcctgggctttaagaagcctccagatgggtgctggacacagtgactcacgcctgtgatcccagcactttgggaggccaaggtgggtggatagctcaactctaggagtttgagaccagcctgggcaatgtggcgaaaccctgtctcttggaaaaaaaaaaaaaaaaaaaaaaaaagcagcagcctccaggtggctccaaggtcacgcacatcacacacacacacacacacacacacacacacacacacacacacacacacacacacacacacacacacacacacacacacacacacacacacacacacacacacacacacacggccaagagctctgctagggaaaggcctggactgggatttgcagccaccagccttgcagctgccttcta

SEQ ID NO: 81963 - DNA, 1908 bp, Homo sapiens
cagaacaagggcttgatttagattaggacttagagaaaagggaaaagtaaatgcagagaaattataaatatagtattttattgaaaacagagttgggaagaaaatggccttgggatcactgtccagtttagtcaggttggttgaaaggaataccagtgaaactcaattgcctctcgggctcagctacacagatcttgaaaggaacagattcagctctgtgctgtactgtgtgacttttctcctcctgcagattctatagtaggaaattcttttaatggagattactgtttttctgttctcctagatttggtgtgattttttttttttataagtaaaagttaccccgtggtggacaaaatttttccccgatttgtggatatctttacttaaatctgatttacatattcagaacgtcacctttattgaaaataacaaaaagacataacatattgataggttttctgtgtcattgtggttgttcctctactactgtgggaatcggtttttgtttgaagagcacacctgcccgtagttgaacttctgttgagaagtctctgagggaatcatttgaatgatggcaagagaatcaagtgttttgctttcactgatggctttctcagtcactgaaactttaggggagaacggattctttcccaggaggaagagggtgaattgagatgtttccttgtttggggatgcctgtgttctcgggatgccctccaagccagcgctgtccagtggtcgttattgggagggcggctctacgctgtgtctatatgacacagtactggaaccacgagccacgtgtggctgttgagtacttgaattgtgattagtgtgacttaggaactaaattttaaatgttacctggtttgagtaaatgaagatagccacatgtagttagtcactacggtattggacagcacaactgtaagtacatttacttatcctctttgtctagagttttctttaagatacgtatcacctagatatttatgacaaagttcctttaaaacgatcatcttttaaagatgcaagactccaaattaaaaatgatgaaagactccttcaaaaatattcacggcttaggtcacactgttcaggattattcactaatttagaaaatatttgttatgctgtgatgtaggccctggcgatccagtggggatgtgacaggccccatctctgccctcatgggtggtgatggatactggacaggtaactgcagtcaggtgtgaccttggaggggacatactgtgcattgactgaggcaccagatggggactgagcctgttttgaagggtattggaagtccccgggggctgtgacgttagcactgacacctgagggtgaataggagatggcagatagtactgttccaggcagagggaacagcactcatagcagggtggaggtctggctcttgtgacagtttttgggttatgttcactgggctaccagaatttaggaggcctcatggttttgcttctgagatggtggagactaaaggtgtggttctgccctgcgggggttggtcggcccgggatccagtcttgactcctaccacttcattcttttattcagcaaatatttaagcacattttacgtgtggggcaccctgctgggctgtggtgatgacagtagtggcagaagctgcttctgtcctcatggaactctgagttgtgtggtgtggtgggtgagcagtcccgtggtgcccaccgtggcctatagcatttcacactcagctcgatgtctgactggaaggaagtggatgcctcaggctgggtggtcagggaggcttgttggaggaaggacaccagagctcattgagggtgagtagagcatcagcttgggcatctgaaggcgagataacatcaccaagggccttgaatgtcagacctaggagtc

SEQ ID NO: 81964 - DNA, 1343 bp, Homo sapiens
ttttctaagtctctatctgtaaacaatgcatttacttgaatcgacccaggaacctgccaagcttagtgagtttcagtagcggccttcccgcacatgaatgagatcactaagggggaggtttgtaaccacctgtggtgggggcagccaggagtgtattcttcctcctgggttagggcgtcccccttttccctctggttctggtgttatcctcagcgtgacgtgtgtgggctcgtgttcctgtttacctcagggagaatgagaaacggttatgttaccccatcagtgagttctggctaagtaggaataaaagttgtcatagagacttttaggactaggacatttcatgaccgtgcttcgtttttgaataactgagaggggtgagagcggtggccccattcaaaggtcgtcagggatgaaggtaggcaaggacaagtcatgtgcagggcgccttagagggccttcagaagatggaaagtcgctcctggctgaacattcagatttgattctgtaaacagaattgaacataacttacaaagagactgagtcctgcagttggaagttgatgcttagattagtcgcctgtgttttcacagcttctaagtagtgtgttgtaattgtgtggcaaagtatgtgattacctggggggtccataattgctgacttgtgtttttacttgatgtatttgaaaacagttaggaaaatgattttgccaaagtgtgtcttaccttagttaagatgaaatgtaccttattgtgagtttctgaagattgcaaaagcttgtcagtttagtttttggggtcccattagtgagggcacccctctttaccttactcaaaccagctcttcacatgtattccaagaaactagagggcatgctaagaggtatttctcaacaaatggtttgtgctcagatgctgttgcttgtagctgaggaatttgactgcagactttcccagagccttggtgtcctgattgggcactgtgagagaggggctacagttggaccactctcaatcctgtttgacgctagaactctttttagcctattatgggtccgcagacttcctctgcaaagggccagagagcacgcatttggctttctgagccatatggtctcttgttgcaactactcaaggctgccatttcagcaagaaagtagccataggcgagtgggcctggctgtgttccagtaaaactctagttgtaaagactggcatctgaggacttcgcccatgggctgcaatttggtgactgatataacgtgggacttcattctctgagcacccgttggggagcactggcctaccacggctgcacagacagctttaaggaaaacagcagca

SEQ ID NO: 81965 - DNA, 1697 bp, Homo sapiens
gtccggggcggcgggggcccggggcgcgctgtcacccccacctgaaagagagcgtccgggggtcgtggtcgcggataccgatcgagccgggagctcggagcaggccccgcagcccgttcccctcgccccgcgcgggagggtggaagttcgtcgcaggactgtcactgggcccgagttggtcagcacacgcccggtgcactcggcctccccgcacccgatcagccctcctcgcggggaccctagtggcactccaggagggaagaagtaaagtgcagcgtgtgggtttgtttggtaatgtcctacgcatccatccgcggccgtgtccacacgcgtggccgtccagaggaatgacagcggagggtacctttgatgcttagagaaagcaagatcgcggccaaaggtagggcagtgtgttttctggattggcgacacattgaccaggctgcattcagaggacactcacagcagccgccagcttgcgagttagaaccgaagtttcttggaatgagtgagttccttggaaagatgcttagtgcttattttcaaaactccttgttttgtgtgtgtgtgtgtgtgtgtgtgtgtgcgcgcgtgtgtgtttttagtcaactagtcattccatttttcaaaacccaaacttcgttagcaagatgtcatgaaagttgctgtggtgtgtttcatttccatgtataacttcaaaagaaagttaaacagcaggtttaagttcatttgggctgcaatctccatttgagtttgtgttgctttcacagtgtagatgtacaaagaattaaggaatgtaggaattccaatttttcaaaaaaatggagcaggatactgaataaatcatctttttgtttgtttcctttcattaaacggcttccctggaaactttcttaagttatcatagctgcttaagagaagtatttagttttctattaattcagtaattctgggtcccactgcgctggttcatggtaacatgaactagttgtatttcctcttttagagctctctcctttgccgcaaaaacttgtgtgccgctgcgaacaattccatctccagcgcagcttgcatttctccagtagtcttgcagtggtagcatctgaaaatcagtttctaatgaatgagtccaaattgaattacatcgctgccttcagatttgcactagacacagctgttcaacttgtggaaatagttctgtgaccgaccactagcatattaaaaaaaactgctattgctgttgaaacaaaacctgaattttgtggcttaagtttgaatacaattcctggaatcaagttatgataagcgacgtttaatattaatgtagaagtgaaaagcgatttttaaagatcaatcataaggagattcttatctagttaaaatttgttaaacagtggggaggagtaaatgatgctcatggtatataaaaatcactaatgcttttctttttagctgataaaagttgagtttgacgttaatcttataaaatgaacttattgaagtgagaaatttggaaacagtagtttaaatgccgttgtactgcaaaacagatctccgttgcttcattaatcttgctgtgtttgagtagtcttcagttctgtgagacgtaggtcatacgtggcgagttcagctttgaagcttgtcttctgaaactggtaacctggatggctttgtagctttgctgttgttgaatgaat

SEQ ID NO: 81966 - DNA, 1439 bp, Homo sapiens
acctgtctctagtaaaagtacaaaaataatctgggcatggtggcgtgcacctgtagtccgagctacacagaaggctgaagcaggagaattgcttgaacccaggaggcggagtttgtggtgaggcgagatcacgccactgcactttaacctgggcaacaaagcgagactccttctcaaaaaaaagaaaaaaaaaagcagaaactggttcagccttgtttagaagggcaatttggaaatttctaaggaaattctaaatgtgcaatatttaaaatgactcagcacttccatacgcacaaagataggggtaggggaatattccctgtgacactgtttgtggtaagaaaagacagactcgggcccagttccatcagggggaatctggctaaattacagaatttccgagtgctggaacactgcacagccatgagaaaataatggcactggttcagatgttagcattgtcctgagtgatttcggcaaaaagaactaacccagaatcaggggagatggcgtcttgtcaaacttttttatacaggtagagagtatagaactcataaaagctatttgtaaaatgataagtttattggattagaaatctaagaaccaaggccaggcgcggtggctcacacctgtaatcccagcactttgggaggctgaggtgggcggatcacctgaggtcgggagtttgagacaagcctgaccaacatggagaaaccccgtctctactaaaaatacaaaattagctgggtgtggtggcacatgtctgtgaacccagctactggggaggctgaggcaggagaatcacttgaacccgggaggcggaggttgtagtgagccaagatctcaccagcaacaagagcaaaactccgtctcaaaaaaaaagaaatctaagaaccaaatatatcagagaatgttaaatttcttgggtatgatgatgatattgtagttacatagggaaatatccttattcttaggagatacatgctgaaatatttagagctgaagtgccatgtcagcaacttactttcaaaaagttcattcagcaaaaagccgggtgcagtggctcacacctgtaatcccagcactttaaggcaagctgatcactttgagatcaggagtttgagaccagcctggccaacatgatgaaaccctgtctctactaaaaatacaaaaattagccaggcatggtggcacacacctatagtcccagctattcaggaggctgaggcaggaggatcacttgaactcaggaagcagagggtgcagtgagccaagatcgcaccactgcactctagcctgggcaacagagcaagactcaatcttaaaaaaaaaaaaaaaaaaagatgttaggccaagcacagttcaagcctgtaatcccagcactttggaaggccaaggtgggaggatggcttgaagttacgagtttaagaccagccttg

SEQ ID NO: 81967 - DNA, 1044 bp, Homo sapiens
ttttcttttaatttttttttcttttttgagacggagtttcactcttgttgcccaggctgaagtgcaatggcacgatctcagctcactgcaacctccgcctctcaagtttaagcgattctcctgcctcagcctcccaagtagctgggatttacaggcgtgtgccgccacgcctggcttgtttttctttttctttttttttttgagacagggtctcactctcttgcccaggctggagtgcaacggcgcactcacagctcactgcagcctcaacctcccgggctcaagtgatcctcccatcttagcctcctgggtagctgggaccacaggtgccaccacacccagctgatttttaaattttttatagagatgggatctcgctatgttgtccaggctggtctcaaactcctgggctcaagtgatcctcctgccgcggcctccgagagtgccggggtcacagctgtgatccccgtgcctcgctgttgttctctttctgttgagttggcagtcaggtccttgattcttggtggctgagggtatctcagtccaaggcaagaatcccacagaaagagactgggacaaatgaggccagaaatgggcctcgcccatcactcttttccaaaatgggctttgtcagtcactcttcctatacttgggtcaccaaacctgatcaccactatgtgcaaagtgcagttttagttttcaaagaagtgacactatacttaagaatacttaagaacgttaactgcgttaacctccacgcacacagccatagacaaattcccccgtcagacaggagcccattaggaaatgcccacccctctctgtagcctttgtaaaattaagctgataaaagacatcgctgttgttgaggtttaaaatcaatggataaccaggaaagaatataagaaatcatattaattattctcctgtttacactacacttaaatcatttagctgtcttttttttttttttggaccttctgctgcaaaagagccattctaatgaacttggaccccagggtccatgtgtgtggttattcatta

SEQ ID NO: 81968 - DNA, 1010 bp, Homo sapiens
ttggaaaatcaaatgaggtaatggaaatgaaaagtactacacaagtgtgattattaaagacagttcagtcaataggtgaaaagactcgtgtagatactttatttaacctggaatcaatgtcttatactcagtagacactccttagatgtgagtttaaagatgtcattactcctataataccagcactgtgggaggccaaggcgggtggatcacctgaggtcaggagttcgagaccagtctggccaacatggtgaaatctcgtctctactaaaaatacaaaaattaaccaggtgtggtggcggctgcctgtaatcctagctactcgggaggccgaagtgggaggatcgcatgaacccaggaggtggagattgcagtgagccgagattgcgccactgcactctagcttgggtgacagagcgagactctatctcaaaaaaaaaaaaaaaattaagaagatgtcattttaatgagcagttctttgttaagtaaagaagaagaggaaaccaggaaatatgatagtgcttggccacctcaccaagtgtttgtcttaaaagaagctttcttgattaagtaaaaatttaaaaggaaggaaagaaaaacccaacctcaccgcaacaaactaccctagtctgaggtaattgtgtagtgtaatgtccctacacctgaatttttcatgcacctgcagatttaggggctctgcctatctttgagtataaatgtccactgaattattagcaaaatgatttgttctcagaaaccaaaattttagcctagatgaatgccgccattggagttatttatatgaaaaggcgtgttaagctcaatggtcttctcttctcttctcttgttttcttttcttttggatttgagacagggttttgctctgccacccagcctggagtgcagtggtgcaatcatgggtcaccgcagcccctacctcctgggctcaggtgatcctcccacttcagcctcccaagtagctgggactacaggtgtgcaccatcatgccc

SEQ ID NO: 81969 - DNA, 1030 bp, Homo sapiens
ataagccctggttccttttagtagaaagtggtttttagaaaccaggatctaagtattaggtgtgttcacgctactgggctattacggctacaaggacttctcaagcagcgtagttaggaattttttttttttttttttttttttgagacggagtttcactcttgttgccaagactggcatgcagtggcaggaacttggctcaccgcaacctctgcctcccggttcaagcagttctcctgcctcagcctccctagtagctgggattacaggcatgcgccaccacgtccggctaattttgtatttttagtagagacggggtttcaccatgttggtcaggctgggtctcaaactcctgacctcaggtgacccatccatcttggcttcccagagtgctgggattacaggcatgagccaccgcgcctggcatagctaggaaattaaacatatgcatgtacttccctacacgtacacatatgtttgtacatacacacacgggcacacatgcgtttgtagttctttgtatccatctgtcccgctcgtatctatgtatccattcatctcatataaaaatcatgataccatccaagtcaaatggtttgtttcagctttctcccctttccttggctgtgcccctcttttctaacaataacagtaacagctcttatcatattaactgtttttatttattgacccttgtatgtcaccagtcttctgacatgcaggccatccagtccatgttcctggcccaggaacatggcagccaagggtccccacccccacttcggcccccaacagtggactctcgggatagttctttttttttttttgagacacagtctcactctgtcacccaggctggagtatagtggtgtgatctcggctcactgcagccactaactcctgggttcaagcagtcctcccaccctagcttcctgagtagcagggactacaggtgtacaccatcatgcccgtctacttttgtattttttgtagaaacagggtcggtcttaccttgttgcccaggctggtg

SEQ ID NO: 81970 - DNA, 1055 bp, Homo sapiens
agcccctcttccaagacatgtttactatcgtttacgtgtgacatgtcaaaacatcttaaaactatgccacgcatgtaataggctctcagtgattaaaaaatcagtttgtctcttaaggagaaaagaataacagcatgtgactcttgtgagtccctgacaaagaatctgttgttccccgtgcacttgaagagccgctcatgtcaagaagcaacttgtgattatgcaatgtgtgacttaaggcattgtcagatgcgttcggctgaaacgggaccccgccccagcagtttgccttactaagttaacatggtaggtcagattttagtattgtagaaaaagccacattcaatattctttgagtagcatatttatttcctagggctactgtaccaaagtacctcaaaccaggtggcttcaaacaacagagttacacgctagttgatatctagtgattcaaagaacagaattccacactagttgttatctaggaatgcggagtgagtgatagagggggttttggtggcgttatattctaattttgaagtaagtttaaatttacagagatgctcccaaacagtataaagaattcccaaatactcttcacccagattccctgaattaacattccgacatgtttgtctgtctgtctctccacatacacacatcccttttttccggaataatttgagaatagactgcagagagtgcctctagattctcctgtgtgggtttcctaaaaacaaggacgctgtcccggatagcctgcaccgacctgcccaaatcaggacgtgggcactgtcacaccatgccaccaaatgcagaggccccggagcccgcccaggaccacaggcgccgtctgtgtcaatggctctcgagtctccttcaatctggggctgttccttcgtctctgtctttcacgaccttgacatttttttaagagaacaggccagttactttgtagaatgtccctcggtttgggctggtctcatattccttcatgatgagaatcaggtggtaggttcctggcaggagagtccctgcagggttgtcacgacagg

SEQ ID NO: 81971 - DNA, 1035 bp, Homo sapiens
atctcatgtaaatgttactggacaatatgacccatctctttaaaaagtgaaattgttagtgggaagctgtggctcacacttataattccagcactttgggaggctgaggcgggaggatcacctgagcccaggcatttgagaccagcctgggcaacagcgagacctcatttctacaaataataaaaacattagctgggtgtggtgacatgcatctttggtccaagctactctggaggctgaggtaggaggattgtttgaacctgagaggtggagcctgcagtgagccctgatcgtgcccctgcactccagcctgggcaacagagtgagacctccatctctaaataaataggtaaaggtaaaatcactgctcagtcactagagagaggagagagaaaagtaaatatactcaaggagtgggaaaagctttgaagtggcatatcaaaatgagaaaaataagtgttttttagagagaaaagatttgtggagaattatatattagaactatttaagacttcttaaaacttcacgattatatggttttgtaaggtttttggggattttcataatgagatgtagatggaacgtccccattgcccatcatagactattcaggcaagttcatacccattcctagaatggagaaccgtctcctctgcggtgaagaagcgcccctgttccttaagaggcagcagcaggaggtggaaaacaacatcccgcttgctaaagtcatgggccttagtccaggcgcggaggctcacgcctgtaatcccagcactttgggaggccaaggcgggcagatcacctgaggtcaggagttcgagaccagcctggccaacatggtgagacccagtctctactaaaaatacaaaactgagccgggtgtggcagtgggcgcctgtaatcccaggactttgggaggccgaggcgggcagatcacctgaggtcaggagttcgagatcagcctggccaacatggcgaaaccccgcctctactaaaaatacaaaaattagccaggtgtggtggctcatgcctgta

SEQ ID NO: 81972 - DNA, 1008 bp, Homo sapiens
ccctggtcccctgtggccaggcttgatttgctctctctttggaagccaccttggcacgcaggcactggtggaaaattttggagtacctgctggaggttgaagatgtgagcacgaagaaaccatggtcttgtctcgggagcctcccagactttcccctttacggctggtgagaacgtgaaatggttcacttgctgcagaagacagtctggcaggtccccaaaaggttaagcacggagctaccgtagggcccagccatgccactcctgggtttgtgcctaagaggtgaaaaacacacatccacacaaaaacttataggaatgttcatagcaacattatccacaattgccaaaaagtggaaacagcccaaatgcctgtctgctgatgaacacataaacaaaacaagtaacacatcaacaaaacgtagcacctctgtaggatagcatacgattcagccttaaaaaggaatggagttctgatacatgtgacaacgtggacgaatactgaaaacatgcccagtgaaaaaagccagaccacaaaggccacgtttcgatcgcttgagcccaggagttcgagaccagcctgggcaacatgtcaaaatcctgtcaactcaaaaattagccaggcatggtggcatgcacctgtggtcccagcccctcgggaggctgaggcgggaggatcacctgagcccaggaggtggaggttgcagtgagctgagattgcctgggtgacagagcaatctctgtctcaaaacaaaacaaaacaaaaacccaaatgccacgttttatatgattccatttctaggaactctagaactacaggcaaatccatacacacaaagtagattagtgatggccagggctggggaaactgaagggaaatgggaggtgaccgccgatgggtatggatggggtttcctttcggggtgatgaaaatgttctcgaatgggctatggtgatggttgcacaactctgtgtgcgaaacctccctgaattataaactataaacgag

SEQ ID NO: 81973 - DNA, 1543 bp, Homo sapiens
accccaaacatctacacagaacaagcctccaggtagaggaaaggcagtaaccgctttgctggaatgactgagtggttcattaaatagaggctccggagggtcttgataggctctagcaaaggtggtggccgagagggctgaccagcgcatggtgcctgggaatgtgaatgggcccaggggcgccagagtgtggacagcttgggactgtgggctccgaggtgctgcgctgagggcgtggggcgcagggcagaaacacagaggactgagtgcttaggggaggcccaggaaatgtggggttgaacggcctagttctggcaattgtttttaagctttgtaagatggagatttcaagaagtatatttatcttaataatattgtagctcctggtaattcttatttgattaccatttatacacatggaaaaccagcatgcctgtttctggcaaagctccagggtagtctttgtgcataatttccaggatttttatgtaatgctattaaaatctgttcttttttttttcccccttccaaagcggggaaaaagcagcttttgaatcatttattttcgtgtttgagttgtttgggaaatattaactacattttctaacactctagcctggagaaaggaagaaaccccacatgcgtgtgatttatttccttgtgtatggatattaaatgcaatataccattaaggctatgacactttaagtgaaagtgtttattgcatgttgattcagttagttcgtaccctattgtgttactatttaaagtgtggattgcatcgcattctggaacttcataaatgagttctttttcccataaggaaaggccactgcttctgatgttcattaatgtgatttttgtgtgtgtgaatgagctgcctaaaaactgggtgtggtgagggtggtttctgaaagggaagcacttttatagcatgatcttatttgaaaatttaatttgtttttgtaaattagcttttggtcttaatacatttcctccactaacaagcacttttgggcaaataatttaatctctctggttctgcttttttcatattggtaaaatataaagtttgagatagatatgcttaaaatctccaccattgtctaagtatagctgagattctcacgtgattgggacatagtgctcattcttaatttgaaaagtgtttttttctttgtcctcttgtttcaactacgaactctcatttagacacatttagcatagggaagctccgatttatagagccactaaattgcagggcgtgtgtgagatttgtaacttcataaaagattctttacttcctttaaatataaatacgtaagattgagttctagaagtataatttacacatggtttcctgaggatcacgtttcctgaataaagcagggtatcgttagaggaaccccatttgattttttttttttttttttttttgagatagagtcttgctctgtcacccagggtagagtgcagtggcgtgatctcagctcactgcaaactccgcctcctgggttcaagtgagtcttgtgcctcagcctct

SEQ ID NO: 81974 - DNA, 1269 bp, Homo sapiens
aaaatgaaaaaatttgatgagaagggtggcactgccatacatttttgcaaatctctttaatgtctggattaataaacggttgaagttttttgttttttttttggtggatttttttccctcttgttgcccacattggagtgcagtggcacgatctcggcttactgcaacctctgcctcctgggttcaagcgattctcctgcctcagcctctcgagtagctgggattacaggcacgcaccaccacacccggctaattttttgtatttttagtagaaacagggtttcagcatgttagccactgcgcccgacccacggctgaggttttttgagtgataaaatgtacacaacagaaatctaccgtgttaaaacacttttaagtgtgttcgctgaattttcttaaccgctttggcattcaatttgttgcaatatgttgaaaaatgtgtagaaaatctggctttagttggaagagcattttcatagcctttttatgtgattctggatatttttctttgattctgtagaaacattcaacaagtgagtagtagtttctttttctttttctgagatggggtcctactctgtcacccaggctggagtgcagtggtgctaccatagctcactccagccttgacctcctgggctcaagtgatccttctgccttggcctaccaagtagctgggactacaggcatgcaccaccacaccccgctgattttttattttgagtggtagtttcttaaatgttagttgcaatatggaatctgaaattttattatctttttttgtacactattatattaaatgctgttgggtttttacccaggtgtgattttataacgtcatgcactagtcatttggaaaatattggtctcttgaatgatgcagctcttccacatgttgacgtcagtaaagtctaatagtctgaagatgttgagttcatcacagtggctgatgtaagttttccaaaactctacttgaaaactggaattttttatcattggcggcaaatactgtcagttattttccttgaagcgacagactcattcatattcccaggaatggtctgcccgtactcaagcctgaacgaccgtggtttgtctgtaggtcacgtgtaaataatgtgctaccaaaaaggtggccagttcagcttgcaatccaaacagctgcacagctgcttttctccaggaccgctgtgctttgatgggcagcagcgtcgtcgtaggcgtgcttctcatttcatcactcagactattcagaagacacctactcaa

SEQ ID NO: 81975 - DNA, 1050 bp, Homo sapiens
ctgaccagttgaaaggtatgtgcactgctttacctcggcatcccccctccctgatcctgattgtattaaattaaaaaaaaaagcttccagcctcagtgtctgcagacagctcaggtatctcagaatgccttaccatggggggatctcagggtcagtgtgacttttctttcagcgggtcaaatatcacagatctgttcacactgcagaaagggacgctgtgcagagatgacctagacgcgacctttagaaggaaggagaactttgaacgtgcataaccactggttggctgaaatgtgggggcacgtccggtgaatgtaagggtatggagcccttcagcattcagcactgtttagcacttaaggaaattgcctttgcattcatttggtcaccctgaagtcccatccaaatgtttctctctgccctttttgcgaaaacgtggagaataaaatctttctcctctctaggcctcactttgcttatcctcaaaatagggataggaagtcggcgcagtcctgcaggtctctggagaattagacggagttacttacctctgagtacacactgtcttttatctaggtctttttttttttttaaaaaaagtttgcattttcagctttcagccatcatttgtttaaggatattttattatcatagtatttgccttaagtgaagagcttcatattgagcttctccagccaccaggtgatttggaagggagaaacgtacctgccggagagctggtattcccctccctcatcctctcaggtttggatctggtgcctggtccctggtttgaagctccttactgctattcttgatgtttttactgggctgcttgttttttctaatataggacaaaagtctttgagatctggaaaatgatattaaaataagtaggacgaaaaagaaagattttaagtaatctgctacatttcttcccccacttcctcctttttaaacagtccttatgttttactaaaatcttcaggattgaggggaacatctgttgtggaagtatgtagagaaaataacactgattttttttaaaag

SEQ ID NO: 81976 - DNA, 1059 bp, Homo sapiens
aaaatacaaaaattagggcatggtagcgggcgcctgtaatcccagctacttgggaggctgaggcaggagaattgcttgagcccgggaggcacaggttgcagtgtgccaagattgtgccactgcactcctgcctggacaacagagtgagactctgtctcaaaacaaacaaacaaacaaacaaacaaaagtctctctgaagccctctttacccacacctttattcctaataccccacagtctgggcaggggcccagggtgctacctctctccctgctcaactcctccccacggctccacccacgagctcagttctgctgattgcatcactggtgctgctgttggaacacagcattcagggatgagccaacaaccagtttggtgggtgagtttcaccagcaccctgcaagtggcctgctgtggagcagaaacctctgctggaaagcgccgagccatttcttccatgccttcctcttgctttactgccgtgtcccctttttactggcctcttctttcctggagggtcccatgaagtctttcagttgttgttcataatctaagcccctcaagcatggaaaaggaacctgatatgtattgatcacatgctatgtgcctgacatgctgtgccagatgcttcatatctagatttcatttaatttcatagcaatttattaggtaaaaaagtcagagagctcacagctgagaaaactaaggctggttagggaacatgtggaatattacacagctgttaagaggagagctggcatttgaactctggtctaatcccaaagtccattctaacacccttcacactcagaataaaccctgtgcctgggcaacagtgagacccccatctctacaaaaaattaaaaacagattagcagggcgtggccgggtgcagtggttgaggctgcagtgagccgtgatcaggccactgcgctccagcctgggcgacatagcaagaccccgtcttgaaaaaaaaaaaagaaagaataaaccctgctgctgcagtatttgggtttatcttatacctttgcaagtcagagccttttccttgtgccg

SEQ ID NO: 81977 - DNA, 1075 bp, Homo sapiens
gctcctacatgggaggttgctttctggagaagattgagcgggccatcactcaggagcttccgggcctcctgggtagcctcgggctcgggaagaatccaggtgctctcaactgtgacaaaacagggtgtagcgaaacaccaaaaaatcgctacaggaagcactaggtggtggagcggtccttgggttcctgttggtgaatcagcttgtgtcctaactgtctgagaggtcctggtttattaaccctttgagccacactggcaggaattattacacagtggagagttgggagttcattgaggccaggggtcggggcaggtgtgtgggtctagggaggagagtggaaactgtgaattcctgtgtgcttgtcttgttgcttcaatgaggaggcctgattgaggcaagtcagcctccacctgcttttcctgggtcctgtcttggaaggacagagagcagctaaattctagtgtatcttaaatcagtgagggtcaaataagctaaaagcagctgaaattcctttgttccctgtgagctgggaaaacagcgaaggcctgagtcgtagagattgtcaggtccattttggcttctttccacacccacagtctcgcgtttgttccccagccctcggctgcctcttaactttgggttgactttcaacagtgaatagtctcttgggtctgaatatacctgggtttgtttttgtgtttttgagacggagtctcgctctgtcggccaggttggagtgcagtggtgcaatctcagctcactgcaacctccccctcctgggttcaagcgattctcctgcctcagcctcctgagtagctgagattataggcctaccaccatgcccagccaatttttgtatttttagtagaaacgggacttcaccatgttgcccaggctggcctcgaactcctgacctcaagtgatccacccgcctcggcctcccaaagtgctgggattacaggcatgagctgccgcacccggcctccacctgggttttgagccaatcccccggacttgctcctggtttcctcaaggggtggggcagtggtttaggacactcgacaactaagaa

SEQ ID NO: 81978 - DNA, 1056 bp, Homo sapiens
gtggtaggcctataatctcagctactcaggaggctgaggcaggagaatcgcttgaacccaggagggggaggttgcagtgagctgagattgcaccactgcactccaacctggccgacagagcgagactccgtctcaaaaacacaaaaacaaacccaggtatattcagacccaagagactattcactgttgaaagtcaacccaaagttaagaggcagccgagggctggggaacaaacgcgagactgtgggtgtggaaagaagccaaaatggacctgacaatctctacgactcaggccttcgctgttttcccagctcacagggaacaaaggaatttcagctgcttttagcttatttgaccctcactgatttaagatacactagaatttagctgctctctgtccttccaagacaggacccaggaaaagcaggtggaggctgacttgcctcaatcaggcctcctcattgaagcaacaagacaagcacacaggaattcacagtttccactctcctccctagacccacacacctgccccgacccctggcctcaatgaactcccaactctccactgtgtaataattcctgccagtgtggctcaaagggttaataaaccaggacctctcagacagttaggacacaagctgattcaccaacaggaacccaaggaccgctccaccacctagtgcttcctgtagcgattttttggtgtttcgctacaccctgttttgtcacagttgagagcacctggattcttcccgagcccgaggctacccaggaggcccggaagctcctgagtgatggcccgctcaatcttctccagaaagcaacctcccatgtaggagcactgctgggagagcagtttgaaactggaaatgggattgatgccgaagaagtccttataggcctcgcggttgggaaggtcaaatttgctgacattggtctttgccaggatggtcttgaagatgtagaatttatcgggatcttccacaatgtccttaaagaccagttctccatcactgaagaaggtcattttgtccttgtaagtctgcaggtagcggt

SEQ ID NO: 81979 - DNA, 1042 bp, Homo sapiens
tgatgatgatggtgatgatgatggtgatgaccgtgccgatgatgaggatcgtgatgatgatgatgatggtgatgatggtgatggtgatgaccgtgccgatgatgagggtcgtgatgatgatgatgatggtgatgatgatggtgatgaccgtgccgatgatgaggatcgtgatgatgatgatgatggtgatgatggtgatggtgatgaccgtgccgatgatgaggatcgtgatgatgatgatgatggtgatgatgatggtggtgactatgctgatgatgaggatcgtgatgatgatgatgatggcagcaatggtggtgatgatgatgatggtgatgacgacgatgacgacgatggtgatgatggtgagagtgatgatgacaatgatgatgagaatgatagtggtgataatgatactgagttgaatgaactctaggtctgatgtcctataacatttctgacagtctcaaaagccgttttccctggtaaaggtgagagggccacacagtcccaagggggatgaaagttccaaatgttggaggttcaccgtgaccatgaccttcacactgctgtgtgtttccactcctgcgccctgggcaggaagcaaggtgtgtgcatatgtgtatgcacatttatattcaagctcttccctggttttcacaacttagggctgagcttcccctgaacttctgctaaacaatttggagtaaaaaggactgaggataatggcttcttacactgtgacctttctcccaggctaaaaataactgctccaacagaaagtctctcaatgaaacaagctgtcccattgggccccagagctcactccccaggaagcagctgtgccactggacccagttctcctcttggaggcgcagacagaggtgtgggagcctccgattacactcacttccatcgcatgacatctcacttcaatcctgggaaatcaaggctggtgtctttcccacctcccttgcttcttgccgaagcaccctattggccctggagcagggaggccgcagaggacccaggacaccctggagag

SEQ ID NO: 81980 - DNA, 1048 bp, Homo sapiens
atcttaactaattacatttgcaaagaccctgtttccatagaaggtcacattcttcctgggtgtggtggctcacacctgtaatcccagcactttgggaggccaagggggtgcggatcacgaggtcgggagttcaagaccagcctggccaacatggtgaaaccccgtctctactaaagatacaaaaaaaaaaaaattagccagtcatagtggtgcccgcctgtaatcccagctacttggggggctgaggcaggagaatcgcttgaacccgggaggtggaggttgcagtgagccgagatcgcaccaccatactccagcctgggcgacagggcaagactctgtctcaaaaaaaaaaaaaaaaatcacattctgaggttctaggtggatatgaattttagagatacactaattttggggggctttctcctaggggatggtcttccactgggtggagggggtacctgtttccttggtccactttgttccacagctcatgggttgccccccctggctgatctggagctctgcagacacacccgggcaagtgtgttgaatgaacagatggaggactggctcaggcagagaatctcaggaggtagcccggcctagtagtggtggtaggtaggagggtggctgcccgggtggggagaattgaccagaattgcccagttcctagggggtgtgtctctgacgcagggtgaggtagagaggggaaagggatggaggtctgggtcctggctgcctgtgtgatgaaaagagtaagggagcaagaagctggaagcccaggaccagcttactctgtgacctgaggcccagctcttcttctgcacgaggccccagcacgcagtcccctcaaagtcttggccttgggcacagcagccaagcaggagatggtgcaggatgtggaagcacctcctcatctgcagaagctcctcagaggaagaacttctgagtgaactttattttagattcaggggggacgtgtgcaggttttttacatggatgtagtgcatgatgctgaggtttgggcttttgttgatcttatcagcca

SEQ ID NO: 81981 - DNA, 1039 bp, Homo sapiens
ttatttttcttgcacttacccaaggagatcaagagaccgggagtgctctctaggacttgggaagaatctggaaaagaactggagaagtgtcaagtactcaccctgtcctggggagaccatcctggcctcgggctcccaagacaccagcccacctcctttcctgcctttgtttcctttccgaattggtagttaagctggtgagcactccaccaagtccctccttgcttggcgctgtctacacagaggcagagcggctggcctggggtggggcccagcgggagcaccggaacccgggggcagagcaaatgctggttttgtcacaaatcagccgccaagtccctgactatctctgcgtttgtttcttcacccataaaatggggataatgatacttgctctatttccagcatggggctgtttcgtgactataataagaaaatggctatcggatgcttaaaatattttttgataatagatactttctaagcttaaaaggactatgacaagaatgacaggttatcactcttgtgagtatgcggcaacttgatatttgcctccagtttcctgaaatatcatgaaacttgaccaaccaggggaatccatcaacacgcctcccctgctcaggactgttaatatccttgggattctctgtcctcaaagagcttacagactaggaggggagacagcccctgctcatgacatgaatagagaaccatataaggtagacgtaatcagcagctaaaaataagcagcctgagagtgcagagaaagggggagcggttgtcggggcatgcttcctggaaggggggctcgagctgggtttcagagcatgtgggccccaggatggtgacgacagggtctgcggccatggggatggtgaaaacgattggctcagtgttaaatggtgtcaggaagctctcacagcgccaggcttaggtgttggttcctatttgatcttcctgggaccacggtaacaacttgccacaaagtcagtagcttaaagccacagcaattgttttttttgagacagggtctcactct

SEQ ID NO: 81982 - DNA, 1003 bp, Homo sapiens
ctgcacgcagctgactttggttttcattcttctttgtggactggggatgggagtccagcctcaggtccccttcatgatgtgttcctggctgtgaggcctgtgccctctcgtgtcccattggtgggactcactttggcatgaggactcactttggctcaaggtggtgggctggcttctgttctctcccgagtttgctctgggagtcctgtcttctcagggacctcgcccctggcctcacctgtcttcttagagctaaaagttgatcttcagagtctgcctccgccctatttggctccttcattccctcttgggtctcccttccctactcaggctgggcccctgctccgacccctgtccctgctaccaagacactggtcatggggggagctgcagctcattgcagtggaggctggtgactcgcagcacagatgggcactttgctcaagtctgtctgtgtttcagaggattcagaagatttcagctcaaggaagatatctctaagatggaatttcccatttggcaggcaaggtctcacccaaagttcctaaatctcaacacggaggtggtaaatagttcaccggttctgagcgcagagggactgagctacatagcaggggtttctcttctgggtcctgaatgggtgaaataatgaatgaatgaattggagccatggcgagcacggctgctaagcatgatctgcccagtgctcgagaggtcccagtcccctgtgctcatccctagctgggtatcctcagtaggacgtgacaggggtgggtgcagtttagcaaatgggacggatttaactgagtttctagagactgattcatttcctcgatggcggcagcctgtgctgtcatccttctctaatatcagagaagtcctgttccatctattttcagcctccctcatccctctgcagccctgaaggtggttttactcggagtcaaggtcccagctgcccccctaccttggggacatgcctgttgcctgtgacttcctcatt

SEQ ID NO: 81983 - DNA, 1978 bp, Homo sapiens
actcagcttcccagctccaccgcctgagcccaagggatgctccattttatgcctgtcacccacgccctgtgacccatgtcatgtgatcccagggctgcaggggttcgggggaagagaatccagccacggccctgccttctggggcctggcagctgggacagcagtggcgcagcctgagcctctgcacagccttctggggtccgggcttcttccccatcacaccctcctagttgccctggtgactgtgtgacccctctcccccctccaccgcctgctgccacggccggccgtataaatagaggcgaggagcagctgggctctcttggcagtcaccatgagggcgctggtcctgctcggctgcctcctggcctcgctcctgttctcaggacaagcaggtagggcccctcccagcatgacccagcccagactggtcccccacgcttcctccaaggttttctgtctaccatgggttgggtagggggtcggggctgatggcaaaccctggctcttggctggtgtcttcttacccttctcttttccccgggcctggggcctcagagaaagagctgggtgctggagaatagcagcacagttgcggggccctcaggaaggccagaggaagtgggaacggcaaacagagctgagctgtgagccagggtcagagaggagtctggccagtagatgtgggaaagagggccctcaaagtcgagacgggggagcctctgagacggacaaaatagcacagtctgggagctggaggtcgttgaggtgaccctcccacctggtgggatataaggcggaggccccactcgggtaagagaactgggtttgcgtggacagaaggggatacagtgggcaaaggtggggaccgttttgggagcagtgagatagaattggaattggtttgggataagatcggaaatagagttggcggttgggctggaaacagcattggatgcaattcagaagaggaacggggcccgttctggagtagagcctctgctcggggtgggggcttccatcagaaaaggggcttggctctgtgtgctgaggcttccctttgacatctcagcactttgggtagcagaggtggtggcttgggttgcagcatgggggttatctataggctatggaggagatgccagattgttttgccacctctcttgttcctaaggttcctgaggccaggttccccgagggaatgcttttagggaggtgctccggggatccccctaggatccggactgcccaccgagtcttttcatgactcggcagtcttcccccaagctgggctctgagcctaggtccgtacctgggactggagaggcccagagtccagcctctcaggtctttgaggttgaatagggggttgcaggggcacagtccctgcagggagagcaggcagtgggtgggaacaaaagctatttctcggggactcaagatgtaaggtggggggctccagccactgcatgtgctgctgggccctgcccttgtctgtccttgagttaatttgggctctgcagggctgcagcggcttgagtgctgagtattccaggcggctgtcaggcggctaagtatggaaacagccgcgtaattggatccggagccccaagccgctgccaccctctcccttcgtggccgctcctgtgctgccccccagccccagctgctgggctgctacacactgggccccaggaatttttggccttttagggacatcctttatctttcctcccaccgagggaactggtcatctggaatgttctgcaggcctcgctgggggctcttgtcgtggggaaaggacgcaggcaggtgcttgtgcaaaggtcccttctctctgctgtctttccttcctgggtcccacagcgtgcgtctgcccctggcccaacctccggcgtaaagcttccctctgtccctgctcctgctcagcacttgggctgtgggtttcatccactgtggtggattttatcaggactct

SEQ ID NO: 81984 - DNA, 1060 bp, Homo sapiens
ggttcaagcgattctcctgcctcagcctcccgagtaactgggattacaggcatgcaccaccgtgctcagctaatttttgtattgttagtacagacaggattttgccatgttggccaggctggtctccaacccctggcctcaactgatccacctgccttggcctcccgaagtgctggtattataggcataagccaccgcgcctggctggtcccctgccctattttaagagtctctattagggataaacttcatggaaaatgtatgtctgttctaagaatgttctcaagtgtcattaccttgtgctgtatctgtttcctctttacgaggattctcagaagaaattcttgccgagtctcaatagttgaaataatttcactccttccaagcatttggtttgctcttattttaaggacactgaattgggcaggtggtcaagttacacacatgtgagggactgaaatatatggtgtcattttttcccgttagtcttacgaatggttccatactgtgtgccttcctgtttttcttccactagtacttccagttcgtgctttcttgctatattttatagagaaaggccatttctatgtctttctggtactgggtgggttataataaaaacgtgcctttggtgccatgatttgggggtgtctttggccgtgcagcagagcgatgccccagctctgctagatgtttgaagggctattgagtggaagaggggtcccttcctgtgaccttggcccccttatcagttgactaactggccccagaccagtatgtaaagcacatgcaaatcctcaaacagcctcttggagccagctggccatgctgtcctcagcttcagatttttttgtgtttctggctccacggtgttcccccgcatcctagtccatcctcctgtcctttcttgaaccagctgtctgtctgtgctttcctcgatgctgtgtggccttgtagcatttgtcattttcactctgttgagttggccggcttggcctcccttgtcctgcaggtcctgggcagggatggcgttatatcatcctctgcctttgtctccttt

SEQ ID NO: 81985 - DNA, 1040 bp, Homo sapiens
aagccactcaacccgaggtcccggggctggggtgtcgcagagcgtgtgggagcatcggcaccccagggcggggcctcggccccgggggctggaggaagctgacacggagatgcctggcctctctctgccaaaaagcattttttcctttaaatatgttttttaagaacagggaaaattaaacaaaaccccaggttatttcttccctgcccagagccagcctgggattgtcagccttcaatcccctttccttcctctttttgggttttcttctttctcctttaagcacttacatggttgggggtaagactaggctggggcattctgggggcccggaggtctccgttgcttcttggttggggtttgctgctgctgtgcccccctcccccttccccatctcggcactagaattcgccactctcccaccccccagcccccacctctgcctccaggtctcatcttccaccccaaaaatgtctgtctctctctttttgttttgtttgttgttggttttttatttctttttggtttgctttctgtttttgttttgtttttcttttttttctttcttttttttttttttttacaattttgaggtcttcgtgttcaaggagaagctattatattttgttaagaaagtggggagaaaaaaaccaagaggccaccgtgcctttgtaaagaaacaaaataaagtttgtactttgttttttagattctgagtctcctgggtgtgggctggcctgaagaccagggcagggctaccccatctagagtaggggggctccttgggccccccaaagcggactgggtgtgtgtgagcacagttactccctcagcttgtgtgtggtgttgcgatgaaaaattggggtcctcagtttccctgggatgaccctgggtattctgtaaagatggaagatggtgttgaggctggggagtggctctttggtgggcggcaaggagagaaggacaaccaagccaccgattccgaaaacctgggaaaggacacaggtgttcaggggccctgcttggtccctacgctttgg

SEQ ID NO: 81986 - DNA, 1066 bp, Homo sapiens
tacatcttctccctggagcaggagaagaccaggctcttgcagcagaacacacagctcaagcgcttcatccaggtgcgccctgtccttcatggctccctctccctggcatgggcatgccttggacccagccatgggcctgggactcaggtgtggctgcaggccccttcttgcccactgacaagtacttccaggcactttttttcctgccccggcctcagtttccccatcggtcaagtgcggtggagtgggctctggaaggagccaggtgactgttatgtaaagcagcccattctcctggcatttggctggtttgttggacttgcagaaggggctccctaatgaagattcacctgtgttgggcagctttggggggctgcgatggaaccccaatctccgtggtggtaccgaggtgtcaggcacactgaccgactccttggggtccccaggagctgagcggctcgtcccccaagcgacggcgggcagaggacaaggacgaaggcataggctccccggacatctgggaggacgagaaggcggaggacctgcggcgggagatgattgagctgcggcagcagctggacaaggagcgctcggtgcgcatgatgctggaggagcaggtgaggcagcgccctctgctgggcacggcgcgcggtgcagagggcgtggagcctggggtcgcgcctcttgctctgcggccctcggtggagccctatttacaggagcacctactgcggtgccaggcctaggagtggggagcaagccagacacgtctctgcccttgggggccaccgtctgcgttggggtgggggagattagccaaaggatctcaaaaatgtaaccatgctgtgggaggccgaggcgggtggatcacctgaggtcagcagatcgataccatcctggctaacacggtgaaaccccgtctctactaaaaatacaaaaaaaaaaaaaattagccgggcgtggtggtgggtgcctgtagtccccgctgtttgggaggctgaggcaggagaatggcgtgaacctgggaggcagagcttgcagtgagccgagatcgtgccactgcact

SEQ ID NO: 81987 - DNA, 1149 bp, Homo sapiens
ccagtcctggaacagggcaccccgggagggcccctcaggaagaggccggggctgcggcttcgggtggggccggcagcctctgctgagagcccagcatctggaagccatcaggccaggggcggggggagttgcaggggaggtccagggagggggacatgcctcctccaggccacacacaagcccaaccctcgggagcgtggccttgggcccacaaccgctgcctctgcaccctggcccgcagccccgccccctggcgcacacgccccgccctcgtccgaagccacgcccccagccagcagccacgccctcttcccccaggctgccttctcaccgcactggccactgctcctgcaagggtcagcagcgctccccacagcatggtgggagcctcgcttctccggcgcagggtgggtctatctcttggagtgggtgggctgtggggagccgtgtccccaggggttgttggcttggtgtctttttggggagtgagtggtacttgtcttctgtgaagtcttagcctagcggggctggggcttgtggtgggaggcgtggccgtgagggtaggaagggagtggggacgtcttcctcagtcctggggtggcaaagcctgagacgctgaagaggcgctccaggtgcctagcaaatcactcagaagtgttccaggagcggggacagcgtccctgaatgtcgtctgcatcccgcgtgcatcagaatcacaccacgcacgtttctgggccccaccgggcctgctagtcagacgctggggccagcacccgtcgtctgcatagtttctaagctcttggatgttttgatgctcagacacactgggaattctgttccggaggagagactgctccctgtgaggaaagccagggaggggatgggtttttgttgttgttgttgagacaaggtcttgctctgttgcccagactgaagtgcagtggcgtgatcatagctcactgcagcctccaactcctgggctcaagcgatcctcccacttcagcctcctgagtagctgggactacaggcatgcaccaccacacctggctaattttatttttttgtagagacagggtctcactacgttgcctaggctgatctcaaactcttaggctcaatgatccttggccttgacctcccaaagaactg

SEQ ID NO: 81988 - DNA, 1074 bp, Homo sapiens
gaactctgatcgctggggcccggacatctgcattttgaacgaccccctgggcgtggtgtgggggaggtgggcgttctacggcgtgcgcaagtttgggacctgtggcccctttcctgccgcgctgctccaggagcgaaatggctccccagggctggagccacgtgctctgccgcccgaggcagtctgggcggggattgagggaggaggagcccgccggtgtggcacaggctggtggacgctagcgcctgcagaatccggcctggagggaaggttgctgcacacgtgtagacactcctgcccaaccctctgccccgggggtccccaccttaaggctactctgaagttcccagtcaatacctagacttgggccagttgatgggtttggcagctggcagggatgccccgagggctggcccttgcacgaggcccacctggagggcccagtaataataagtaaaaaaaattcttgagctctttttatgttctggggactcactttgctagaattttctcactgagttgtcataatctttctatgagtcaaaagtgtcttttgattccgcttaaagaggcggacacagagactggagaagggaccactacagcaggtggtggaactggaacttgaacccttgtcctggggttgctgctgctgcagggctgggctgggcagcgcggaggtgcagttgagccgctgtgcctactggagaagacattctgggcctgatcctgggcagggttggggggccctctggctgccatgcctgggccttgggtgagtcctctcagggccccctgagattctggcttcaatttatccctgccccaagcgttcctttggagcataccagcagtcccccagggtagctggatcttggtaggccaaggacttgaaggtgtagggccttcgtccagggttggacatggcaacgtccattgcaagacagttgtcagctgtgcattaggcatggagttgggggtccctggatttgtttaccttcagtaggggttgcagggtgaggtgggaagccagtctgggatcaaatgtgttcattaggcaggaccttctggcca

SEQ ID NO: 81989 - DNA, 1109 bp, Homo sapiens
agtggcttctggggattggctggagcccagtcacagcttggagggtgaccggggaaagcccctggcctgggagtctcctgccctgggttcaagtcttggctccaccaccaacttccagtggtccttgggtcagactcctcccctctcccggccttgtctatgaaaccaaggggtcagaccaggtgagctcccagagtccatgagaagcctgggtggaggggggtcagggggaggaaagagggtgtaaatccagcaaaagccaactctcaattatccgagggtggagcccggatgaataactggatgccacagacatcccaaaacctcattgcaaacaatcgtgtgaaccgcgtccccccaaagcttttgtttctgagaaacccagctgcaactgggtagccacagcgatttcttcccccgcctgaactccccttgcagggaggacaagtagagggctgagagtgaacaggccggagggaaaacaaaggtctcccagggccccttcttggggcctggagggaggcctggaccccatttccaaggcccccactctcccctccaccctccttcccggcctggccttggccccgggcggtgggagtgtcctctcaccacctaatcctctcagggtctgggcagccatataggaggaagaatgtgttttcccggcaacaatttcccatgtgtatttctagccacccgctccactcgcctggaatctgaattccccacttggaccagggggtgagggccagtgccggccagggtttggggcaatctctggatgagggagggtggcgacagctgtgactgggggaccagatgtggagctcttgtggggcatcttgggggggctcctggggaggcacttttgtgggtcgcctggcctgacccccagccccagaggctgcctccgaaggttcctgcctctaaggggaggcccaggggtctctggcacctaaggaggaaattgattccatgggagaggccctgtgctgggtggaattggggcgggggtggctgcagagaaaagtgtcccctgaatcccttcctctcctcatggctataattgttactttatttcacagcaggtgactgagaccacaggg

SEQ ID NO: 81990 - DNA, 1005 bp, Homo sapiens
caagcacccccccaaagctgggcagacaggaaaataccagacatagttgtgcaaaggtgcagcagcgggcaggcagcgggggggtggaggccactgcagcaggggcccggagccaccaggatggggaggcctctgtgccaggccggccctgcagctggactgccatggccatctgtgtgagtgtgcgtgtgtgtgccggggctcccggagcccggtgtcaccctccctgctggcgttggagaaggaagtgcctctggtggggcatctcctaggaagcccgggctggtgcaggccagggaagccctccggcccgtcttccagcttcagctctgcctgaattatctgggtgaccttggcaggcccaagttgctgtgcagggaacccccagcctggggccggaaacaagaatcctttaggttaccagtagctggcagcttctttatggcaggcatgaggacaaggccctcccttgcaagatgccctgagtcccagggaccattgccgtggtgtctgttacctacaaggaaaccaaggctcagagacagcagggcctttctgagttcccacagccaggggtggcacagggggctgtaaccaggcagcctggccctggggcacactctgtgaacacgcagaaaaaagatccctggcacatcccatcttcaggtgctttcccgaggaccccacggcagagggcagaggtcagccctggctgggtcacctcggaccccttgtgttcccaccccgggagggggtctgccctcccaaaaggtccgggggtgctggctgagtgccccgtcttgggagggggaggggctgcctactgagccaaaggttcccagggacggtgaatcccccactcttccaggaagtgccgcctgccctggcccctctcctgggatctgctgggccaggcctcaggataagctcctccccctccagtcctgggaggaggcctgtctgcggccagctccttccagggttgatcaggccttcccggggcct

SEQ ID NO: 81991 - DNA, 1096 bp, Homo sapiens
cagggaggctgaggtgggaggatcgcttgagcctaggaggtcgaggctgcagtgagctatgattgtgccacttgcactccagcctgagtgacagagcgagactctgtcagcaaataaaattcagtttcatggcaaaatgaagaatgtgagctttgtcttccccaagagactcatgggaagcagatgcggaatctctgaggaggctgttggctctccccccatgatagctgccggccaggtcgctcggagggtctccctacccaggagacaacctcacactgccccctgctcctgctcctgttagactgtcatgagtacagcccgaggagaagcctggggtctcagtgccacagcacagctcctgtccttccccaggttcctgcgtgaagaccagctgggagcccactgcctgctgccacctccaactccggccccctcaccatgcactccctggacgagccgctcgacctgaagctgagtatcaccaagctccgggcggcaagagagaagcgggagaggacgctgggtgtggtccggccccgtgctctgcacagggagctgggcctggtggatgacagccccacacctggctctccaggctccccgccctcaggtactggccctgggcagggcagggggacttagccctgatccagtcatggtgacagggagaatggccaagtgtgtccaccagcatgtagctgcagcccctctcggcttccggttcatgggaagcccgcacgcttgtccttccatccgcccagcatcgtatgtctgcagggaggtgggagctgcagtgcccagctcacgtggctggcacacgatgcaaactgaggcctctaggcagatctggaacagagctggtcgggcaaccaggcattcagaaggagcggcagtagtcccaggacctgcaccctaggctgtggggtggtgccgctggccaacctgggcagtagaggctgggtctgagcccaggaggtgcctctcagggattcccggtgcttgggcccagggtggtgggcaccacttctgccctgcctccaagagcagagtcacccgaaaaccagattcaccgcttgtctgaaggggaaggcta

SEQ ID NO: 81992 - DNA, 1085 bp, Homo sapiens
cctcccctcgcaccccaggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaaggtgagtgggggccagcaagagtagtgtggagtctggggcaggtcaccccgcatgggctcagaacacttcccatcctccgcagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtgaggtgggggagagaggggtagagggaggactggggtctccagtgagctgagccgtgccccccgccctccctggagcaggtacaagatgctcatccacatccgcacacacaccaacgagaagccacaccgctgtccgacctgcagcaagagcttctcccgcctggagaacctgaagatccacaaccggtcgcacacaggtaagaggccggggccgggcggcttggcccatgaagggggcgctcagctgagaccggctgggcaggtccccagggggaggggactgttaagtaaatcccgggcctcagagataagggttgatgtcatcgcccaggggtcccttttccaatgcagtttgctaggggaagcatcccctgggggtcagacccccacccagcacctgctcttggagcaccaatgccatttcctggttcccgtgggtatcttctgactaatgccacctctgtgatcgcagaggccaggtcggcttcactcctcactacagcccaggcccataccaggacagctctggttgtcagagccacagacataattttacatttcctaatcgctgcataaaacacagcaaaaataaatgggtgaaattaattgtaatatggttcgttgaccccggtacatccaacgtgttatcaattcattattaaagacaaatc

SEQ ID NO: 81993 - DNA, 1086 bp, Homo sapiens
atcctctgtagcagagggtgcagggcgaggctaggcagagctggagtcaaccaggctgagttttcagcctctgtgccctgcctgggggcagatctcatgccatgtgctggggatgccccctgcccccagaattggggcatctatgttcccagggagtgcttggcccggggaaatgttgagtgcatggggtgagacccaggaaggggagagacccctcatggcggcactgcactgcaccaccctgcaggtgagaagccctacgtctgcccctacgagggctgcaacaagcgctattccaactccagtgaccgctttaagcacacgcgcacccactatgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagct

SEQ ID NO: 81994 - DNA, 1620 bp, Homo sapiens
cctccaggaggcacagcagattctcaacgtgtccaagctgagccctgaggaggtccagaaggtgaggccactgggccaccccaaagtttgagagggagaggctgccagggtgggaagagtgaagggaggcctggccagggaggtccgatgtggaggctgcagctgcacccagctcggactccaactttcgggagccactgttgctcgtgaagttttaggcctgaggcaggacagtctagagacaaagagtgccttccagtagcagctcagttgccctccagggtacccgtccccatctctgcctctcagtggccacaacagctgggtgtggcacacagggtggagaggagtcctgttgcctctctcacgtggccccacatagcctgcccaacatctcttgcctgcagtctgcagccctctcacccgtcccctctcctctgcagaactatgaacacttatttaaggtgaatgataaatccgtgggtggctccttctacctgcagtcaaaggtgagtggtctttgattctgggaggaatgaagtcatgggaccccttcttctcacctggggctcaattcctagttgggggagctggccagctaagggcttggcacacagaaaactgtgccaggctttcccatggtgccccagcctcagggaggccccctgaactgccacccctctgactgcttcagctttgcggggtccagccactcaggctgtgtcaccccagatagagccctccctcccagcagctgggacttcgaaggagcaggagcccccatgggtggggtgctagaaacagctctcagctcacagaggtcacagcatgcgctgggccctgcagcccagctctgtctccccaggccaccccgaccctggggtgccactgaaggaagcattggtatccacccactgcccttcaaaaaatggacctgggctgatgggaataggccatcccatgtgggcaaggggtatggggcggaggcttggcctcccggcctgattatccgtgacccactaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgcatttctcgtttgcatgtgtccagattccagaaggcaggttgctcctcctgccggttgcagggctgtgggtgctggagatggggaggcagcagcctttaacagcccagaagggccgggctgggtaaggttggcgggcagccagccagtgggctccagctgagtcctgtcacgtacaggatgcagccgctcctgcttccacagcacccgtgccagggtgaggctccctcccatagcgcccctgcccctcccacggggtggcggtctcctggccccagagctcttgtcggcagccaccctgtccctggggcaggtttgaacctagcacctcagtaatctgggcacagtaccccagaatgtggctggggggagaagggcctttgcccaccactctccaaagccgcagcgggcagtagtgggctgaggacttggaccttgggatgctc

SEQ ID NO: 81995 - DNA, 1110 bp, Homo sapiens
agaatctgctgtgcctcctggaggctgaggccggagaggttggaagcggctgcagaccggtgtccagcgcgtcctcgggcatcagctgcggcccggctggctgtgtggacatgtgggtgatcgctcagtcctcagcagcccacacttcaccctgggccttccgagttggtggctcacccctgccaccagcacaggatgagagacacagggacaggtggctaggagctgcctcttctccaggagtggtttcctttttagggggtagaggctgggaaagtgaggacagacgtgcctcactggagggtaagggcaggatctgaccgctaatcctggctcctggtccccaacctagaccatgagatgaccctgtcccccaacccccatatcccaggggaacagcaaattggggagctttaggctacgatggagactgtatagtggggctgcgggcatgagagggctctgcaggggcccagctgcccacctgtcacctagaccaccaaagccactgccttgggtgacctctcccctttcagtgaccccagaacctagaatcaggagctgctaaacttttcctaaaggctcagagagtagctattttaggctttgcgggctaatgagcctacactggaaccattcaactctgccttgaaagcagcctgtcggccgggcacagtggctcacgcctgtaatcccagcactttgggaggccaaggagggcagatcacgaggtcaagagatcgagaccatcctggccaaaatgatgaaaacctgtaaaatacaaaattactaaaaatacaaaaatcagctgggtgtggtggcacatgcctgtagtcccagctactggagaggctgaggcaggagcattgcttgaacccgggaggcagaggttgcagtgagccaagatcgcaccattgcactccagcctgggcaacacagtgagactccgtctcaaaagaaaacaaaagggctgggtgcggtggctcacgcctgtaatcccagtacttcaggaggccgaggtgggcatatcacgtgaggttgggagttcaagaccagcctgaccaacacggagaaaccccgtctctactaaaaatacaaaattagccgggc

SEQ ID NO: 81996 - DNA, 1083 bp, Homo sapiens
gggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggccacctcttgtgctgctgtggtctctgggctggctggaaagggaaggggacaggaatgtgggtgacaggggtctggccctgggctcccctttatctcagcctcactctggtcccaaggcccaatcacctgcgcactgctgggagtcattcgctcaccatgcaggttcctggcagtgctctggatggcgggatgctataaaggacaggagagataaggtcttgcaaggaccttcagcttcttacagcctccttatgcaggggaaccagactgcacacgagcatatagagtgtgaagacagcagtaaagaagagaaactggctgggcacggtggctcatgcctataatactagcactttgggaggccaaggtgggaggatcgtttgaggccaggagttcaagaccagcctggcccacatggtaaaacgctgtctctactaaaaatacaaaaagtagccaggtgtagtggtaagcgcctgtaatccaagctacttgggaagctgagggaggagaattgcttgaacccaggagtcagaggttgcagtgagtcaagatcctgccattgcactccagcctgggtgacagagcaagactcagtctcaaaaaacaaacaaacaaacaaaaaaacctgtgggacaggaagcaactgggatgcagcgaggcagggaattcagggcctgagaaggtgactttcagctaagagccaagacttgaaggctgatgaggagccagccagggagagagcc

SEQ ID NO: 81997 - DNA, 1048 bp, Homo sapiens
catagcaagaccccatctctacaaaacaaacaaaaaattgcactagataaggttaaactatatgaacctacaatatgaacctaaaaataatattaaaaaccaaagtaataaacactcagtttatcacttctaattaatttatccaattttactattatttgtgctgaggtcacatgtttctgtgttggagtgcatggaggaaatgcaggatgatgtgctatttacatctcttcccaacaccacattcagggagtggaggtggcacgtagaagctgcccatggtgggagtttgtaaactgtggaaataggaaaacaccacaaatcagggctttccctccagagagcaggttgttcaacatgatcaacacgttactgtccagggacaggccctaggcatggtggtcctaagtgaggggtgccggcaccctggggagactacgtgcccagccatgagctctaggtcccagcggcagctccgactcccttgctcccccagggcctcgtcctcctgcctaagacggagtgcgacgtgcgggaagtggagctgatgcggtgcctgcggctgcgtcagtcctccctggagcctgtggccttccggctgccccgagtccgggtgagggtggggacctgggactcccatgcccaccgccttctcggtgcctagaggggagtttgggtcccgtctgacccagcttccaaacttccctacccattgttcatggggacacctacccccttctgctgagatgctgaaactcatggaagccccaggctggtgggagggtcccaggtcttgccctgtccctccccaacagatgcccgtgtgccctgggcacctggtcaatgtctcaggacagcccgtttctccctctgcagaaagagttcttccaggatgacgtgttcccagacacggctgtgatctgggagcctgtgctcagtgccgaggcctggctgcaaggcgctaatgggcagccctggcttctcagcctgcagcctcctgacatgagcccaggtgcaccgagggactgggtgtggggaggaagcggga

SEQ ID NO: 81998 - DNA, 1055 bp, Homo sapiens
tggggagccccatctccagccactgtggttctgtggctcaggtccttggggacctgtgggggagctgatgccagtcctgggccctccccaggggttcagtcagcaaacggggctcagttcagactcatttcagggcgagaggcagctgtactgttacgaggtggtcccgcagcagccggcgctgagcccaggtaagccttgcttcctcgcccccatcccctaccctcccctcccctgcccatcctgcctgttcccctatggtgtcctcaacagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggtgagggggacttgggcgagggactgcgggggctggggagtcggggggcctgggcctcactagctgcctgcttgtctgcggccaggctgtggagttccacgaggacctgttcccggacactgccggctgtgtgcctgccaccgacccccatagctggtgggctggggacaaccagcaggtaggaccagggctggctcacctctcccagcctccccgagtccctggtagccccgtgtggctgtgtgccaactcagtctggcctgctgggtgccccccatccctacccagttgaccctcccatgggggccctcctgaccgggcagcccatgcccccatctccccactgccggcctccatgcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgtaagtaccagggccgcccccatcctccctcagcgacactgcagtggctgccctgagtgttcaccggctgaacggcctttttttttttttgagacagtgtctcactctgtcacccaagctagagtgcagtggcgcaa

SEQ ID NO: 81999 - DNA, 1052 bp, Homo sapiens
cgcatcctccctccccaggcccaggggaggctagataatggtctggaggggatccagctgggctgctcatcaccagagcctcttcctgcctctgacactctgtttacagaagctccaggccaactcccctgggagaagagagtaaactcaggggactgctccccatcccccacccgcctgccccagctctgttgggtttttgtcaatagctgggcccatcctggactttgctgccccctggactggccctaatggaccctgcttggaaggtcccagcccggccacccctctatgccctcaacacccaaagtacagtctagtgtgaagggaccttggagattttatccaatccccagccctggaggctctcagcctggggaagggggctctaggtcccgctgcctctctccagagcctcacctgtccttggtgcaaaaggcaggcatggggacacctagacccccaggacctcttccttccaccctgcacactccacccctgggccacagcaggggaggcggtcagtgaccctggtgtggcaatcgttaacgaatgggggagaggcagaatggttggcaccaatcggctggcctgccagtgaccacaggggacctcagcagtcctcaggccccagcactgccagcccagggacacaaaggactaggctggctccaggccactgggtttgcagcccaagcaaagccccttccctggcagaggcagagacccggcaccctgcctgatacccgaagctctaagggccctggccagtacaggtccatcccccacctggagggatgggcatcggacgcccaccagccactccccgcccctccctagggctgcatatctgtagcccccagctgtgctttgagtgacaagggtccagaggaccccgggcagcccttctgcacagcagcacctactgccggaccccaggagggaaaagtgacccaagcctgtggcttggctatccccctcaaaggggtttgattcataaaactggtcatgccggaggcccagccgtgggaggaggaagcatgggacggggt

SEQ ID NO: 82000 - DNA, 1052 bp, Homo sapiens; identical to SEQ ID NO: 81999

SEQ ID NO: 82001 - DNA, 1052 bp, Homo sapiens; identical to SEQ ID NO: 81999

SEQ ID NO: 82002 - DNA, 1052 bp, Homo sapiens; identical to SEQ ID NO: 81999

SEQ ID NO: 82003 - DNA, 1052 bp, Homo sapiens; identical to SEQ ID NO: 81999

SEQ ID NO: 82004 - DNA, 1145 bp, Homo sapiens
catctcaaaaacaaaaagaatgtctaggagtgagacccaggcagagctgtattttggagaagctccttgagcgagtcctccgcacagccagggttcagaacaccaggacagagggttgcaaaggggacagtcaggatgtcagctcgtcttcctgtgcagggaggaggctctgtatcctggagcaggtgtggaccagctggcagggctgggagaggggcaggcacagggtcttccctcctccctccacccaggaggctggcccggccccaggtgggtgccttcagtagcaccgtgggtgacttggcagctgccagacctgttagcccagggcagggagaccagtgactaaggccaggccccagctcaagtgagcccctggggcggtgggacgtgccatcgtagtcacaagaggtgcaacctgtcagggaggacacctgtggccctgggagctgtgcagtggctgcagcccaactagaaatgggccagtccagatgccactttcggcacgcggcaggtgtgatgccaccagggctgggccctcacacggggcctcctcactgccctgtccccacccaggggcaagcacccatctagtaaggccctaacctgcaattaaccctgaacttgccagaagaacaccttagtcaccaaggaaggccgccagccctaagcttcctgggcctgggggtctgagaaggaagtggccctggaaggggtcttgcccttctcaagctccccatgccgaaccccccacaatcacccagggttcttggccaacccgtggcagaaatggcgcccctggggtctgtgagctgatcaatgggcaggcgggatggattcagggaggcagaacaggacctggccactgaaccacaaccctgcccccgcactgctctcaatgcccagccgggctcggggcccagggccagcaggggccccagcggccgccccagccccttcccggtgtaggccggctccctcctccctccttaattaaatctctcaggcagcccctgaggaatgtcagaaccttattgcattccccacgaagagtctggtgggggccgtcccgaaccctgaagaataactggcccctcgcctgcccccaccccctgcccaaaaccgaggtggcctgagggagcctc

SEQ ID NO: 82005 - DNA, 1145 bp, Homo sapiens; identical to SEQ ID NO: 82004

SEQ ID NO: 82006 - DNA, 1145 bp, Homo sapiens; identical to SEQ ID NO: 82004

SEQ ID NO: 82007 - DNA, 1145 bp, Homo sapiens; identical to SEQ ID NO: 82004

SEQ ID NO: 82008 - DNA, 1145 bp, Homo sapiens; identical to SEQ ID NO: 82004

SEQ ID NO: 82009 - DNA, 2441 bp, Homo sapiens
tgtggctggcccccatcacctagactcctggggagaccgctggggccgtccccaggaagagccctccccactttggcacccctagaagtccctgagcctcatacggggtgccagcccatccccaggaagcatcctgcccagtggcgcctgcagctcacacaagagccctttgtgctggagtccgggcttccccttcccccacacaggctgtgcaggtagtccagggaacacgaccccgacccagcctgcactccgccccaggctggggggacccgtccatagggctccctctcccccaggtacgtgggttcctggaatgtgaggaggagcaggtggtcccaggacagattagacaagtcactggtgaggtgaccactggggtctgcgggtagctcgaggtgaaggaagaagcccttgtccccggggttgggcccacgcaggccctgcccacgtgtagtatcgcactgccagagtcgtctcccctaggagctaccgaccctgagcccctagccagttagcgacaacaagcacccttcagaggccagcaggctaagcctccccaacctagcggtgtcccccttgctgtcgtgtgccccctcacctccctaaggtgagacccagcctgcctttgccataggtgtctccaggcccacttagctcaggtctgctgagtgaacagcccaggagggcctggcactgagcactggaagaagttagcaccccaaaccccaggcacgcgtccctggcccggccagcccaccccaggggggctcgtgtctgatgacctaaggccctggggccacacccctagccttctcttcccccatgggacccgctccaccctcactgactcagaggacggcgggtgcggcctggcctccagatgtgggctgtgagtgacccccacccaccccatgtccatatggggggtgaggccacctctgcctgaattagccctcccagcagggccagaccagggtcaggaaggatgcagccaggttccagagtgggaggggatcctccacgtggccagcctggccagcctggccaccactgtggccgcagctccccttgggcctcgtttaaggtcacagttaagagcgctcactccaggcaggcggccctgtgctcagaggtgtccaagctgtgaggccgcagacagtgactttgctctcacacctcggtttcttcatctgagtatctgggacacttcagggctgcagtgggggatgcatgtggagtcctcagccctgcaaggccaggtgtgcaggccagctcttaggggcacgtgctggggggtgctcttcaccctgcactggggagggggaccagccatagctctgggctccgtaatctgttgggtctttaatcagcaaggttgtgaagggagaggggatgctgtgggtccatctggccacagggtggctttccggctgacaggtagtgagctgtggaatgtgcgttcctgttagcaggacaggggtctaggtcaggactgtgggctggggtcctgggctgaccatccagcaggcggcagccagcctgcttcccagccccgtaaaatgtgcggtgagctcttttgcctgagccccaattctacccccacatcaaagggaggagggaggaggcagcgctggagctttggaaaaccccagagtttgtaagctacaggctggcagctctgagggcaccgccagggactcctggcactgagaacccatcagccagccccgagaggaacccagcgagggaaggctgactgtggaggggacggtggcaggggacagaggccagagttcctttctcaactgtgggcctcagtttctcacctctggagttggtgcaagcagccctgccccctcaccctctggagttgtagttttctgttgttctgtttgttttcaaatggggaagttcttttaacaagttctgggagctgtcccgcccgcctggggtctgggcgtgtgcttggtgtgtgcgtggggctgggggctgtctacaggtcacacggtggttgccgccgcccacccaccctcccacccggtgatcccaggacctgggctttgatatttgatcactagtcaggcagggaggtgagaccttttcctctgcctggtgcaggaggtgttccggaggcagccctgggattcctgggattcggggacgtcggggggtgggaagatgacgcaagggtctggggcctccgtcctccacccaagttcctcagccttgctgagtgctgctgccggccttgctccctccctggcacagtaactggcatagggcgacagggtccacagcccggccacgacccctacctcagcccccattgtgcagtgggcgctgctcgtggtgctcgtggtgcctgtgtctggggtgacttggtctgtgctcggagcacttgccaagtggtcggtaaacattcactgcggagggcgtca

SEQ ID NO: 82010 - DNA, 2441 bp, Homo sapiens; identical to SEQ ID NO: 82009

SEQ ID NO: 82011 - DNA, 2441 bp, Homo sapiens; identical to SEQ ID NO: 82009

SEQ ID NO: 82012 - DNA, 2441 bp, Homo sapiens; identical to SEQ ID NO: 82009

SEQ ID NO: 82013 - DNA, 2441 bp, Homo sapiens; identical to SEQ ID NO: 82009

SEQ ID NO: 82014 - DNA, 2055 bp, Homo sapiens
cttacaaaaaccaaagtccttgtctctgagtttgaaaaacatcttcccagaataaatgggaaaggatctcttataaatatatatatattttaaaaaagcaaaacatgttcctaaagcatcttcctttccagtttcttttgttccttcgcttcctggggccaagactagagtcacacagccgcctacccgctctccctctgctctttccgggagcttccttcactggcccccagggtccgcctggagtgggagagcccagcagggcccaggcatgcgttaccagcacatggcagggcccgccgtgcccagggactgcacgttgcggagggcagggcggacactgtcctcataggcactcggttctggggacgttagggctcgtcagctgggccacagcatctcacagatgaggagaccgaggtccagagggaacagggcccagctgtggtcacacagccctgtctgcacacatccccgaggttgggactgagaacttacgtggtgtggcagcaggagggggctggccatctcactggctgagagcccggccccagctgccctgtctctctctggcttagatgtagggctttgcgtggaggggtgactggaggccaggccctgggaagcccatgagtggcacctcacactcagacccgctgggcagggcctctccaccgccctctgttgccttcgggcctggctccaaggggaccttcactccctccagttccaggggcccagcccctggccccacctgccctttgtcctgagccgctgctgccatggcccgcccccgccgcacacagtaggctgcccccaccgcagccagcgcggccaggagcaccgcggccagggcgggcgcaatgaggagcggcaggttgccctcgcgggcctgggtgactggggcgtggttggagtggacggctgggggtgtatgggcctccccgcaggcctcctcgccctccggcacccgcccgggccccaaaggcatgacacagacggagtaagtggcgttgggccgcagctgggtgaccgtgtactcagcgagcgaggcaggcagtcgcagcgtcaccagccgcttatcagggcccgataggttgcgataggtgagacggaggctcctgagctgcacggagctcccctggaggtagcgctgcagccccacgcgcagggaggtggggctcaccggctcgatgcccagggtcagggaccgtggtggcctcggcgtgactggtgtagggctgggccgtgtcccctgccccatctggctctcacagtacaggcccgtgaagccttcggggcacaagcacgccaggtggtgccgtgtccccaggtggcatgtgcccccattgaggcaggtggacggtgggcagtcctggggctgggggacaggccctacagtcggtggggcagtggagggcgggctgggggcctcagtggccggctctgtggggctaagccaggtaggagccaagctagaagacaaggctgtgggctcccgcaccacgggcctcgtggtgggcactgtggctgtggtggtggtggctgggcagccaaagtcggcgtagtcaagctccaggagcagccggccagcgttcttgggcgggaagtggcagcgcgtctcctcagggctggccagtgtgacgtggctctcgcgcacccaggggccaaaccagctcagggggcacacgcagttgaaggggttgcgggcagctgccagcagccgcaggcgggggaagaggcccgagaggtcgccaggcagggcctgcaggcttaggttgctcacatccagctcctgcagggcagccaggccggccaggtcctcgggccgcagctgggcaatgcgggtgttgccggccagccgcaggcgcgtcaggccccggaggcctcggatcacaggtggcactcgctccagctggttgtcggacacatccaggtcgtggaggttgcgcaagcggctgaagagcccctcgtccagctgctgcagccccagaccagccagccgcagcgcctccacgttggcagtgtccaggatgccgggctccagggccagga

SEQ ID NO: 82015 - DNA, 2055 bp, Homo sapiens; identical to SEQ ID NO: 82014

SEQ ID NO: 82016 - DNA, 2055 bp, Homo sapiens; identical to SEQ ID NO: 82014

SEQ ID NO: 82017 - DNA, 2055 bp, Homo sapiens; identical to SEQ ID NO: 82014

SEQ ID NO: 82018 - DNA, 2055 bp, Homo sapiens; identical to SEQ ID NO: 82014

SEQ ID NO: 82019 - DNA, 1006 bp, Homo sapiens
accacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttataagagatcctttcccatttattctgggaagatgtttttcaaactcagagacaaggactttggtttttgtaagacaaacgatgatatgaaggccttttgtaagaaaaaataaaagatgaagtgtgtttcttgggctcagccccagggtagaagggctgggtggagggagatgaagaaggagtggccctcgctctggggagccagggcccctcagcagcccctgggcttgggcagccctcccaggtgtcctgacctgggtgccatccaccctaggcttgaatgaggtgaggctgggcccaggtgggagcagggctgcctctggcctcggacaagaacgggtcagggagcctcaccttccccaggccctgtcttctgccagcaggggctctggcccatgtgcggctgggagaggcttgtggcacatgtggggccaggtgagtcccttgtgggttggtctgatgggcagttcactgcctgctttcctccagggacagggccctgggctctctcattccaggcctcatggatggtcccgggagcaagtggcctccgggaccttctctacagcgtcccggg

SEQ ID NO: 82020 - DNA, 1020 bp, Homo sapiens
ctgctgagggctctggcacgaggagggaggaggcgggccgtgggtcatggcgggcagtgggtggtggcagtgggcctgggtggggccccttcttcctgaggcagcggcggcagcccaggtggatttcctgtaggcctgggtcccattaggggagtggctgcggccaggcctgcctcccccggcccgtggctgcatcgtcaaaggggcctttgtgggcctgaggctgctgctgaacacggcggctgctgaagaaatgttttcactgcaaagcaaacctggccgagtgggatggtggcagggggcagtggcgggggggtggcagggcccaaaaaaaggaagccttccctggaacagtgtctggagtgtgccatcagatcagggcttcggggaaggggagaacccagccagggggcgaccaagctgagatgcagcctcgacccgggacaagccccccgactctaggccagggaccaggggcagacgtgggggtgtgcgagcccccatcaccaggtgctgactgcagcaggccctgggccatgtgggtgacacatgctcttgtttcatgcccggcgacctcgtctattgaaaaggagtggccacagggagggaagacaacatgctcacagtaagtggagacaggaccccagcacctgctccccagccacgggtggggctgccggccacgcgggagggcttagggccactgtgagctacagaagcaatacaccctacttctatgggggtagggggtgatacagttcacccagccccctcacaggcattcacacactcatccccgctcaattcacacccagaagcgtggcacccaagacaggtgtatctctgcatctccaagaccaaagcatgagctgttccttcagtgcaggctgccagtccctctcgttatccccccacctccaccctgcgccaagcatggtaccaagcacacaaagtgctgggcagccctccgtggaggctgcctgagcacagacaggaccttggtgttcgaggctggcctgg

SEQ ID NO: 82021 - DNA, 1974 bp, Homo sapiens
gcgggatcttccggggagtccccagaagagctcccacctgagtaccagcgagagctcctgccaagggcttccccgggctgagagccgcccagaggaggggtaggggtcagggtgacagtgacgccctttcccaccctgtcacacccagggaggggctgagaagctggcaaggcccattttacagatgagggaggcaaaggtgagcaagattcggcaccttccctgaagccatatggagggtaagaggcagagtcagggctgccctcagcctcctgcctgctctgggcattggagattcagggaggagtcagtgggacccgccccgccttgaggagtcggagctcccgggccttcagactccacgtctaggatctggccccatgtcccccatcccaggcccggagctgcctggcatcttgtcttctagacctttctaggtcagacagccccttccctgcagggcccccagtggaggcatttgtgtgaagggacctggcaccagtcacttccacccaccacttcctgccttccaggctctgcccccagtgacagggtccccatcccctgaaagcgtctcctgcccggccccagtgtggcctctggaggagttaatgatgcccagacctcacggtgccactggccaaggctgaccctgtaattaccacagttaagaatagcctcgaaggaccagtgaggactggaatttctcaaatcactcccagatgggtggccaggctagggtcctctcccctctgcccccgagccctggcccctgctctgccagcccccatgaagctggtggatgccaaggatgtgtgccagccccccagctgttctgagaggtggcaggtcccctgcacccccaggcgtcctggaagctggagccccccactaactccctggggtgccggggcctctgagcaaatctaggctgagcatggaaagtctggagtgtcatctgtgggcacggctaatggggaggttggcaactgcatccactccaccaccctcgagttcttctgttttacagattttccatcttggcttgggcagaacagtgtgtgcccttatgagagctagaggaggccagggttcgtgcacacaccccgtcccctcctcatcctcacccaggggcctccgctgtggtcccacctatgcccttcccctgacatttgtggagtatctaaggggaagccagccacagtgagaggagcaggggctgggagccaggccagcctcgaacaccaaggtcctgtctgtgctcaggcagcctccacggagggctgcccagcactttgtgtgcttggtaccatgcttggcgcagggtggaggtggggggataacgagagggactggcagcctgcactgaaggaacagctcatgctttggtcttggagatgcagagatacacctgtcttgggtgccacgcttctgggtgtgaattgagcggggatgagtgtgtgaatgcctgtgagggggctgggtgaactgtatcaccccctacccccatagaagtagggtgtattgcttctgtagctcacagtggccctaagccctcccgcgtggccggcagccccacccgtggctggggagcaggtgctggggtcctgtctccacttactgtgagcatgttgtcttccctccctgtggccactccttttcaatagacgaggtcgccgggcatgaaacaagagcatgtgtcacccacatggcccagggcctgctgcagtcagcacctggtgatgggggctcgcacacccccacgtctgcccctggtccctggcctagagtcggggggcttgtcccgggtcgaggctgcatctcagcttggtcgccccctggctgggttctccccttccccgaagccctgatctgatggcacactccagacactgttccagggaaggcttcctttttttgggccctgccacccccccgccactgccccctgccaccatcccactcggccaggtt

SEQ ID NO: 82022 - DNA, 1974 bp, Homo sapiens; identical to SEQ ID NO: 82021

SEQ ID NO: 82023 - DNA, 1974 bp, Homo sapiens; identical to SEQ ID NO: 82021

SEQ ID NO: 82024 - DNA, 1974 bp, Homo sapiens; identical to SEQ ID NO: 82021

SEQ ID NO: 82025 - DNA, 1974 bp, Homo sapiens; identical to SEQ ID NO: 82021

SEQ ID NO: 82026 - DNA, 1047 bp, Homo sapiens
ggggttcctcctggaggagcagggcacggccaggtggggacatgtccagccctttgggcggggacgaaaccaatgggaggcgggggactgagggccagttccaggcctgtccatatacggcctggctgtgctgccgggtctcagagcctcaggggactgacggctgctgaaaactggcagattccatttgtaatagctcagcctgaccccaggagccatagtggccctacagggacccgagaacacagagggaaccgcccctcatcctttgtcacctaagggttcttaaaggggcagaacatgaaaacccagattctctttccctggggtgactcccacccccactccaagccctgctctggggcaggtgccccgtgtcaggctgcaccctcaggcgctggtttccctgggagccccccgggtggggctgagggacaggcccctctgagcccctctctcgccctccctgcagatgcgtgagcgcgaagtgaagctgtgggacacgcggttcttctccagcgccctggcctccctcaccttggacacctcgcttgggtaggagctgcggcacgcaggtgggctggggggctgatgacccaaggcgccgcaggtgagggcacctgatccggcctgtcagtgaggcgggctgatctccggggtgttctggggtacctgatctgggctgcaaggccttgcaacagacacctggccctgtacccccggagcttccagatgtcacgagcagcaggtgctcaggtgcccctctggcccctggtagcagagtgggcccttggtcaccagaggtttcatggctgggggttgacacaggtatgcttggcattcagggagagggtgtgatccagaagtgcaagaatacgcttcatttttctgtggatgttctggcagggctgaggcccagggaggctccaggctatgataggagggtggacgtgggcattgttggacagcctggcagggtgggggtgggggtggaggtggaggtggaggtggaggtgggccttggcttatgcggcccactgaggttta

SEQ ID NO: 82027 - DNA, 1038 bp, Homo sapiens
cccatggcatgcatagtcacagggaatgacacactgatttctctttggcctacatctacctccccgatgtgtttattccacgggcacagggactttccccattttattcaccatgtcatctcgaatagtgtgtggctcaaatacccatatgacgagagaacagatgagtgaggggcactgcttccccccagcacctgccctctatctgagaaccatccggccccactgccagctcctagcacagttctggcccctgggaggccttgtgtgtttcttgaatgaatgagtgacttttggacaagctaagagccacctggtgggctgcacacacgcagatatttgcacaacaaacaccaacgagagggcaggagcctgaatgacactgtgaccctctccgggtgttgagggcagggctggccaatggctcgacccttgtcctgacccgatatcccctcttacgtggagagagggcagtggggccttggttctcaggctccagccccaacttcctgtgccggccacagcctggtgggaagggaacagtgagaaaagcccctcgaaggacgggacctggagccgtttccgatggtctcccacgctggagtcagcctccacgggctggggagggggccccaggccagctcctcgcaggctgcttccctccctcattcattcccaaggagatcgtgggaagttcggaggaagctggccatggtttggggtgagctatttttggtaacagggtccttcgtctcaggctccaggggccagggtgactgggaggagctgtttgcatttcctctggccccctcagctccccactgccagggcccaggaggacagggccccacccaccatgtgagcttccctctcctcccaggggccgggagccttcctgctggcagctccagcacctcgggagggccaggagaggcactacttggcgctctctggacgttgcccagaggtgggtcccaggccctgcctcttgcctggggcagccacagtgatcctcgaaatcccccagtttacacggtg

SEQ ID NO: 82028 - DNA, 1038 bp, Homo sapiens; identical to SEQ ID NO: 82027

SEQ ID NO: 82029 - DNA, 1038 bp, Homo sapiens; identical to SEQ ID NO: 82027

SEQ ID NO: 82030 - DNA, 1038 bp, Homo sapiens; identical to SEQ ID NO: 82027

SEQ ID NO: 82031 - DNA, 1038 bp, Homo sapiens; identical to SEQ ID NO: 82027

SEQ ID NO: 82032 - DNA, 1041 bp, Homo sapiens
acaggcgcgcgccaccgcgcccggctaatttttttgtatttttagtagagacggggtttcaccatcttggccaggctgggtcttgaactcctgacctcgtgatccacccgtctcggcctcccagagtgctgggattacaggcgagagccaccgcgccgacctcagctctctccttaagcgtgttagccttctccaaacctgcagtgaacttgctggttccgaatgggagccgtgctgcccaaaaactaaattagtaaaacttgtgagcgcctactgtgtgtcatgcatgttctagaatatcggggatacagtgatgcctgatacaccatccctgttcgggaggagcaaacaatgactcgagagaggctccttagcaactaacaatgttaaatgctatcacaggaataagcactgttacagtcatacaaggtgaaggagtcattccatttctaaaatgggagagaggaagtttgggatgtcagggcttctaagaggtaagattcaaactgaacatcgatgaaaagtgtgtcaggtagggatggagtattccaagtagcctgaacttaagaaacaaatgtctaagatatgaaagtgtttgccttctttgcttaaaccctaaatttaagagtatgtgatgaggccggtcgcggtgactcacgcctgtaattccagcattttgggaggccgaggtgccggcggatcacgaggtcaggagtgccagaccagcctggccaacatggtgaaaccccgtctctacgaaaaatacaaaaattagccagtcatggtagcacgcacctgtaatcccagctcctcgggaggctgaggcaggagactcgcttgaacccaggaggcggaggttgcagtgagccaagatcgcgccactgcactccagcctgggcaagagaaactccatctcaaaaaaaaaaaaaaaaagaaaagaagtggtggccgggcgcagtggctcacgcctgtaatcccagcactttgggaggccgaggcgggcggatcacctgaggtccggagttcgagaccagcctgacc

SEQ ID NO: 82033 - DNA, 1041 bp, Homo sapiens; identical to SEQ ID NO: 82032

SEQ ID NO: 82034 - DNA, 1041 bp, Homo sapiens; identical to SEQ ID NO: 82032

SEQ ID NO: 82035 - DNA, 1048 bp, Homo sapiens
gagcccatgagggtgtgagtgttgtctctcatctgctacagtattccaggagagttctgtccggtgggaaggcactgctgatcctctctcatttatgtccttataagacactgtcagagtggaagagagaggggatatatttatgatctaaattatgattgtggatcattcaggctgtttttaagtgccatgtacgagtatttatctgtgaacattttcagtctgttgaaagtacgttttcatttaagtcatacattatctcttaaaaatcccaaagagtagggcagaattcgttcagtgagtcctacctatgcttacttggcagagtgcaagtaagtacagtggtgaaagagtgactgaaaatgtgggccagtaccctcctttccctttagagccgagcgtcagttttggtcgttgcaaacaaaagttgacaggctgtcccttggtttctttagtacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggtaaggctctgcccgagactccacctcccacggcttgcaccactgactgagaagagctggttgtggcactgctcccagagaacgtatgctgggaattgggggagttggtgaactcagcctggctgtctttcccccgtgaccctgaggagacgagcctgtgctcctctttccctgataccacaggctcagcaaccagagcacagcagctccgggggcggggcgggggattgcatccagttgtcactttcttctttatttttctaacaattgctttggtaattcaaggggaaataatcttttttaaatgtactgttcagctcccaggagtcttcaggtacttctgtagacaggcggtatcatatttttcagtgtcgtgtggtcaagttgatgatctggagtgcagaagtttgtgtgttctagaaaatcagatgaacagattg

SEQ ID NO: 82036 - DNA, 1016 bp, Homo sapiens
ttcccacctgggacactccgccaggatttcagagtgtcttaaaacaacagcagccacagcagtggagccgcagtcagcagactccgtccgccgctttagagcaggactccctccaagttatctagccgtgaacagatgcaccatttaccctgagctcagacatcgtgctagcgagtggctgtgttagggatctgtcaccagaacacctgctgtgggcgctgagacaatggcaccccagctgcagcccctcttcccatggggtctggggcctctttcctgggactcctggctcagggcagggcaggctgtgcccaggggtccttggttcaggcggcatgtatttcctcctcattgcatcattttgtttttgtttggatcctgggtggagttctcagaacttgagcagccttagattagtgcatggtaattcgtagcaggtgtttggagctgggggccgattttccaataaagtggaggatttggagctccaggggcaggggcaggggctgggatggaagtccctggaatttcactgagctcctgttgctcccaggggactggaattcctctgttaaaaagcagctgccggccgggcgcagtggctcttgcctgtaatcccagcactttgggaggcaggggcaggtggatcacttgaagtcaggagtttgagaccagcctggacagcatggcgaaaccccatccctactaaaaatacaaaaattagctgggtatggtggtgcatgcctgtaatctcagctactcaggacgctgaggcaggagaatcgcttgaacccaggaggcagaggatgcagtgagccaagaccacaccactgcactccagcttgggtgacagtgagactctctgaaaaaaaaaaaaaaaaaaaaaaaaagggcctggcgcggtggctcacgcctgtaatcctagcactttgggacgccgaggagggtggatcacgaggtcaggagtttgagaccagcctgaccaacatggtgaaaccctgtctctactaaaaaaa

SEQ ID NO: 82037 - DNA, 1051 bp, Homo sapiens
acaatttaggtttgaaatatctttttgcaatagataatcttatttacattaatacagaatcattttacattcctaaatcagacactaatagatgctttattttagtgaattataaaggaaaacaaaaaggaaactgttgagaagtgttcttcattaacctgtctaacgacagcccgaagatcctgaaacacatggaaactgcgacatgctaccagcagaggctggggaatgggggttctgctctcactgaatggtggggaaccttcaactgcttagcctgtgctttccttttctgaatcaacatttacaaaggaaaaaacaatgattagcactgaataatttaaacacacttcagaaaatagatgtcaacagtgtaagtgggagaaccaagcccctgactagcaacagtggcagggcttcagttcccaaggcagctgaagtctggccagcacagtgctgcaatgggctgtggctcagcagaagggcaggagccctccatgcctggcttacaacaacaggactcaatagtcagggacaggcggccatcccggatggggtgggagcaaggactgtacatcctgacaaggatcaccacccacacggtcagagcagaacccccagggactctctgggcctctacgtgcctcccaggcaccgactgtgcagctgcttggtaccccgggaataaaaactaactgagcagagcagctgatgcctcggcagggcccctcattaggggaggacggtgctggtggggcctgggggccccacgctcccagtgaagacaacctgtcaggaagaactcattctggaacctcccggaggtttgctgagaaggaaattaatcacttcgtaacttgatgcagcttaaggcttcatttctaagctgtaagcatggcctttaactaagatatccacaatattcaattccaaattagagttttagccctgcaagagtctaaccatctccctctgcctgagccaggggccgtcacctaccaatggacaggaaactgccaccagcctctggggctgcatcctactgcccggg

SEQ ID NO: 82038 - DNA, 1068 bp, Homo sapiens
ggggtaccaagcagctgcacagtcggtgcctgggaggcacgtagaggcccagagagtccctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgccc

SEQ ID NO: 82039 - DNA, 1046 bp, Homo sapiens
ggccacttcacacctgtctgactaaacacgtttaggtcactcgtcccagtcaccaagtgatcccttcagccttggaccctcccttactgctgtgttggtacagccctggagccaccccttactgctgtgttggtacaaccccgggtcccctcacttactgctgtgttggtacagccctggaccccccccccccgctccaacttactgctgtgttggtacagccccggaccctccccaaccacttactgttgtgttggtacacaactaccaccccaacccaagtcctggaagcagagtcctcttctcctggaagccatctgggagaacaatggctttattcagatgttggtgcctctgcccctctggtgcccccgatccccacaaggggccgcgaggcgggcaggtcacagcaggttgaagtcccctttgtgctgttccagccactggtccagcgtcagggccttggggttgagtctcagggtcagctcgatgtcacggtcgggtctcagggcatagaaacggaacatgttggccaggtcccgggcaccgggaaagccaagcttttcgtagtcctcaggagtcatctggaagcagaggagcctgtcgtggccggcgtcctccagtgccccgggaggtggcggggcagggaggccggatgggctggggtctcccgacctgctacacccagagccactattgtctcggtccctgacccaggtcctccgtacaaggtcatttgaaaacttctaagagccgaaagttcagaaactgctgctctcctgagctgcctgacattgtagatcagtttaaagattgttcttggccagatgctgtggctcatgcccgtaatccctgcactttgggaggctgaggcaggcaaatctcttgaggccaggagttcgagaccagcgtggccaacacgataaaaccccgtctctttcaaaaatacaaaaattagccagcctggtggtaggtgcgtgtaatcccagctacttaggaggctgagacaggagaatcgcttgaaaccaggaggtggaggttgcagt

SEQ ID NO: 82040 - DNA, 1012 bp, Homo sapiens
gaaaacctacctactgggtactgtgcccactacctgggtgacaggtccagtcacaccccagacctcagcatcactcaatataccaatgtaacaaacctgtgcatgtacccctgaatctaaaataaaagtggaaattactttttaaaaaaaacttctaacatttttgattaaaaaaaaaaaaaacaaacgaacaggccaggcgtggttgctcacggagactgagacggcctcaaacaaacaaaaaaaaagtaattggatgagaaagcaacagcgtccacctgcttcacagcctagagcaggcagaggcatgaagaagagggaaaggcctgcagtgctccaacctccctgcagagtcggagctcctcccaggcgctctgctcctagcctggccgggcctccctgcagctcctgcctgccctcacctgcttgacctcctgctcctggctgcagctctcccagtaattggtcacgatgaaggtggcgtaagccccattcagggccagctccatgatgacctggtcatcttggtctccctgcactacttctgcaccttgcagcctcagctcctttgctgccttcttcctagggtttcgggtcaccactcgaaccttgaatgtcccatcttccaggagtgtgcgggccacggagccaccctgggcacctacaaagaatcaaaaagacctctcaggtcagacctacctgaaagtcccactgaagggcgaaaccccgaagggagtgctccaccacagcaaggagcatccaggaaaccttctcaacgacgattctcattcaggtatttttattttctttattttatttttttgagatggagtctcactctatcacccaggctgaagtgcagtggcacgatcttggcttggtgaaaccccgcctctatcaaaaaatacaaaaattagctgggtgtgaaggcacatgcctgtactcccagctactcaggaggctgaggcacgagaattgctggaacccaggaggcggaggttgcagtgagctg

SEQ ID NO: 82041 - DNA, 1033 bp, Homo sapiens
ggagttcgagatcagcctggccaacatggtgaaaccccgtctctactaaaaatacaaaaaagttaaacgggcggggtggcgcgtgtctgtaatcccagctactggggagtttgaggttggaggatcacttgagcccacgaagtggagattgcagtgagctgagatcgcatcactgcactccagcctgggtgacagagtgagaccctgtctcaaaaaagaaaaaaataaattatcacaagacaaaatttgtgcttatcaggagttcacagttaagacatatataagcttacttggtgaaattagaaaaagttatcagataaaacattcaggtttaaacactggtgagggtgtgggaatttgtggagccttggaaacacactcattgaatgacctcatctacctggggatgtgaagagggaaatcctgtgattcctccattgtctgacttgatttccttttttccttggctgtggcaacatgttgaagtgctgtgagtcaccaaaagggggaacgtgagcaactctagaaatgccagtgccagtgagttacagacaataaagcattgaccgcctttagctcacccctcatcaagtctgttgaaaacttgtaaaattggacagctagagctaccttgattttttggtttccttttaacagctgactctcttcacaggacagttgggctctacatcaggattgcacccaaaactggaatatcactcctccaggaggaagatatatttgaaaattagaattgtgggcccggtgcagtggctcatgcttgtgatcccagcactttgggaggccgagatgggcggatcacctgaggtcgggagatagagaccagcctgaccaacatggaaaaaccccatctctactaagaaaaaaataataataatacaaaaattagctgggcatggtggtgtgtgcctgtaatccgagctacttgggaggccgaggcaggagaatcacttgaacctgggaggcagaggttgcgatgagccaagattgtgccactgcattccagcctggg

SEQ ID NO: 82042 - DNA, 1033 bp, Homo sapiens
ctgccttggcttctcaaagtgctgggattacagacatgagccactgggctcagccattaattttaaattgcaagtgacatattctttagtttattaatcagcaccatatgatgtcacagttttataactcatttatctcatttaattctcatacccaccttgtggaattgttatcactgtcctttacagatgaagaaagaaactccaagaaattaagtagctggcccaagtccacccaactgggatgggcagaaccagggtttgctcttggttgtgcctttctacagcctgtgccttaaccacatctatgtgctgcctcttggcctctgtgtggccagtagattctctcatggctaggctcatcttaattaacatttgttgggtgcctactatggctcaggctctagagatcattgtaaaatccagtccactgccccagctcctcgtgtgtcttttgaacacattagtattgtgctgtgcagaaaggacttctgtgcatatgcctgctattacacttgttgaacccaatttctacaaactttcattcagatggagggattcagtcttcttatcatataatacatacagaaatacaaatatttaaatatttatctaaattaatagtcacatatgccatttatacagttagtgagttacagccaagtgacagttgtgatgggaggctgtgtctggggagttacatactggtgaggaaactagaaaacatggctgtcgggccggcactgtggctcacgcctgtaatcccagcactttgggaggccgaggcgggtggatcacgaggtcaggagatcgagaccatcctggctaacacggtgaaaccccgtatctactaaaaatacaaaaaattagcggggcgtggtggtgggcgcctgtagtctcagctactcaggaggctgaggcaggagaatggcatgaacccgggaggtggagcttgcagtgagccgagatagcaccactgcactccagtctgggcgacagagtgagactctgccacaaaaaaaaaaaaaaagaa

SEQ ID NO: 82043 - DNA, 1057 bp, Homo sapiens
tggcctgccctgttagtcatcaaaaatagatctcaccagggaacaatcttctcaggttgttgtgtaatttgagtgagccaaggtgagtgttttagggacaagcagcatcaacttcggaatcttcaactgggcctgagcacttatttctcagaaataatagaatcttgctcacttttctttctttttttttttttttttagatggagtctcgctctgttgcccaggctggagtgcagtggatcagtctagctcattgcagcctccacctcctgggttcaagagattctcctgcctcagcctcctgtgtagctgggattacaggtgtgcgccaccacgcctggctaataattctatttttagtagagttggggtctcaccatgttggccaggctgctctcgaactcctgacctcaagtgatctgcccgcctcggcctcccaaagagctgggattataggtgtgagtcaccatgcctggcctcttgctcacttttcatactaaaacaacaaattacaggctgtagtttaacctctctactgcatgcataaatgcagtgtggtacgagtgcctctgtagcccataacttcagtttccttgttgctagcagtctgtggtgacactatactaatctcacatgcaggaaccaatgaggattagccagggacacaggaggagtcaccttgcattcagaatgactcaagtttagtctcaacttgaccattagctctctgagtgatcttgcccatgttaattctcttgatcttagtttcttcagagccagtgagacattgcttgaaagtgacttagcctggtatacccaggtctgtcagacttatagtctggtgctctcttgggtgaacttgagggccttctgccaaggcaggaatggcttcttttaaaaaaaaattattttattattatttttttttttgtagagacggggggtctcactatgtttcctaggctggtctcaaactcctggactcaagtgatccttcagcctcggcctcccaaagtacagagattataggtgtgagctaccagtaccagcctccagg

SEQ ID NO: 82044 - DNA, 1049 bp, Homo sapiens
ggccttcagaccttgatttataaatgttttcttttttttttttggtaaaagtacagctttgctagccgggcgcggtggctcacgcctgtaatcccaacactttgggaggccgaggtgggcagatcaggaggtcaggagtccgagaccggcctggccaacatggtaaaaccctgtctctactaaaaatacaaaaattagccaggcatggtggcacacacctgtaatcccagctactcaggaggctgaggcaggagaatcgcttgaacctgggaggcggaggttgcagtgagccgagatggagccactgcactccagcctgtaatcccagctacttgggaggctgatgtaggaggatttcttgagcctgggagacagaggttgcagtgagtcgagatcatgccactgcactccagcctggccgacaaagtaagactctgtctcaaaaataaataaataaaatactttaaataataagaacagctttgctgtacacccttgaggaccctgagagccaaaatttgtctctggctgctcagttctcaggcagcagagaaaaaggtgctgggatgaaaacactgagctatctagaggagggaggggtgcagtaaagggtcctggagcctctagatgggtgatggaagtaaaggaccaggctgagggcacacacacaccaggctgagggtccaggtaccccaggaccacaggccccatgcttcttacaggcaaaatgaggcaaagacaagtgccatccatggcccaggttaccaactgcagtaacttcagcgtgcttcttgccatttgcacctacttatcatgctgcacaacagtgatagggaacgtgattaaatctcattaactgtgttttactcaataataactgcatgctctgggagagtatagtcttgcttaattaaacaacaagtccttgtgcttctccgaaaaatacaaaaaggagccaggcacagtggttcgcacctataatcccagcatttagggaggccgaggtgggcagatcacctgaggtcagcagttcgagaccagcctggcca

SEQ ID NO: 82045 - DNA, 1111 bp, Homo sapiens
agcctgggtgacagagcgagactctttaccccgccaaaaaaaaaaaaaattggttctcatggcttagatagaataacatagtggtgtgaaggaagcaaaagtatgcgtgttccaaagacttcaccatgccattcctttaagaaacaaaagcttccttgtgtgttaaataattcactacataaaaatggaccataggattgggtctttggggttgggggttgtcacttgagcctctgcatccagctgctcggatgtggtgtgctcaggcatagctggcctcctcctgtcacctccacagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcaggtactattgggggctgccagctgctagggctgaagagggaaactttgacagtggtagcagatccatagtggcccatgaaggcacacatggcattaggacagatgagctgcagggtgccgagaggaaggtggccaccagattggccaccagagcttgtgggcccagtgggtggttcccagcatggaggcctggtgtgatagatgccagtgggtagtgttttgggaagggtgagtcctctcgcacatagaggggtctggaagaatggagctggcttcctccctcattgcaggatgctggtcttgaagaatggttaattttctt

SEQ ID NO: 82046 - DNA, 1704 bp, Homo sapiens
cagaagtgtggaagcctggagtagagctgggtcgggggccaggcttgctgcactgtgccgactgctcccagggtgacggcctgtgcccagtgcggaatatggcccatagagaggatgctgtcaggcagaggctctagcatctggcttttattggttgcctttcttaaacccagcattttttaaaaagtcacctgaggtggtagtttagtcagggctggagaaaggggtaggccagtggtcagtcgggaggagggtaccggtgtggcatgatgggtgcttcacatgtagtaccaggccaagagtccagcagctagggccacaccagcggccaggatgaactggaggctgggcttcctcagcacagccatagctgttcggaagggacagctgctgccctccagggcacctgtgtggcagcaccaataggagacatggcatcagtggagtctcctgctacacctgccccaggaggggagctcaggacacacagacctacctttgtcttgttcagcagcgtagaaagggcatttacgcatgtctcctttcccatcgtgtacagggaacccatcctccaaggtctctctggccagtgtggagccggcctggtccagttcattgaatatctgcaggagcagaggatcgactgagccatctttgggctgcccatactttttttttttttttaaatgtcttttgagatgaggtctctgttgcccaggctagagtgcagtgttatgaacatggctaactcactgcagcctcaaactcctaggctcaagtggtcctcccaccttatcctcctacgtgtgtgtaccaccatacctggctaatttttaaattttgtggggagatggtgtctcaccttggttgcccaggctggtcttcaactcctggggtcaagtaatgcccctgcctcagcctcccaaagtgctgggattacaggcatgagctactgcgcctggctacactctccttttagaggacgccctccagagagagtgagctggagcaggtgagcttgctcaggtgtgccaactacacagcaagcagcactggtgggcggcagctgcactgcctgatggtcttccctccctagcaagagctctggggaggtgtggatattggtaccccaagaaggctgccaaatgctgggtctcccctgggaactgaccagagatgtagccttctctgaggtggctcaagccactgaaactaccacagcacagacaggagggcatgagtacatccccatttctaggtgctggttatttttttatcaagaagcaacagaaaacctggaacatgggagaatgagactgtggcagggcatactcatcctgagtgccctgggaggcctcagtggaagctgacaggacctggggacagagtaagcttccccaggttcagcctcatctaaaggctacttgtaaacagagcttatttactctccttggtggcactggctctctattaacttataaagcagggcttctcagagcaaaacttgaaaagaaaattaaccattcttcaagaccagcatcctgcaatgagggaggaagccagctccattcttccagacccctctatgtgcgagaggactcacccttcccaaaacactacccactggcatctatcacaccaggcctccatgctgggaaccacccactgggcccacaagctctggtggccaatctggtggccacc

SEQ ID NO: 82047 - DNA, 1928 bp, Homo sapiens
atggctcagtcgatcctctgctcctgcagatattcaatgaactggaccaggccggctccacactggccagagagaccttggaggatgggttccctgtacacgatgggaaaggagacatgcgtaaatgccctttctacgctgctgaacaagacaaaggtaggtctgtgtgtcctgagctcccctcctggggcaggtgtagcaggagactccactgatgccatgtctcctattggtgctgccacacaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagctacctccttccctgcctcctggcaccgggtgggtcaagccacctccccataggagagtccctcagaagcaagggcatgttatgtctgtgtggggagtggacatcgtccatcatggctcccagcagccacctcctgctctgggtctactctccagcacctctagtctccaaagcaaagtcactctaaccgtcttgcaaagatctttaaagtgtatccagcactgctattttttagctcagaaataccttagaggtttcctacttaaaaggtttttttaaaatatatatatatatttaaaaataagggttttaaaaaagcacatatttgtatttaaacaattcattctctaaaagagaaacatgaacttaaataattttattaataggaatctactacctgtaaaagttttatttcaaaaagggttaaaaagtagggaaactctttaaactactgaccaagactgccaccttcataattcagatgagttagtgcagagatggccagggccagaggtcgcccagaacctgcgtgtgcagactgcgctctgttagtcttctgcctgtcagcctcagcccagtctgtgttgcttaagggtgcgcctccccagggctggatgatgctgtgctcaagcctgcgggtaggagggctccagcttgcagatcccatgcgtggatgccatatatagatggttgaaaccagcatcagaggaaggaaggtgaccttacagccactgccgagaccaacgtgtgccctggcccagtcacagctggaaatcccagggctggtctacacccgactctggtttggtttaattaggtccttacgtgttggtgttgtcccaggcagttggcatggcatcagcactgagggtgtgagaccctgaggactcagcctcccgtcctgccagtagactgcctgcagccccaccctctttccctcaaaaaagaaggaagccaggcaagaga

SEQ ID NO: 82048 - DNA, 2115 bp, Homo sapiens
gccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatggggtaggtggtgtgggcactggtagggtgggggctgcaccagggtcaactggctgcctctgcctcctccgcagcaggcctcagcctgttcttccctgtctctgattcagatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaacacagactgggctgaggctgacaggcagaagactaacagagcgcagtctgcacacgcaggttctgggcgacctc

SEQ ID NO: 82049 - DNA, 1031 bp, Homo sapiens
cctttatgatgctaagtaagagcaaaagcttcccacctttctgagctgtgctcagagagtttggtgacagaaatgagggaaaagatttcacttgactcttcttccccctgacccccacctcaacaaacaaaccagaagggcacaggccagagcacagcttgcctggcagtccagtcctcatgcatgggagctcaggcctggtgggaggggaggcagagggcccagccgtggcccttgggtgccagcagtcctgggggagggaggaagcagacctgcgacgggaccgaggaatggaggggtggtcgggtgtgtggatggcagagtgacagctagggagaagccggatgtggaaggggaggaactgtgtggtatgcccaggcccctgggcccagccctggcttggcagcccttgctccctgctgagggccctgcctttccttcccctgaaacagctcccggagccctgcctgttccctgtccatccaggccagcagctgaaggagcctcacctgcctcccttctctgagtagcacggatttgaggtaagaaatcccccagaacccccattcccagtgcagcctgtggcagagatcggtccagtgtctcctccgactgccttagtgcccgctaaacgtttggggaggggagagctcggtgccaaactgctctcgtgtggggcaagtgctgagttaggctccttgggggactttacctcactgggccctgcttcctgggttctgtccttgcccttcagcttccaaacagggaagagcaggtgactactgagaggtgaggatggtggctctgggctaggtggccctgggaaaggtgggggatccccagtgcctggaggcagacccttctgaggatggtcacacgccttgtgcagcatcttggccaccccacagggctgaaggagaaggaacctggctgggagcttagttcatgtctgggttttccctccatgtccaggagaagcagcgaagatgtccagcgagcctccccctccttatcctgggggccccacagcc

SEQ ID NO: 82050 - DNA, 1058 bp, Homo sapiens
ctgggaccacaggtgtctatcaccatacctggctaattttatttttttgtagagatgggatcttgttatgttgcccaggctggtcttgaactcctagctttaagcagtcctcccaccttggcatccaaagtgctggaattacaggtgtgagccactgcacctgtctgtgctgtatatttgtaatgacacttgttaatacttaacctgaaaataatttaccaataattaaccagtaaaccaagttttattactcatgtggaagatgtgggaggtggtcagttagttgctggtgtggtgtcccatggctgtcctaggcactggcctccatcccaaggccctcatggtgaagcacagctactggagccatggcatctatcttccaggtggtagatgggaggaaggcaggaaagatgaagggcctggctccgggctgagtcggcttgccctgaatgccttcttatggtctggacacttctgcttacagctcattagccaaagctttgtcactctaagaaagctcggggaccctcttggttgatggacttgccctgagtgaaagtggagttctgtattcaagaatgggggagagagtggatttgggtgcagctggcaatctccagtctgtacttcattaggcggaacattgctgtttgagatcttgttattctgccttcttcctttgcagtgtgatgtggaggagcacagcacagctctgtatgggtggtggtatctgcgtagtaattcatggaaggcgtctccagcaatacagcctggacatctacatgtgggattttgttcagccttccaagaacctcattttgcacgtggggaaactgaggctcagagaggttgaggaatttgtctagggctgcaggccatcagcggcgaggcagggtcccagggagacctgtgctctcccaatattctattgacagtcaagcaaagaagaccgctgtctttgtttccaagtgccacaatgcaacaaggctgaatggtgccggaggtctcctggggaagcctaaagcctgaggagaagggcctgggacactgtccagctg

SEQ ID NO: 82051 - DNA, 1044 bp, Homo sapiens
cgtaattacaggcatgagccaccgtgcctggctaggctggtgtcttatttccgctgagactcatcatggtcgaggaggagcatgtagggttgggtgggaggagagctggcagatgggaaaaccagatctgttttctggtcctttctgtgacttaagttgagcttgttttgaagtgtttagaattcccaaggcatcagatacacccatcttcaagtgtaaaaataaataaatggttcagagccacccgcgatgttatctgagggagggactgtctcgtcctgcctccatcaggacaatgggaaatgggccatgttcaggattttccaggcctgcctgtgctagaacttggcagccgaggacaacggtcccagagaaggggacacattggcaacctccctgagtcttgggagggctcagcctcactagaggctgctctgcaactgagtggacctttgtggagggcctcctctttcctgctcatcacccagcgttgggaatagggtccctctggtcagctgcgaaaggccacagggaatcctggcctggtcccacatggacttgggtggctggattagccccaggtttggatagggcatggtggagaggggagtggagagggtttggggcccaggagcagtctcacagcaggggctcccttttgagcacctcctcacttggagcacttccttcatgtccctgtgctgggcacctgcatccaaacagtgcatgctctattaacgttcactgcacgccatcgtcctcctcagctcctccttgagccagtgctcatgctgaaatgagcactggagttgcagaagaatgtgtcctcgctccaaggcaaccagctgcacttctctcggggcctgttttaactacggaagcatctgctccagccttcccgccagggagtattccccatgccttggcctctgtactggctgaggctgtgtcatgtgacctaaagaaagccatgatccttttgatcatggatcacttgaagagaacttgtgttccttcagacctaaggaactgtagagatatatt

SEQ ID NO: 82052 - DNA, 1007 bp, Homo sapiens
agacaaaaaatgtgttacgtatgtaaatacatctaaagaagaatcacactgtgctactgcttttttattcttcactcactgctatattaaaaccatttttctatgtcaataaaaatctatatcattggccaggcatggtggctcatgcttgtaattccagcactttgagaggccaaggtgggcaaaatcacctgaggtcaagagttcgacaccagcctggccaacatggtgaaaccccatctctactaaaatacaaaaattagccaggcttagtggcgggtgcgtgtaatccttgttattcaggaggctgaggcagaagaattacttgaacccgggaggcggaggtcgcagtgagcctagactgcaccattgcattccagcctgggcaacaagagcgagactccatctcaaaaaacaaaaacaaaactatatcattttttaggggctgaatacagttacattatatagctaatcacatgcatgtaaccagttccattttcttgaacatcaagacagtggtgcatataaacatctttgcctgtgaatctgtgttcacatgtccatttacctctagaacgaatacattgaagtggaattgagtccataagagtgtacaggtagcaaggctgtccaggaaagttgtactgatccactatgctgtggccccgtgctgtggacggagtgtcaccaagtgagagtggtttgccaggaggttttactaaaattcagcatgatataaattgcacagtaattgtcatcatcatagttcctagaggccttagtacttttaggtttagaaccattctttgagtcctgtctgccttttgattttgcttctgcttaagagcaacagtgtcaccgggtgcggtggcacttgcctgtaatcgcagcactttgggaggccgaggcaggtggatcacgagatcatgagatcaagaccaccctggctaacacggtgaaaccccgtctctactaaaaatacaaaaaattacccaggcgtgttggcg

SEQ ID NO: 82053 - DNA, 1597 bp, Homo sapiens
ctccacctcgtgggttcaagtgattctcctgcctcagcctcccgagtagctgggattacaggcatgtgccaccacgcccggctaattttgtatttctagtagagatggggtttctccatgttggtcgggctggtttcgaactcccgacctcaagtgatccgactgcctcagcctcccaaagtgctgggattacaggcgtgagccactgcacccagtctatatactgtttcatataatgcagtgtaaactactaattcagtttgtttcacacccaaccaatgtaagtgaattcttagggtcagatgccaactaagagtgatagaaactcagttaactaatttccatatgctatatactgttgcatctaatgtagtgtaaaatacaaattagattcccactctcagttcctagagcgctttcttcacccatcagaaatgtcttcaaaataattgaaagaatgccctgtaacatgagagatctaaatgtcgcagggatgagccactgtcctcactgttctgagggaaaattgctggagggggagcttctgtgtacaggtatgtatggtgactgacacatttggaggaagaaagcctagaggtttgcttttccacatcccaccccgacccacggaatagggggactcaggcaagacctggccgcgggcagagcccagctccctggctaaggacggccaggagacatttgtgtctgaattaagactcttccacctgggtggccgtgagtggccacgtgtcttgactgcacttaacggcctggtgcttttttgtaggttgcagtggtgtgtcttgatctcatccaacagacagctggttgaatagagtcaacccaagactgtccattttgtgtctgctcagtacaggcagacagaaggattttttttaagggctccattttgagcacttaaatgatggttctttaggttcatgctgtttctaaaattagtcagccttgtagttaccaaggcctgcctgtgggacaggtgcagatgacttgtttattcacttgtggttgagctgtgtctgattttttccttttgctctgcatttcccctcctgtctgtgcttccttcattttctctgctagcaggagagcatgcaggaacaagctcttgagcagcgttctgcctgggaggtagttcagagtcctggcgagatcactgggcgagttgggaggccggggctgtgtcctcagcatgggctctatcactcgtttttattatgcatccaacggggactttcttaccagccctctttggtcaggtgacctcctgctgggtctcctggcggggtctcctaggctagcaggactgtgaggtcattacattccaactttacagatctaaactttccatttgcctggagtaccgggaggtgatctggcagaactgactcatttgaccaaactcatgggagacctatggccataaggggctggctttggagaggaggccactaaccagtccaggcctctggcttgctctgcagagcattttctcctgtaggtgaaattagattatagtctgaggtgtgtttctggattgaggagtatgaggagtagtatatatatatttttttga

SEQ ID NO: 82054 - DNA, 1070 bp, Homo sapiens
atctgagatctgagaagtgctcacttgaggccttctcccctgaacagggcaggactcttcaggttcaaggatgaggccgtttcactcagcagagccatcaccatccaagttcctctcttttttgtttaagtgactacctgtttgaaaagactcatcagaccctccatggaggtcactcacctcatggtccctgccctcagggagctgcagatctacctggcaagacaagtgacacttgagaagaacttataaaaaatacacaggcaagcccagcaggagctgtcgcctctgtgacagcaggtgctccagcagagaaaaggtgaggcctgtcatgggcttcacagccctgcagggaggtggccagggaattctgggtctagggcaatggagtcactcataacatgcagaattagaaagttgtgatcaaggccatctcccagtcagacccatagctcctgcagggcagggtcagaccttggggccagtttctccagggcaccgggcagcctgtgaaacatgggttagtgggtggatgggctgcagcttggctgctgctctaggcaggaactctgctctccagccagaggacccttctgttcacttcactcccattgccaaactggatggctgagaggcgctccagacctttctcgtctccttaaaccatgaccagtcagcaagtcctactaactccatggttcaaaggccctcagatccactatctcatctaacagtcaagggtgacagggaagagtctggacttggaccatatcccagatctaccaccggatcgtaactcacactcctccaaactatctcatccccccacccttcccaagcccacccccgtactctttccctggcctccaaacacgcccacaccccacttccctgcaaacctgggccttcctgaggattctgctgccaggggattctctgtcccttgtcttatctcccctcaagaatcctgggactctcccacttgtattgttgggccctgcttggtgcctagtccatgtgtgttgaagaaatgagtgcacaggtttggggttgacctaagtggacctcct

SEQ ID NO: 82055 - DNA, 1055 bp, Homo sapiens
agactgtttcaaaacaaacaaaaaagaatggcacaggaggtccacttaggtcaaccccaaacctgtgcactcatttcttcaacacacatggactaggcaccaagcagggcccaacaatacaagtgggagagtcccaggattcttgaggggagataagacaagggacagagaatcccctggcagcagaatcctcaggaaggcccaggtttgcagggaagtggggtgtgggcgtgtttggaggccagggaaagagtacgggggtgggcttgggaagggtggggggatgagatagtttggaggagtgtgagttacgatccggtggtagatctgggatatggtccaagtccagactcttccctgtcacccttgactgttagatgagatagtggatctgagggcctttgaaccatggagttagtaggacttgctgactggtcatggtttaaggagacgagaaaggtctggagcgcctctcagccatccagtttggcaatgggagtgaagtgaacagaagggtcctctggctggagagcagagttcctgcctagagcagcagccaagctgcagcccatccacccactaacccatgtttcacaggctgcccggtgccctggagaaactggccccaaggtctgaccctgccctgcaggagctatgggtctgactgggagatggccttgatcacaactttctaattctgcatgttatgagtgactccattgccctagacccagaattccctggccacctccctgcagggctgtgaagcccatgacaggcctcaccttttctctgctggagcacctgctgtcacagaggcgacagctcctgctgggcttgcctgtgtattttttataagttcttctcaagtgtcacttgtcttgccaggtagatctgcagctccctgagggcagggaccatgaggtgagtgacctccatggagggtctgatgagtcttttcaaacaggtagtcacttaaacaaaaaagagaggaacttggatggtgatggctctgctgagtgaaacggcctcatccttgaacctgaagagtcctg

SEQ ID NO: 82056 - DNA, 2390 bp, Homo sapiens
aggttttccacaggatgggagaaccagggaagagctttacaggttctcttacaaaggttcatttatttatttagagccagggtcttgctctgtggcccaggctggagtgcagcggtgccgtcacgacgttcactgcagccttgaactccttgtctccagcgatcctcctgagtacctggaactacaggcatgccccaccatgcccggctaatttttttttttttttttttttgtagagatggcatgtcattattttgcccagctggtctctaactcctgggctcaagtgatcctcttgcctcaccctcccaaagtgctgggattacaggcaggagctaccgtgcccaagttcttacaaggatttaagagcagccagccgtggttctagaatcaccataagagcagaacattgactgtatgatgtaaagtaatacttcagggaacaaaattgttttgagaaggagctaacggaatgcgtcccgaaggccagcttgccccagcagatcacgttggcaataattgaagctagtcatcagcttgcaactccctgtcggctctttacactgtaagcttgtccaggttgaacctaccagttcagtgtgtgttttctaaggtctaggggaactggggtgtgtagtgcaatttagctcatggtgttgatggactagaggccgtggctttgagacccttgggcccaggtactttgttccttagccacaaacaccagcccttcaccctactcagttgcctgagtgggagagaaaagataggccctgtgaaaatttgtctccactttgaggaacatggttccaagggtaaggacatgtttttactcatagaagacacagggaaatatggtagttaaagttgtggcattttatagcatgtcactgtcctgtaggtggaggaagtgctggtgagaaggtggcaggcagggagagctctgcagaggaccttggcgctccatggggaggatggagagagagagccaggccggcagtggtgacaggaggttccctttcccccacgaggggacttggaaatagattactcaaaatggaaatgtgcccctttctaggatcccacaaaaagtttctgtttctgtctctgcctagtcaggagtctccaagccacagtctctgtgggaggtggtaaaggctaccttgcaatacagtgcagcagaggtggaggcgcctagggcctgggccagaacctccccatgcccagagggctgtccactcttggagacactggtctggtggctcctgaacccgtgggcctgatggccccggtcaccacttctcctactctgtgagtcatcaggcagtggtccatgacattggtggtgtcctgggaccagggctgcctagacgtggagacctctctgtcatgttgaagctgtgtgacagacaggccttgctggccgcgtctgtgataggtgaagagcatcacccaggccacaggaaggcctgcatctgctgttagcgctgaagagatgaagggtccctgacggcagacaaagcaaaaccaatacagagcctgcagtgcagggtgagggggtccaggagcattctgattctttccttgaaagcagttgtgatgcatttttggtaatactggaccatttttccaggaaacatttcttgtcaccttttcagtgctcctgatttgtgggtgagacctggcttggtctgtacattgagtgattcagtaccatcgattcttactgcaaggaggtgtaatgggggttcagtaaacactgagggtcttcctgagatgtaattgttcaatcaatgctaattaagtctgaattcagatctagtcccagtgtctgggtttttcccccaagaaggaaaagaggccaagaaaggtggaagtaggtagagaagagtgcgagagctgccttgggagggtttagggagaatttcaacccgtattacttcaggaagaaagcgagcttggttgtcacaattctgattaacatgcaggccgggtgctgtggctcatgcctgtaatcccagcactttaggaggccaacgggggcggatcacctgaggttgggaatttgagaccagcctgaccaacatggagaaaccccgtctctactaaaaatacaaaattagccgggtgtggtggtgcatgcctgtaatcccagctactccggaggctgagacaggagaatcagttgaacctggcaggtggaggttgcagtgagtcgagattgtaccactgcactccagcctgggtgacagagcaagactctatctcaaaaaatcaaacaaacaaaaaccaaaaaaaaaaaaaaaaaaaaaaaccatgcaaacagcggcctcacaggctggggaagcaggaggaaatggggttctttgcagtgtaccgccctatgaaca

SEQ ID NO: 82057 - DNA, 1044 bp, Homo sapiens
gaggaggcgctcacagggacggttctttccctattctccagcctcgtgtacattgggcaaacaggccccgaccatcccacgtgctcagccccagctctaggccaaatcgcctccgctcccactgacgtcatcacggcgcatcacgtgcctcccgagaccccaccccccaccgtgacgtcccgggcctcggccctggtccaaagtctacccgcctccttgtgacagaagtgcgactgccagctgccgaggcgttcggtcctgctgttgcggccgctgccccagggctgcggggacggtgagtcgactggacgcattcggagacggcttcgcgcgggagccctcctccccgggggaagggtctgggcgccagctctcctcaggtcggggcgtgacctcggaccgtggcgccccctccccgcccccgcccgcggcgcctgggcggtgcatgccgggcaccgtagtccccagcctctcagagcgggttgtggtggggggggtgaccgggcggactacaagtcctagaagcctctgggcggtggggtgggcggtgggttggggggtttcgttgtgcgcgcaaagccgcgcggggctgagggtcttgttctgccggcgcctgtccggacccgggcccctctccgctttcggccggcctcgggcaccgggcttctggaggtaaagcggggccggcggttggggcgcggcatggcggggcccgtcctcccctcagggcgctgccgagacctagcgcggccctggggatgtcgaagccgctgcggtggcggggcccgggcgggcgccccgctgtgtgccgcggggttgtgcgcccggaatggcagcctgctcgcccgcacgtttttccgtcagggaaggttgtggaaattgccatctccgtcttgcagggcgagacggggaggggaggggtgggagttgttttctcaaggaaagggggtcgaggaggagccccgtggccgagccagcccctgccgagccccgcgggtgaccttggccgtcccggagcccagcagtgtcctgcacccgcgcccg

SEQ ID NO: 82058 - DNA, 1291 bp, Homo sapiens
ggagcaagactgtgtcaaaaaaaaaaaaaagagaaaagccttttgagaagagtgcaagttcttttatatatttacaaaacctttattcactcaatttttttgtttgtctttattttttaagattgtattacttgattttattttacactaggtggtgggcacacaaagcaatccttaataaagttgacaattagcttcattcaacatttttaataatgcacatataaaaaaagtattcatcttacaaattcttctgcaatccaaacatataatagcttggagaacatttagaaaacaaaagccaatgtaaaaagacagattaaaacaactagaacagtacaggttttatttatatggctcgaattttacaggtttcttactgtatcatcagtgtcagaaatctgttctgtcagctggctccattgttctggatttaaagaaataccttttcttcctggtttcatttcaccttcaggatccatccaatattctccaatatcaattagcactttgcctttaaaatcttgaacgccaacgtacctcattttcccaatctgaaacatgttaccatctctgctgctgctcctctgtcagaagatgacagagctctccaagtttcgcctgtcttttgcttctttacaggtttttctggagcaacttgctttttcctctttaagtttttgtcaacctcactgtcagaatcactgccagaagagtttgaagaaacaagttcctttgctttaggcatcgcttcgctcggctctagcagtggaacaccctcttgctcgttcgctcatgactgactcgtttgtttttatttttaaggcagggtctcactctgtcgcccaggctggggtgcagtggctcgatctcagctcactgcagcctcaacctcccgggctcaaccctggaggcaatcctcccacctcaacctcctgagtaggtaggactacaggcctgtgccaccacactggctaatttgtattttttgtagagacagggtgttgccatgttccccaggctggtctcgaactcttgagctcaagtaatcctcccacttcagcccaaagtgctgggattacaggcttgagccactgcgcccaccctctgttaaccttttttttgtttgtttgtttgttttgagacggagtctcgctctgttgcccaggctggtgggcagcagcatgatcttggcttactgcagcctctgcctcctgggttcaagcgattctcctgcttcagcttcctgagtaactgggattacaagcgtgcaccaccatgcccagctaat

SEQ ID NO: 82059 - DNA, 1105 bp, Homo sapiens
tggtggtgcacgcttgtaatcccagttactcaggaagctgaagcaggagaatcgcttgaacccaggaggcagaggctgcagtaagccaagatcatgctgctgcccaccagcctgggcaacagagcgagactccgtctcaaaacaaacaaacaaacaaaaaaaaggttaacagagggtgggcgcagtggctcaagcctgtaatcccagcactttgggctgaagtgggaggattacttgagctcaagagttcgagaccagcctggggaacatggcaacaccctgtctctacaaaaaatacaaattagccagtgtggtggcacaggcctgtagtcctacctactcaggaggttgaggtgggaggattgcctccagggttgagcccgggaggttgaggctgcagtgagctgagatcgagccactgcaccccagcctgggcgacagagtgagaccctgccttaaaaataaaaacaaacgagtcagtcatgagcgaacgagcaagagggtgttccactgctagagccgagcgaagcgatgcctaaagcaaaggaacttgtttcttcaaactcttctggcagtgattctgacagtgaggttgacaaaaacttaaagaggaaaaagcaagttgctccagaaaaacctgtaaagaagcaaaagacaggcgaaacttggagagctctgtcatcttctgacagaggagcagcagcagagatggtaacatgtttcagattgggaaaatgaggtacgttggcgttcaagattttaaaggcaaagtgctaattgatattggagaatattggatggatcctgaaggtgaaatgaaaccaggaagaaaaggtatttctttaaatccagaacaatggagccagctgacagaacagatttctgacactgatgatacagtaagaaacctgtaaaattcgagccatataaataaaacctgtactgttctagttgttttaatctgtctttttacattggcttttgttttctaaatgttctccaagctattatatgtttggattgcagaagaatttgtaagatgaatactttttttatatgtgcattattaaaaatgttgaatgaagctaattgtcaactttattaa
